United States Patent 12,642,819 (COMPOSITIONS AND METHODS FOR TREATING INFLAMMATORY BOWEL DISEASE) - sequence listing, part 49

SEQ ID NO: 17 - DNA, 2169011 bp, Bifidobacterium adolescentis
tcctgctgaaccgcgactcatccttgagtatgagatcaacgcgggaacagcgaaaactggatgatcagaaaccatgttccaagcatcgggcaatcgtcaatcgcctagcaatacgccttcgtgcggcggctcaagccaatacgactccttttccacactgacggtggacgcccaccaggtctgttccacgcctggcaatgggcgaatggattcgtccaccacgcgccataggtcctcatcgttgtcggcgatgatttcaatcaggtaatcggcaccgttcaatccgacaccactcatcgcgtacgtcacttcgtcgatggccagaagctgttcggagtcaagccgatatggaggtttcactccaagtccgaggaatgcctgtcggaatcctcccaaacgcatggggcttaccgtggccataatgcgcatcacgccggaatcttcgagttttttgatgcggccgcgaatcgccgtatgggtcacgccgagacgctcccccaacgacgcatagctggccctgccgtccttctgcagttcgttgaatgtgtgcacgaaccgtggatccagacgatgcgagggaatatcggtgccgacactcgcctcgcgtttggtcaggaagccggtttcgccatgcgcggcgagcagacggttcaccacgctgacattgtggtcatcaagcaccagccgtccgcatgagaacacctgcagacgggacaatcccggcaacgcgcgcagaccatgtttgaggaaatgatccatgccttcagccgaatacaccacagcctcagcgatgatgtcggcatcccccagagcgcagaccacgtaggtgacctgtggcatggattggagcatggcaagagcctcatccctgctcccgtcgagacgaagtcccaccagcacctggctgtaattgcccagactcaatggattgcacaccgggacgatgctcatgatgccggattcagtaagcctgcggtagctttccgtagccgcgtagacggaaatgccgattttgtcggcaagcgcctgcatggtcatacggccgtcgcattgcagggccgagaccactttcaggtcgcgtgctgtgatggtgatgcgttgttcgttctggaacattggcctacctcagagctgccacagcatcagccagatgctgcctgccgtcgcggcgacggtgaccgcaaggatgatccaatcggagagtctcatcttcagctgtatgcggtaggtgcgtctcacgccttggaggttgagcccgcgcgattccatagcccagccgacgctttggctcattttgtaggcgcggatcagcaccgcgatgatgatgggcaaatacgatttgaaccggtccaccaagcgtacgaatacgttgcgtttcttgccggtagcgtctttcttgccgttcaagtcgagtccgcgggcccgttgcgcggccgatacggattggaagatggagaagaacaccggaatgtagcgcagcgcggtggcgagcgtgagtccggccttgtacggcatgcccagggaggtgagccctcggatcagcttggtctggctggtggtgaacaacgtgaggaagcacgcgaatccgagcgccggaatgcgcaatcccatcaccgcggccatgacgaggttctctcgcgtgagtttcagccatccccactgccacagcacgtgcgtgccggatgggtcgaaaatcggccagagcaccacgatgaacacgatgatcacggcgaggatcttccacacccagccgatgcgtttcagcggcacgccgtcggtgatgagcatgagatgttcgatgatcagaacgtcaagtatgaacgcccagttgcgccataccaggcacaacaccaacatgaccacggtgatgaggaatttcacacgggggtcggcgcgatgcagccagccgtcgcccggtacatacaaatcggcgtccatcagtgtcgtccttcctcatgcttggtgactttcagcagcacatgcgtcgccgaaacgggcccattggatttacgcggtttgcggatggtccgagattgcttctgcgccgcttcggacctgtcgatcggcccatactgcacgacttttccgtcctccaattccagcacatgcgtgcagtaccggtataccgcgcgcatgtcgtggctgatcatgacgatggtgacgccgcgctggttgagtttctcgatggtgccgaggaagcgtgctgcgagacggtggtcgagaccggccgtaggctcgtcgagcacgaggatcggcgtgcgcattgcaagcacggatgacagcgccaccgcacggcgttcgccgtagccgagcgtggccggcgagacgtcttcataacggtgcaggtcgaacagcgtcagcatctcgtcgacgcgtttgaacacggtggctccgtccagtccaagcgcggtaggaccgaatgcgatttcctccttggtggtggagcagaagatctgatggtcgggattctggaagacgaatccgacgtgggccgccatttcgccgacgctgtgtttggaggcgtcaagcccatctaccgtcaccgtgccctgcgtgggtcggatcagtccgttcagatgtttggcgagtgtggtcttgccggagccgttacgtccgatgagtccgatgaatgagccacgttcgatgtcaaacgtcacgtcgtccagagctttcgatgcgttgccgccgcgctcatattggtaggagacatggtccagactgatgaccacatccttggaccgttccggctgattctttttgtccttcttatgctttttgccctgctgtacggccttgacctgcggcagcggatcgtccgcgacctgcacgccggaggattccagcagtcctttttcacggacgaacaggctggcgtcgccgttgcgcaccaattccccattgaccatgaacagcacttggtcggcccaataggcgatatgctccgtgtcctgttccgccatgatcaccgtcatggaacgggtctgccggatgcgttcaagcacatcgaagacttcctgcttgccttccggatcgagcgccgcagtcggttcgtcaaggatgagcacgtcgggttccgccgccaatgccgccgcgatggccacacgctgcatctgcccgcccgacaggctggccggcacgcgcttgcggtagccggtcatgccgaccagatcgagcatgacgtcgatctgcttgtcgatgatgtccggtacgatgccgcggttttccaaaggaaaggcgatctcatcctcaacgctcgcgcagaacagctgcgcttcaggatcctgctgcacgtagccgatacgttcggacaacgccgatacggaatgacggctggtgttcatgccgttgacttccaccagtccggtcatggtgccgtccgccagattcgggatgattccagccaaagccatgcacagggtggatttgccggcgccggtcggtccgatgacgcccacgaacgagcctgatttgatatcgaagctgacatgcttgaggctatccaccggcttgccgccatccaccaatggctcatactgccaactcaaatcacgtaccgtgatcatgcgctcttctccatatctttcagcacatcagcccattgcaccggccgcgaacacagccactacggatactatatgaacgaatatgtataaataaagcccgtggaatcgccgttcatcggtgaacccacgggctttatttatgcaagacaataatgtatcactcgccggccttgacgctgaggttgccgagtcgcaccagcggcggataagccttgcgcaccgcggagaacagtgcgaagccaacgatcaggccgacaaccatctggaatgagttgccgatgatttcgcctagggccggaccgaagccggacaggatgccgccggcgatgaagtagccgaacaccttccacacgccggccaccagagagccgatgacgacgttggccggtttgaattcacggaccagcagacccacgagcaccgcctgcagaccgtcgatgatgaaggtgaagattgcccactgcgggtatcccgagatgaggtcggacaacgccggtccaagaccgccgatgatgccgccgacccacgggccgaacgcataggagctgaagaaaatcatcgtgtcggacaggttgaggtatccacgggtcggggtcggaatcttcacgaacatggtcagcacggtggtgaccgcggtcatgatggcgatcaacgggatggtgttgacctgaatagctttcttgatatcgttcttgacgtcctgcgccataatacagtcttcttctctcttttttaccaaaatagcaaaatcatcttgcttttcctacgatttgtaaagaaatcgcaaggaatttctttcgatgtatcaaattgcgacataccatatcgcaataagcgaaaattttatcccatccgcgttacaagcgcagtgcaaagcgggcagcccgcaacacccccttctcatggtgcagcggaccgcccgacagttgtttcagaccaaagtcacttggccagaccggattcgcgcaaggccttgaagccgctttcgaggtcctcgatgatgtcgtcgatgttctccagtccgatggacaggcggatggtgccctggtggatgccctggtcctcgagctcctccagcgtctcctgggagtgcgtggtggaggccgggtggatcacgaggctcttggcgtcggccacattggccagcaggctgaacaggtgcaggttgtcgatgaacacgcgtgccgcgtccttgccgcccttgatgtcgaaggtgaagatggaaccgccgccgttcgggaagtacttcttgtacaggtcgttgtccttgcggccttcgatggacgggtgggagatggactcgacctccggcacggtcttcaggtagtcgatgaccttcagcgcgttctggacgtggcgttcgacgcgcagggacagggtttcggtgccctgcagcagcaggaaggccgcgaacggggacagggtggcgccggtgtcgcgcagcaggatggcgcgcacgcgggtcacgaaggcggcgccgccgagggcctcatagaagttcaggccatggtaggacggatccggctcggtcagggtcgggaacttgcccggcacttcggcccagttgaacttgccgccttccacgatcacgccgccgagggtggtgccgtggccgccgatgaacttggtggcggattccacaacgacgtcggcgccgtgctccagcgggcggaacaggtacggggaggcgaaggtgttgtccacgatcaccggcaggtggtgcttgtgggcgatggcggtgatggcctcgaagtcgggcaggtcggcgttcgggttgccgaaggtctcgaagtagacgagcttggtgttctcctggatggcgtcctcgaactcctgcgggttctcggcggagacgaaggtggtggtgatgccgtcgcgcggcagggtgtggcgcagcaggttgaaggtgccgccgtacacgttcttggctgcgacgatgtggtcgccggactgggtgatgttgcgcaccgcgtattccacggcggccgcgccggacgcgacggccaggcccgcggtgccgccttcgagggccgcgatgcggtcttcgaacacgccctgggtggagttggtcagacggccgtagatgttgcccgggtccgccagtccgaagcgggcctcggcgtggtcgaagttgtggaagacgtagctggtggtctggtagatcggcaccgcgcgggagtcggtggccgggtcggcctgctcctggccgacgtgcagctgcagggtttcgaaacgatagttcttgtttgccatgatgcgctctccttggataagggttcgttgttctcgtcttggttggccacccgccctgccgtgtagggcgcttggccaggtgttggtagcgacaataaaccggccggcgagcgcaacgcaagccgaacgttatcgcacttgcctatatccccttataaaccgttggaatcattggctttccccactcccccaaccgttgaaaaaaaccattcggaaccattcgacacgccgaagtcccgcatgccggtgacccaccgtgaggaacggatgcgcgtcaggtcaggggaacggctaaagtcatgggcaggcaaatcgcaagagaggttccgatatgagcgatgagattctgtacgaccgtgatccgcggtatattccgcgcgtcgccgcggtgcatgacatgtgcggttatggcaagtgttcgctgacggcggccattccgattctgtcggcggccggctgcgacgtttgtccggtgccgacggcgctgttttccgcgcacacgcgctacgaggtattcacgttccacgatacgaccgagattctggacggctatctggacgcatggcgtcaggagaacgtcgatttggatggcgtctattccggttttcttggttccgcggaccaggtcgcaatcatcaaacgcctatacacggagtatccgcatgccttgcggttggtggatccggtgatgggcgacggcggagaaatctacgccacgtacactcctgagctgtgtcgggcgatgggcacgctggtggatggcgcggatgcgctgatgccgaatcttaccgaggcatccattttgacgggccgtgactatccaggccaggatatcgacgacgcgcaggtggatgagattcttggggcgttgcttgccgccggcgcgaagaacgtggtgcttaagggcatcgatcgaggggatggcatgattcgcaactatgtggcgtcagcttcgacgggcgtcgccggaaaacaggagctggcgcatgccaagctgccgttcatgacccacggcaccggcgacgcgttcgcgtcggcgctgtgcggcgcggtgatggctggccgtcctctggccgaggccgcgaacatcgccggcgagttcgtccgccatgcgatggaaagcacccagtatcagccgaatcatgaggaacgaggcgtgagcttcgaactcaatctcgacgaattgaccgctttgacccgtcgttgacggttcatcggtcactcttttcgcacagaggccttggatcgtgttgtggataggtgtggatagcgtcgactcatccaccgactatccacgacacgcccgagatacgtaagttatccacattagcccatcggccttgtcatgcgtggcttctgtctgttggactagggccatgaaccattcatcatcacatgatgttccggccccaacgcagccgccggagcagattctcgattccctagcgcggcgtctgcatgacggcacgctgcgttcccgacagatcggcgagctgggagaacagtacgccgccgcatggttggaaagccaagggtggcggacgctcgaccgcaactggcattgccgatacggcgaactcgacgtcgtgtcgcgcaatccgatgggccagatcgttttcgtcgaggtcaaaaccagacgtacgatgcgctacggcacccctcaggaggcggtgaccgcttccaagcaaatcaatctgcgccatgccgccgtgcaatggctgacgacgccggagcaccgcatgccgaacagtggcgtacgttttgacgtcgtcaccgtcgtggtgcagggagacagacctttgctgcatcatatcgagggagcgttctgatggccatcggcagcgccctttccgtaggactgatcggtttgaaagccttcatcgtccagattcaagcgttcgtatcccctggacttccctatttctccatcatcggcctgcccgacacctcattgtccgaggcgcgcgaacgggtcaagtcggcatgccaggcaagtggtttcaaatggccggaaacccgtgtcacggtcaatctctccccagcgtccatgccgaagaaaggctcttcgcatgatctggccatcgcggccagcgtgctcagcgcggccggcgcaatcgcccatgactgtctggccggcaccatcgtgcttggcgaggtgaatcttgacggcaccgtattgcccatcaacggactgctgcccatcatgctgcatgcgcgggagcagggaatcgcaacaatcatcgtgccttacgccaaccttgatgaggcccgtctcgttccggatgtcaaggcgatcggcgtgaggcatgtcggagagctcatcgaactgatgggaggcgatgcggactaccggattcccgaagccacgcatgccgtgaacgccgatgtcggcgccacgggcatgtgtcctccgcccggcgacatgagcgaagtgatgggccagcaagcggccaaatgggcgttggaggtggctgccgccggaggccatcatctgatgatgaccggtccgcccggcaccggcaagaccatgctcgcttcgcgaattcccggcatcatgagtcctttgaacgagacggaacagcttgaagtggcctcgattcgttcgttatgcggcacgcttcccggatacggaatcagcgacgttccaccgttcgaggcgccccaccataccgcgtcgaccgccgcgctggtgggtggaggcgcgggattggcccagcccggagccatcacccgcgcgcatcgcggcatcctgttcatggacgaggctccggagttctcggcgcgtacgctgcagacgctgcgcgaacctttggaatccggatatgtcgcgatttccagagcgaaaggcaccacatactatccggctcgcttccaactgattatggcggcgaatccctgcccgtgcggctacgcgtacggcaacggcgagcgctgcacctgccgagaaaaggaccgcgtcaagtatttcagccggctttccggaccgatcctcgaccgtatcgacatccagatcgaggtgcctccggtggagcggataagtccggggaacgctccctccggcgattcgagccatgccatacgtctgcgtgtcatcgttgcccggcagatggcgcaggaacggttccgcgaattcggctggtgctgcaacgcgcaggctaccggcacctggctgagagccaacacctcccccaaggccatcgaattggtcaaccgcgccttggcgagcgagcggctgagcctgcgtggcgccgaccgtgccatgcggcttgcgtggacattatccgatctggcgggaaagacttccccaggacctgaggaaatgatgcagggaatatccatgagaacgaggctggcatgatggtgacgattgacgacgagaccctggcccgcgcggtgctcaccttctgcctggacagcgccgacgcgatgatgtacgcgctggtcaaaggcaccggctccgcggcaagcgcgctacagctgatcgctgacagcggccctggcaatcacgaaaacgtgacggccgcggcctgcacgtcattggatgcggcgttcatcaacggcgtcactcgttggggacgcaccatcaacgcccgcggaatggcttcgttccatggctcgctggtgtcatggcagcaacgtctggcatcgttgcccagcaaggatccggacgcattgcgagactggttcacagcagacggcacgcagtggatcatcgccccgcatcacccctgttggcccagccaactgaacgacctttcactgcgcaccgactgggcctccccgctctgcctatggggcaaaggcgatccgaaggcgctggtgtcatgccccgagccggtgggtatcgtcggctcacggggcgtaagcgactacggtaggcaaagcgcccacgaattggcccttcggatggcgcgtgccggacatctggtggtatccggcggcgcgctgggcaccgacgccgcggcgcattggggcgcggtcaaagccatggacgaaatgagcgccgctctggcgggacgcaccgtcgccgtattcgctggcggactgaaccatatcggtccgaaaagcaaccagaacctgttcgagcagatcgaaagccattcgggcgctttgatttccgaactgtgccccggaaccgtgccggaggcaagacggttcctgctgcgcaaccgtctgatcgcggcattgtcatccactctgatcgtggcgcaggcacgtgcgcgttccggcgcgctcaacaccgcaggctgggcgaacgaactcaaccgcaatctgttcgccgtgccgggagacatcaccatgccgcataacaccggctgcaatcgccttatccaagacggcagagccaccatcatctgctcactggcggagatcgacgaactatgccatagcgcgcatcgcccgcaacatgtcgacctgccggatgacaccgaacatccgcaggaatcgacagacgaatccgacgatgccatactcgccgccattaaaacttgcgccgaagcaaacggccacgtctccgccgacgatctgctcgatctaatggacaagacgcatccgggagaatatcccatctcgcgaatcatgcgcgaactgggctccttggagcttgaaggccgcatcagcatgcggtccggatggatcatcgccgagcagcgatagcaggcccggcacctccacctcagccgcgtcgaacgtgcgaggtcacaccttgtgcgagaatcggtggtatgagtccgaagcatgttgaagatatgtatgatgcagtgatcgtcggcgcaggcgcggccggcctgtccgcagcgttgggaatgctccgtagcgagcggatgcgccagatgcgggcggacggcatcgaaccgaacgtcctggtgatatccaaactgcagccgctgcgttcgcacaccggctccgcggaaggcggcattgcggccagccttggcaacgtggagaaagacgattggcattggcattactatgacacagtcaaaggcggcgactggcttgtcgaccaggatgcggcgaagctgcttgccgaacaggctcctgccactgtgatcgcgctggagcatgccggcgtcgcgttctcgcgtaccgatgacggccatatcgcgcagcgccgtttcggaggccataccaaggatttcggcaaggaaccggtccgccgcgccgcttatgcggccgaccgcatcgggcatcagattctgttctcgctatggcagcagtgcgtggccgagggcgttgagttcgccgaggaatggtatgtgaccgatctggtggtttccgaagaccacggcaaggtcgagggcgtggtggcgttcgacacgcacaagggcgagacgcatgccatccacgcacgcaatgtgctgatggccactggcggtgccggccgtctgttccataccacgtcgaattcgtgggatctgaccggtgacggcatggcgttgacattgtccgccggccttcagcttgaggatagcgagttcgtgcagttccatccgaccggtctcgcccataccggcattctgctgtctgaggcggcacgtgcggaaggcggcgtgctgcgcgactccgatggcgaggcgttcatggaacattacgcgccggggcatgccgatcttgccgcgcgtgatgtggtgagccgttccatcatggctgaaatcgacgccggacgaggaatcgccgatccgaagaatccggatgggccgaaggattgtgtctggctggatatgaccggcatcgatgcggatcatatgcatgaggtgctgccgcaggtggtggagaccatcgaacagtatgccgatctcgatccgacccgcgactatgtgccggtcaaacccaccgcgcattacaccatgggcggcatccccatcaccaccgacggcgaagtctaccgttgggtcgatggcgaacgcgccgtcgtggacggtctgttcgccgctggcgaatgctcctgcgtgtcggtgcatggcgcgaatcgtctgggcggcaactcgctgttggacgcctgcctcttcggcacccgttcgggcaaggcgatggctgaacgtgtcgtcgataatccagtgaacgatccgatggccgagcctgccgacgaagcatctatcgacgcggtgtcgcaggctgccgacaagcgttccgcgcaggtcaaggaactgttgacgcggccgtccgatgacgacgatgcgtcgtcggacaatccgtaccagctgatggccgatttgggatccgtcatggagcaggcggtcgcggtgcgttgcgaccggaacagcatcgaacaggcgttggctacgctggacgatacgctcacgccgcgtgccgaggcgctgcatgcgcattccgactcccccacgttcaatcaggaaatcaccgccatctgggaggtgcgccatctgttggagctcggcaaggccgtgctcgccgcctccgatgcgcgtcacgaatcccgtggatcgttgaagcgtcttgatttcccggagcgtgacgacgagcatttcctggcccattccatgacggatgtttcctgccaggtctcctggcagccggtgcacatcgtggacatgccgccaaaggcccgtgaatactgacaccctgggcacggcgtatggcagactggttgacggttttttatcgaaaggcaggtatatgagcggcatggagaacggcatggaaacggtgacgttgcgggtgaacaggttcacgccgcgtcccgaacgcggccgtgaacgaggcggctcgccgttcgctaggaagagctctcccttcggcgattccggatccacgcgcaggcgtccgcgaggcaagcagtgggtgcaggattacgcggtgccggcgcgtccggaggacaccgtgcttgactgcctgctcaaagtcaagcgcaccatcgatccgacgcttgccttccgttattcgtgcggtcatggcatgtgcggttccgatgccgtgtccatcaacggcacgcctacgcttctgtgcaccgccacggtgaaggcttgggcaaagcagccgtccgacgcacaggtggatgaggacggcttccgtcatacgggcgaagacgttcaacccgcgcaaacgcaggatgccgacgatttgggtgtcatcgagctcgcaccgctgcccggtttccccgtgcagcgtgatctgatcgccgatatcgaccagatgcttgaccaaatcaggaaactcaagccgtatctgcaggccagtggcgaactcgccaccaccgcggacggcaagatcaacgcattcgaatatctgcagaatccccagcagctcgccaagtatgagctgctgagcaactgcatagcctgcggcacctgtgagggaagctgtccggtatatgcaggcggcgaggcgttcatcggccctgcggctcttatcgccgcctcccgtttcatcaatgattcacgcgacagtcagacggatgcacgtatggatgccatcgattccgccgatggcatcgccgcgtgtcagtcggtgcgcgcctgcacgcgtgaatgcccgcgtggcatcgatgtcggtgaggagatctggcagctgatcgcccaaatcaaggagcgctgaaatggataggacgtcatataccaatctcgcgaaatcgtgggagtacgtcgaggatcatgcgttctcacgccagtctgccgaactcaatgcgatcaggaccgcggccgaggaagccggcattccccaaggatccgcggcgcaggccgaattgctgcgcatgctggtgcgaatgttggacgcctcgtcggtgatcgccatcggcaccggttccgtggtggagacgatgcagctgatcaacggtcttgacaatgcaggccagcttacggccgtcgattcgtccacgcagggcatcgcgctgattcgcaaactgttcaatcgtctgtccgatgacaccgaaaccacattgcgtgccgtgaacgcgtccgcaggtgtgtttctgccccgtctgaacgccgagaattacgatttaatcgtcgtggccggcgatccggagaattatgcggcggctttcgcgcaggctccacgcctgctgaaaccgcatgccgcgattgtcttcaccgatgtacttgcctttgattcggccacatcggccggcggcgtgctgaatcccgccaatcgtgatgccaaatccatcgcgatgcgcgaattgctggaaacagtggagtcggatgaacggttcgtcactgcgttgacgccgaccggcactggtctgctggttgccgtcaagaaatagaccaatcagattaatcagccgtgccgcaatggcacgatatgttgaaagggccacgcatgggaatgcgtggccctttcaacatatggaaatcccttttactgttcctggtgggtgccgattatctggctgaccaccacggtaccgtcttccagcaccgtctcaacttcgttcatggcatcttcgtcgccggtatggtgcttatgcttcgtaccgtcctccagttcgaatcgtttggattgatggctcagcagaatacctgagatcacggctgcgaccatggaccccaccaggacgccgaaacgggcttcagccgatagttcggcatcctgatatgccagcgacgcgatgagaaacgacaccgtgaaaccaatgccgcaggcgcaggcggcggggaacatgtcgcgcacgcgcagccccttggccatcttcagaccgcccacgtgcgtggacagccatgcggtggtcatgatgcccagaggtttgccgaccacgagcgccaccatcacggcaacgaccaccggcgagacgaacagcgccaaggtcaacgactcgaagtgcacaccagtggcgaacagtgcgaagatcggcaacgccagcagtgcggagaacggctgcagcttgtcggcgtaacgttccgcacgcggcatcttctcaccgaaacgctcatgggccggcgtgagcagtcccacgagcacgccggccaaagtggggtgcacgccggcttcgaacatcatgacccatgccagcacgcccacgatggccacggccaaccacggtaccttgcgcatgcggaccagaaagtaccagacgaccgcgcatacggctatgccaaggaaccagtaccatgcgttcaccgatgagaagaacaccgcgatcaggatgatggccagcaggtcgtccactgtggccaatgtcatcagaaaagcgcggatggatcccggcaacgctttggcgaacagggccaatacggccaatgagaacgcgatatccgtggctgtgggcaccgcccagccattggacatctgtgcgaaggagaacgacgttcctgaagcgatgacgagttgccctgatcctgccgccgcaaacaatgagatcacgccgatgaacagtaccggcggagcaagcataccgccaaccgcgcacagcatcggcacggccgcggctttgggattggacagtgatcccgtggtgagttcctgcttcaattccaggcctacggtcaggaagaacaccgtcagcaggccatcctgcacccaatggcccaatcccatgtcgatattggtgtgtggaatggctatacggaagttctcaagctgttcgaacgcatgcgcggtgaacggcagattggcgagcaataggccggcaagagcgaaaccgagcataatcagaccggatatgcggtcggacgcggctatgcgtcggattgttgcccaggttcccctcttcgatgtggccatcatgctccttgtcttgcggtccccgttcgaccgcagtatccgtaaacgtagtatcaagtgtatcggagggtcttggcgttcatccctgccgcatattgcgctccgctgtgcgcgcaatcaattgcaggcttcacaaaaatccacggaaaataaagaaagccccctccgcattcgcgaaggaggttcatgtgcgcgagacaggattcgaacctgcgacctgctgatccgtagtcagctgctctaaagtagtacaaatacgctcttgagttctcaaaccaccaccactcacccacctcgcaatccggaaccatccggaccactcgctgagcggcagcaagggattaacttacacgaacccgtccacttgcgcaaatcggcattccgcaaaccccgtaaaaacccttgcggcgcaacgcattcatcggcgtgtcgaaaactgcctatcgcacgccacatcatcgcagaaatgcttcagacaagcctcaaaacggcctaaaattcatcagaaaaacctgtctacgggcgtgtcgtgagcctgcaacggtttccaaatacggtcggaaagccgaaaaagacgcatacggaggaaaccgcgcggtggtatgtatggaggtatgagcaaaaaaatcgcagtattgacgggcgcaggcatctccacgtccgcaggcatccctgacttccgcggcccggacggcgtctggaccaaacatcccgagcaaatgaacgtgtacgacatcgacgcgttcctagccaataaggaagaccgcgagtattcctggcgctggcaaaaggaatcgccagtatggaacgcgcagccgggcaccgcacacaaagcgctcgtcaagctggaacaggcagggctgctgacgctgctcgccacgcagaatttcgacgcgctgcacgagaaggcgggcaatagcagcaacgtcatcgtcaatctgcacggaaccatcggcacctcgcactgcatgaagtgccacgcgaaatacgacaccgccgaaatcatggcgaatctcgacaacgagccggatccgcactgtcatcgcaagctgccatacagcggcaatatgccatgcaatgggctgatcaaaaccgacgtcgtctactttggcgaagcgctgccggatggtgcgattgaaaagtcataccgtctggcggcgcaggccgacgaattgtgggtgatcggctccacgctggaagtgatgccggcggcgagcattgtgccggtcgcggcacaggcgggcgtgccgatcaccatcatgaacatgggacgcacgcaatacgatcgcttggccacacggcttatccgcgacgatattgcgattgcgctgccgcagttggtcgacgagacaatcgccgcggaacagggcaaataacaccgaatgaacaagcaaggctcctcaacctgattgggtttgaggagccttctttgatgcggaagatatgcgagaatccgcgcttatccaccgtgggaaatcagtagatgcgcttgggccggaaaccggccgcgcgcatcgcgtcaaggatgcggtcgatgtgctcagggccgttggtttcaacggtgacgcccaaggaaaccgaatcagtgtaatggctggaagccttgaactggtcgtgatcgagtgcgatgacgttagcgcgctgctcggccagaatcgtggccaccttgacaagctggccaggggtatccggaagctcaacctcgaagttcatgatgcggccacgggcaatcatgcccttctgaatcaccgcgctgatggagacagtatcctcattgccaccggaaagaatcggcaccaccacatgcggaccctgtgcttcggcgaacttgcgcgagcgcagattcaggtgctcaagcgcggccagagacacggcaccagcggcctcgaccaccagcttgtgcttctccagcatgagcaggatcatctcgttgatgtcgcgctcggtgacggtgaccagatcgtcgaggaactcgttgagcagcgcgaaggtcaggtcgcccggacgcttcacggcaacgccttcggcggaggtacgcacctggtcggctgcgacgacgcgaccggcggccaacgaattcttccatgccgggctgccttccggaatggcgccgatcacgcgcacttccggcttgaacgtcttgatggcgagcgccacgccggcgcccagaccgccgccgcccaagggcacgaccacgtcggtgacgttcggcacgtcttcgaggatctcaagaccgatggtgccttggccgcacagcacctcataatcatcgaacgggggcacgtagatcatgccttcgttgtcgctcagctcctgcgcgtgagcggcggattcatcgaacacctcaccacacagcaccacatcagcgccgtaagccttggtggcatccaccttcaacggcggcgtgatctgcggcatgcagatggtggccttcgcgccacgctcacgggccgcgtacgccacaccttgggcatggttgcctgcggaagcggtgacgatgccgtgagcgagctgctcgtcggtcagcgatgcaatcttgttgtacgcgccacgaatcttgaacgatccggtgacctggagattctcgggcttgagcagaatctcatgtccggtcatttcggacagcacaggcgacggaataatctccgtgtggcgtgcggtgcccttcagtcgttcggcggccagtttcaattcagcggcatgatcgcgccgcaatgctttgagcacctcgttttgttccatggacgttattgtaagcgcacgtctgccgaaaatgccgtgcgattgccgaatcgcaatcgaatcccggccgtgcctcagaatcgcacggaaaaagaaacgtccgacaggtttcgtgatgaacctgccggacgttccgcagagagttatagggaaagatcgatcagagctgaatcacgactccctcccagcgagcaagctcgccgtgagcgatcgactttacgctatgcatagcatcataggtgctaagcagtacttgcgattcgtttacgccgtcggaaagcagctccgccacgtccgaaggcagcgccgcggacctgtcggtgaggttgacggcaacgagaatcgtatcgtcgccatcaacgcgcgtgaaggcgtacacctgctcatcgtcggcagcgagcagatgccattcgccggccgcgatggtggcgctgttgtggcgcatggcaatgagcttcttgtagaacgtgtacacggaatccggatcgtcgaattcttcggccgcgttgatttccacatgattcgggttgacgctgatccatggttcgacgggcgcgtctggcgcggtgaagccggcgtatttggaggcgtcccactgcatgggggtgcgcgcgttgtcgcggccgatgagggcgagggcggccatcatggattcggacgactggcacttggcttcctccacgcgctggcgatagccgttgagggcctccaaatcgcggtattgttccagcttggtgaagtgggcgttggtcatacccagttcctcgccttcgtaaatgtacggggtgccgcggtgcatgtgcagcaccatgccgaacgccttggcgctcagctcgcgcgaatcgcggtcagagtcgttgccccaacgggagaccacgcgcggctggtcatgattgcagaagaacaggctggcccaaccggccttcctcacggcctcctgctgctcggtcatacggtcgcgcaggtttttgacctcgaacggcacggtattccacttggagccttcctggtcgatgccgacatggtcgaacaggaatagcatgtcaagttccttgttggccggatcggtgacgtgctcgttacgggccggggtgatgcccggagcctcgcccacgttgatgtagccttcacggccttcgaatacctcacggcgcatttcggcgaggaactcgtcgatgcgcggaccgtcggagcagaacgggaacgggctggaatagccttcctcgccgaccggcagatcggcgatttcggaaccgtcctcgcccggcagcctgccgttcttgtcgacggtcttggagatctgggtgatcacgtccatgcggaagccgtcgatgccgcgatccatccaccaattcatcatcttgtagacggccttgcgcacctccgggttctcccagttgaggtcaggctgcttcttggaatactggtggaagaagtattcaccgcgcttcggatcgtactcccatgcggaaccgccgaaataggagccccactggttcggctcggcaccgggcgtgcccggctcatggcccggcttggcaggacgccaccagtaccagtcggcgtgcgggtcgtccttgtcgcgggaagcctggaaccaggcatgctcgtcggacgtgtggttcacgaccaggtccatgatgaccttcaggccgcgcttgtgcgcttcggcaagcagctcgtccatatcggccatcgtgccgaacagcgggtcgatgtcctggtagtcggagatgtcgtagccgttgtcgtcctgcggggacttgaagaccggggacagccacagcacgtccacgccgaggtcggcgaggtagtcgaggcggctggtgatgcccttcagatcgccgatgccgtcgccgttggaatcctggaaggaacgcgggtagatctggtagaccaccgcgttcgcccaccacggattcggggtggcgccattcgaacggacggtgtcaggaagagtggaacgattgaaattcgtcatcgcgattgagctcctttgcctaagtggaatggatgaactttgctatatcccatggtacgtaaagcgttttttctttcttgcctgcggcgcgttttgcaaagcaggaaatgaaagatatattgcaagcgggatgcgcccttcggaatcacatcaatgcatacgaaaagcgggaatcctcgaaaaaggggaaacgaggattcccgctcggcgctgtgaagttttacttcacaagcagacgtcctacggccgcgttgttcctgccttcgctcgcctatcggctcgctcaggaggagcctatgaacagtccacaggactgttcacttaacggctcctctcatcacaccaccgacgacccacttttgggcgaagatgtagacgatgaggaccggggccatggccatcaggtaggaggcgaaggccatcggatagttcgacgtgaactggctctggaacacgtactgcgccagcggaatcgtctgattgctctggtcggtcagcgtgatcaacggcagcaggaagtcgttccatgcccacagtgcggtcaggatggcgatcgtggcgttgatcggtcccatcagcgggaagatgatcttccagaagatgcgccaggtcgaagcgccgtcgatacgcgccgcctcttccagcgaaatcggaatcgaacggatgaagccgatcgcaataaacaggttcgtaccaatgccaagaatcgtgtacagaataatcaaaccaagctgattatccaaatgcagggtgcccatttccttggcgatcggcagcatgacgacggtgaacggcacgaacatcatggccaggaagaagtagtacaggaagcggaagaaccgcttatccatgttccttgccacggcgtacgcgacgaacgtgttcgtcagcagcgtcagcaccacagcgcacacggtgatgatcgcggaattgagcgcggccttcggatagttcaccttgttccacgcgtccgcgaaattatgccattcccacgtggtcggcaggctgaacgtgcccgcttcgcccggcgtcttcagcgcggtgacgacggcgaagtacagcggcacgagcaccgtcaggctcagcacggcgacggccgccgtcagccaccagttgatgctgtggtccttgcggatcttctccggcttcgcttgcgattgtccgctttgcgcggcggcctgcttggttgcaacagttgcgctagtcatgatttcttccccttactctcagaccttttccttgccgctgaagaacttcagctgcacgaatgcgaggattgccagcacgatgaagaacgtgaccgcgttcgccatctggtaggagtattcgccgttgcccaggccgttctggaagatcaggtatgagacggtttcggtcttggaatccggaccgcccttggtcaatgccatgacctggtcgaacgcgccgagcgagttcttgaggctcagcaccatgttgatggtgaagaacgggccaatcagcgggaacgtgatctgccagaagttctgccaggcgttcacgccgtcgatggacgcggcctcatagatttcgttgtcgatggtctgcagacccgccaagtacagcagcgtggagtaggccacaccctgccagatggacaggaacacgatcgggaaccatgccagatccggattggagatcatggatgtggacagccaatcgatgtgcagcgcctggccgagggccggcagcggggtcatgaagatgtacttgaacacgtagccgatgaccagcaccgacagggtgtacggaatgaagaagatggctcggaagccgttcttgaaggcgattttggagttcagcagcaccgccaggaacatgccgaggatgttcgtgccgagcgtgatcagaatcgcgatgaaaatcgtgaacagatacgcgtggccgacgcgtgcgtcctggaacatcgcgatgtagttcttgaagccgatgaacttgtaatcgccgtaaccctgcgaattggtgaacgagtacatcgcgccctgcaggaacggcaggtacaggaagatgcacacgagaatcatcgcgggaatggtcatccagtagaacgccggatcgaccttgcgcttggagtatttcgaaaccttcttcggcttctttgcggcggccttgtcggccttggccgagatattgccagtcattgtcgttcctcccctcacctaaagttcctggcttcgatcttgtcgtattccgactgcatgctgttcaggaatcgtttagtattgcccgactgcaccaacgtctgcaggaaaccggcgaggttgatgcttgccggcacgtaatggtcgcagaaatcagccagcttgccggccttgtagaagtcgagcacgccattcaacgcttcatcgccgacgtacgtatccttgtacggggtgaacgcagactgctgcttggagtaatcctgcacgttctcctcgctcatcaggaagtcgacgaattcgcgagcctcggtgtaatgcttcgtatgcgcgccgatcgtcagcatcacgtcgtcgccggcggtcagctgctgttccttgacgttgtcggtggccggcatctgcgcgaaccgcagattggcgtccttgttgatcagacggatctgcggaatcgcgtacgtgccgagcggcagaatcgcggccttgccggaagcgatgtcctgcgtagcctgctggtaggtgacggccggattcttctgcgtgtagttctggtaaatttcaatcagcttgccgctgacgggcgtccacaagtcggagaaggtcttgctgccgtccttgagatacgcgtattccgattccggcaccagcgtcgaattcagcgatgcaagcggcgcctgcaacgtccacggatcggcggtgctcgcctcaaccggcgtgacgcccttggccttgagccgcttgagcagcgcgatgaattcgctccacgtctgcggcggattgtccggatcctcgccggcctgcttccacacatcggcgttgatgatgtagccgcttgcgttgcccgcgtacggaataccgtacagacgcttcttggacttgtcggtggtctgcacgaggctcttcgcgatgttcaccatgcccggattgagctcgtcgacgatctcgtcgtcggtgaaatcgtggaagacgcccgcttcggcgagcatgccgtaattgatgtcgccgttgatggtgatgacgtcgggttcgcggttcttcaccagtcgcgtgcgcagatcggtggtggcgtccgacgaattgttgacattgactttgatgttggaatgggttttctcgaattcacgcgccttggcggtgaaccaatccgccgcctcggacttgaattggaagaaatccaaggtgaccgtgccggcggtgctgttgccgcagcccgcgagcccgaccgtcaacgcgaccgcgcatgcagccgtgacgacacgacccgcgatccgcctgaaagtgcctgcgttggcattggaatcaggtttcattctctcgactcctttgtattttcctttttcacggcaggccggcttcattaccagcctccgttgctttttaattgtagaatcggcttgttttcattcccagtttccgcgcgcccgcactgtacggaaataaaaaacggttattttgttattcttggaaagaaaatagacggtaaggacggtccgatatggcgatttccccgattccacactggtttgaaggctcggagtacacgcataaggttgcggcctgcattatgaagtacggtccgatttcgcgcatcacgctggcacagatccttggcctttcgcaaggcgcggtatcgcgcatcaccagtgatttgatttacgctggcgtgatcgaagagacgccaatggcagcggggcatggcggcaagttaccgaaagatttcttgcggaaatcggcacaaaagtcaatccagaaagaaaatacggaacgtcgcggccgtccgcagaccggactgcgcatcatcgccaatgcgcgcacgttcgtcggcatgaaaatcaacaccacccatatcactgccgtaacagtaaacgcgcttgggcagattgtgaccggctgccatgacctgccgctcgacgacgattcgccggaatcggtggtcgacgttattcggcagctgaccatggactgcgccgacgaggcgataatggcgggattgccttcgccatgcgcggtcggcgtctcgttgggcggacatatcacggacgattcggtgacgacgttcgcaccgttcctgcactggtcgaagccggtggaattttcggcgatgattcgcaaggcgaccggcctgccgaccggcatctacaacgacatcgactcattggtggtggacgcgtgcatgttcggctcgggcgtcggattgaacagtttcgccgtggtgacgatcggcatcggcgtgggatattcgctcaccgtcaacggcgagccgatcgacaatcccgacaaaagctatggcctggtcgggcatattctggtcgaccccgacgggccgcgctgcatttccggacataaaggttgcgcgacgtgcctaactgacaattcaatcgcaacagaatattcggaaatgatcggacatccggcgacgttcgacgaatttgcggccgcagcgcgcgccagcaaaacgcaggccacgaatctggtgaaccgcacctgtttccgtttgggtacattgatcgcgaccatcgccaatcttgccatgcccgacaaaatcatgatcgctggcgaatcgtcgttcattgcgaaactcggcatagacaacctgcgtaacggcatcaatatgtatcggcatagtcaagccgcgccggtcgatttcgaaatcgccgagcacgactggtcgctgtggagcaaagcggccgcagcgcaagccattcgccagtatgtagggtaagtcgttcggaatcgctgtcgcagtgtgaggccggtacgcgaaagtaccagcctcaccatacaaaacagatactcagatgcggactactttgaaaaggacggcctgcgcaggatgcagcgccggcggacggatgccgtaggtggtgagcgcgcgaccggtcattctcacgccgtcagcgttccaccagccgagcgggctctggccgttgccgatgtcctgcttggccaggtcgaggctcacgtcgagcggggatacctcgtatacggcgtccggatcgaggccgggcagcttcacgggagcggccgggtaggtctgcgacgtggtcagctgcgtgaagcggtagatcgcggcagccttgttcggcatgacgcagccgtccacgcgcacggccggatcggcggcgtcggaatgcaccgcggtgtcgacggcgaaccattcgcgatgctttttgaattcggccgtccattcggcgagcttgtcgatgtcctcctgcggttccttgagcagattccattcgatgcccatgtggccgaagaaggccatggccatgcgcatctcctgggaggtggcgcggtgcgtggaatgcgccggggaagcgcccacgtgctctccgatcatctccggcggcacgagcagcgacgtgtagcgctggatgtcggcgcgttccaccgggtcgacgcagtcagacgcccaaacgcgatcggctacttcaagaatgcccaaatcgatacggccgccgccggaggagcagctttcgatttccaggccggggtgcgctgccttcaaatcggtgaagatgcggtatacggcgagcgtctgcgcgtgcgctgccggacggccggtcagcggcgagacttcttcggtgacgagcttgttgtggtcccacttgatgtagtcgatgcccagctcgctgacgagcttgtccatcgcaccgtaaatgtagtcgtacgcgtccgggttggtcaggtcgacgacctgctgggtgcggccctgcatcggcagacgaccggcggtgggcttcagcacccagtccggatggttgcggaatatgtcggaatcggggttgaccatttccggctcgaaccacaggccgaattcgaggcccttgccgtgcacgtagtcggcgagcgccttcagggacttgtctccgtcgggccagacgtcctgtgagatctgccaatcgcccagaccggcggtgtcgtcacggcgggcaccgaaccagccatcgtccacgacgaatcgttcgacgccgctttccacggctttgtcggcgagggcggtcagggtgtcgtaatcgtggttgaagtagacggcttcccacgtgttgaggatgaccggacgcggcttgggcgcgatgccatggtccacgagccagtcgcggtgcacgcggcggatgtaaccgtggaagcgtgaggcgacttcgttgagcccctcgccgtaagagccgacgagccatggcgtggtgtagctttcaccgtgttccagaccgacttcgccgccgaagagcacttcgccgccaccgatcacgccagtggtgtagggcagtcgttccgcggacagcacgctgttgccgctccatgccacgtgcgcggagtagacgttgccgtgggtgaaaccgaagccgtgttcgccaacgctgagcagcagggtggcgtcgaagtcggggcggccgatcatggaggatttggcgaagcgcccgatggtgaagtcctggcgctgtggggaacgctcacgcagatggtgaccggtggtggtgaggatctcgttggcgtcggcgggcacgctgaatgcaagttcgatcttgccgatctcgagtcgtccctcgccggtgttcgtcacctccgcatgctggcggatgaggccggtttcatcgagctcacaggtccacgtaagtttcacgcattgttccacgtcctcggcagtgacggtgacggtaggcgtctgcttgggctcggaggccacgctccagctggggtagccgtctttttcggccatggtgtaggttttgccggcggccacggtttcggctttgatgtcggtgacctggaacttgcagaacagttccacgccgtcacggcgcacgtcgaaacggtcagagccggaccacgcttcggactgtgtcggcagcacgctcggccatgcggtgtagtcgagggctccggaaacacgctgcggagcgagcgcgtcgaacgtgttgatcacggtttccggtgcggtgagcgggcgaccccaatgcacgaatctcggcaaatcgctgccggggaacaccagagcaaaagctgcggcggcagccggctgctcggcatacacggcggtaaggggtgtgccgttggaagcggtgccgtggaaagtctgaatgagcgtcattgcagcatccttttcttgcgattcttggttggtatgacgctttgatggtactgcataccgcttttcttctcgtcgccctgcgtgtttgtttctttcggaaagtaattagcgtcggcgcgcgaagaaatcggtcatcaatcgcccgcattctgcttcgcgcacaccgccaatcacttccggtacaagtccgacgtgcggatcgcggggaatatcccataccgaaccgcatgcacccaacttggcatcccacgcaccgaacacaatacgtccgatatgcgtctgcaggcaggcaccggcgcacatagggcacggctccaacgtaacgacaagcgtgcaatcagcgagattccaagtgtcaagcgaggcggccgcttcagccatcgccttgacttcagcgtgggcaagcggatcggcatgcgtctcacgcaggttccgcccgcggccaatcacccggccgtcagcggcaagcacgacggcaccgaccggcacctcgccatccgcggcggcttcgcgggccagcgcgatcgccggttccatatcatcgtcccatcgcatacgccacagtgtagcggcggccatacgaccgctccgcacgactggtccgcacgtccgacctgcgcgcccaaccgaagcggcacgaacgtcagcccatggcgaaacacgctcataaccgcctcttggtaggctggaaaaggttggaaatacgcgcaaaggaggcacgttggcggtattcgagttgattctatgcatcatcgctgccgtcgtgctgtcctcgttcctgagccgattcatacccaaggtgtccacaccgcttgtgcagatcgcgttgggagcattggcatcgcagctgccgttctttccagatgtgacactcgatccggaattgttcatggtgctgttcattgcaccgctgctgtatttggaagcgcatgagattgacaaaaccgagctactgaaatccgtcaaactgtcattgtcgctggcgatcggcctggcgatcgcgaccatggtggcggtcggtttcgcattgcacaccgtctggccggcgattccgctcgctgcggcacttgcgctcggtgccgcgctcgggccgaccgatgcggtcgcggtgtcgtcgctcggcaaggaggcggcgctgaccgaacgccaaacgagcgtactgaagggtgaatcgttgttcaacgacgcttccggtatcgtcggcttccagttcgccatcgcggcggcggtcagcggcgtgttcgaagtgggcgaatcggccgcgcaattcgtgatctcgttcttcggcggcgcgatcttcggccttgtggtgggcaccatggccgacctgctgttcgaatcactgcgatcccttggttgggaaacgactaccagccgcattctcatggagctattcctgccgttcatcctgtatctgggtgcggaggcggtacatgtctccggcattctgtcggtcgtggccgcgggcctgatcatccgattcgaccgcaccggcatcggaccgaatgtggcacgcacgaacatcgtatcgtcaagcgtgtggggcgtgctgtcgttctcgctcaacggcacagtgttcatcctgctcggcatgctgctgccaaatgccatgtcggccagctgggatgatccgcatgtcagcaaccagctgctgctggtcgcgattctcgtcgtcgccgccgtggtgatcgtcatgcggttcctgtggatctcgctgatgctgcggctcgcgcgcgacaccaccaccggcaagcggcgcaagatgacggcgcagcgctggcggtccgccgcggtcatgacattcggcggaccgaagggcaccatcacgctgtcgttgatgttcacgatcccctacacgctggcggccggcgcgaacttcccgatgcgcgacgaactgatctttatagccgccggcgtgatcgtggtgacgctgctgctggcgaatttcctgctgccgctgcttgcgccgaatcgcgacaaggacacgtcgacggaaatgacggagatcaccatcgaagtgctgcggcggacggtcgaagagctgtcgggccgtgtcacgccggacaaccgtcgggcggtgcttatggtcatcgattcctatacgaaacgcatcacgcggttgaaacagcgcaccggcgaaatcgatccgcaggggtatatgcagctgcagatcgacgcgctcaactgggagaaggagtacgtcaagaaccgtctggcgggcgtgcgcgcggcgatcaaggcaaatcccgccgagaaccgcgccgcgaacgatctggaggccgaggcctgcgagcgcctgctcgaccagatcatgagctcgctgcgccacatcgaaaccgcacacaattcaggccgtatgatctggcgcgtcaaaggccggtacaaggcgctgcagcggcgcatgggcacgttggcgaaacgcgtgaacagccgcatccggcgcacgaccccgctgttcagcgacgacgagctgttcgcgcatacgcgcgtggtccaagtggatgcgatcgaacatgtgatcgaccgactgtatgaggagatgggcggcgacacgtacaacaccgagcactgctccggcctgctgttggactaccgacgcagcgaatccgcgttgagggcgcgtccgaatatgggcatcagcgccgaagcgcaggaacaggccgaggaggtcaagcgcgaaagctacggcatcgagctgggcgtgatccaggacatgtatgaggccggcgacatcacgcgtgcgcaaagcaagcagctgcgacgcaacgtgtatgtgatgagtgtggatgcggacgcgcagctctgacccgggttgcgcgctcaggatacacgtttccctcgcacgttcatcgtgcttagcggccacggcatatacctgtattaccagcgcgaacagccaatcccatgtatccctcctaccgaggaaaaatacctcaaggaacggaagagcagggatcacgcgtccgcatccgaaaatcatcggaacagaacccaagagcgcttttaaaacttttgcatattatttgagacaaagtaggtatcttggaataaagatgaggtttttcacttcatccggtcggaaataagccgaagtgaaaacaatgtggataactctgcaaagatgagaattatctgtttcatttagacacgaatgctcctttcgaaaggatgattgacaaataccccctaatagcctattgtttagtcatgcttcatcggcattgtaaagaaaggggattgaatgaaaatagtcaagagaatatccccttttcattggtctagcacttatggtggctctgcctgtcaccgctcatgcgtctacaaacgatgatcagcaagacatcgcatcattggatatgtccgtcatcgacgtgcaaatacaatcacgcggcgttatgaccgcggaagatctgtacgacttcctccaatccgatgcagagaaaactgttgacatcgatgccgaaacagggaaaattaccgccgtgagcgaaggtataacgaagcctaggattgcggtcaacaatatttgcaatggccgtgattcatgccttgtccacagtcgtgttccttatgcggacttcggatttagcgggaccggaacgaagaccgggaattggccctaccgcatctcttgggagactggttctcatacggcaaaagcttggtacagacatggctatgacgttgttggatggggcactaagttcggacctcacaccaaggccaatatgaacgctcctgtcacggctgttcaagtcaccaattactcgtgatcctgcatgagtttctggcgcagaagataaagacggctcatcagaattctgatccgcctggacatatgccgccgaattctcaggaagttttcagaaaacaccagacatgtgctcagcatcgaatggttatatatgaactgtcagcacaacgagccgaccaggaacacaagagttcccgacaattgaaccctttcttcttctctctcctttctctccccggtggccgatcccaccggggtcttcttttttcgccgcttgcttcgcctccctttcccagcttgtttcacggcttgtttcacgtcccttttcacggatcttttcgcactgcgagcgtacgccacaatcgcacgctatattggaaatcatgagcgacgcaatcgaaaacacaacaggcagcgcagacagcaatgataagaccaagctgatcggccgcgaatcggacgtggtgccgggccgtttcggcgaaccgctgcaaatcacgcatgtgcagtattcgcgcggcggcggcagcaccgcgccgaaacgaccgttgttcctgtgcctgcacggctggggatcaaacgaggcggacttggccgacatgatgcgctacgtcgcgccatacaacgatttcgcctcgttgcgcgcgccgttgacgctgcagccggctggccgctttgcacccggcgcgtactcgtggctgcatgattgtgtggataccggcgaggatttggaccgtgacgcattcgccgcagcgaaagcaatcgacgattgggtttcggcgaacattcccgacgaccgtgccgtggtgccgatcggtttttcgcagggcggtctgctggctattcacttgctgcgcgtgcacccggaacgctaccgtgcgtcgatttcattgtccggattccttgcgcctgggctcgtccgcggcaccgcgcctgccgacgaccgtatcgcgccgctcaatattcccacgttcttcggttacggcaacagcgatacggtgatcgccaagccggagcttttcgccatgagcgcctggctggacgagcacacgttcctcaccgcgaaaagctaccgtgggctcgaccactccgtcagcctcgacgagttcagcgacctacgcggatggctcgccgtgcatgacatcgcgccggggattctgtgatgcatcagtcggtgatatcggccttgtagaagttcacgtaggagcggctcggggtcgggccacgctggccctggtagtgcgagccggtgccggcggagccgtacggatgctcggcgggcgagctcagctggaagaagcacatctgtccgattttcatgcccggccacagcttcaccggcagcgtcgacacattggacagctccagcgtgatgtgcccttcgaaacccgggtcgatgaatcccgcggtggagtgagtgaggatgccgagtcgtccaagcgaactcttgccttcgagtcgtgccgcaaccgtcgaatcaagcttcacatactcccacgtggagccgagcgcgaactcgcccggatgcaagatccacggctcatcagaccggacttcgaactgctcggtcagctcgccctggttctccgccggatccacatacgtatacgcatggttgttgaacagacggaagaagcggtccagacggacgtcgatcgacgccggctgcaccatttccggggtccacggatcgagcgaaatatggccgtcagcctgtgcggcgagaatgtcgcgatcggacagcagcatcgaaattcctccaaacatcaccggaacaatcgtcatatgagcgggcgcgcagccaacgcgcgcccaccaactgtcgtccagtctagcccgtcgacgctataagccagcatcaccgccgatgcatcgcacgcagcacgcacttgcgcagctcggaggcgacgagcacaatcatcgccaggccgaggcattcgacccacgcacccgcggacagcggcacggtaccgaacgcggtgttgaggaacggcacgtagaccaccgcaagctgcagcagcgtggacagtgcgatcgcaccccacagccacttgttggcgaacagccccacgaacaccgactggtcatgcgagcgagagcacagcgcgttgagcatctgcgcaaacacaaggatggtgaagcccatcgtgcgcgcctcagtcatttgcgcatcatgtccgacagcatccacggaacggtcggtgaacaagcctccggcgaggtgcatgtccatgccgatcagcgtgacggcggccatgatgatgccgatgaagatgatgtctccccacatctgcccgtcgatcacgcggtcggtgagtttgcgcggcttgcgggccatcacgtcgtcggtggagggatcgacgcccatcgccaaggccggtgccgcgtcggtgagcaggttgatccacagcagctgcgtggcgagcagcggcacggtcacgccttggctgcccggctgcgtgatgccgaggaagccggccagcatcacaccgccgaaaaccgtgaagacctcgcccacgttggagctgagcaggtatcgcaggaatttacggatgttgtcgaaaatgccacggccttcgcgcaccgcttcgacgatggtgctgaagttgtcgtcggcgaggatcatcttggcgctctgcttggtcacttcggtgccggtgatgcccatggccacgccgatatccgcggttttgacggcgggagcatcgtttacgccgtcgccggtcatagccacgatattgccttgccgttgcagcgattcgacgattttcagcttgtgttccggcgcaacgcgcgcgtacacggagatttcgcgggtggccttgtcgaacgcttgctcgtccggcagctcgtcgagttgaacgccggtgagcactttgctactaaggtcggcgctgccgaccgagctgccgtctccgtccgtttcaataatgcccagatcgctggcgatgcgtgccgcggtaagcggatggtcaccggtaatcatgacggtgcggatgccggcgcgatgcgcttcggcgacggaatcgcgcacttcggtacgcggcggatcgatgatgccgaccatgccgacccagatcaagtcgctttccagcacatcgctttggtcggcgatgtccgccacgtgaccggcggcgttgatgcgcacgcctggcactgcggcgagcgacgcggtgccgagtggccggtacgcctggcccagcgtacgatacgcttcggcggacaggcgttccacggcggcgaggatctgctggcgatcgccttgcgtcatcggtcgtacggcaccgttgaccgcgatgcggctgcagtagccgagcagtacgtcgggggcacccttggcgaagacggtgagacgcccggcatcggcgttgtcctgcgcgacgacggccatgcgtttgcggtcggaggtgaatggaatctcgccgacgcgcgtgtagttggcgtatttgcgatcggccttcaccttgcgtgcggcgacgataagcgacacttcggtcgggtcgccgacggcttcccacgttatgtcggaagcagcggaaccatcgccggcacctgtgttttcgcgcaattcgccgtcgttggccagcgagcccacggcgagcgtggcgacggcttcgacctgtgcggcggaagcggcggaaccagacagagcagcgtcgggaatcgcaatcattctgccttctggcgcatagccggtgccggtcagctgcacctcaccgctcggcgtgaccacgcgttccaccgtcatctcgttgcgggtgagcgtgccggttttgtcggagcagatcaccgacgcggaaccgagcgtttccacggaatgcagtttcttgacgatcgcatgatgttcggccatgcggcgcacgccgagcgcgagcacgactgtcagaatcgcggcgagcccttccggcacggccgcgacggccagcgaaacggatagcagcagcgaatcgattacgtcgtggatgtcgttgaagccttcggtcagcgcaagcgccaccagcacgaccgccgcgataatgcacaccgcgatgccgagaatcttggaaacgtagttcatttccttctgcagcggactgtcatcatcatccgtggcctgcagaaggtccgcgattttaccgacctgcgtgcgcatgccagtgctcgtcacgattgcgcggccggtgccttgcgtcacggacgtgccgttgaacaccatattggcgcgatcacccaaggccttggcttcggcaagtgtgtcgacgtttttgccgaccggtacgctttcaccggtcaggctcgcttccgccacgcgcaggctggcggcggcgagcagacgtccgtcggcgggaatggagtcgccttcaccgagcacgaccatgtctcccggcaccacgtcgacggtgttgatgcgtgcgattttgccgtcgcgcagcacgttggtttgcggcgcggtcatttgggagagcgcttcgacggcttcttccgctttcgattcctgaatgtagccgagtaccgcgttgacgataaggataagcacaatgacgatggcgtcgaacggcagtatttcgccgccttccgcgcctggcgcagcgttggctttttcgatgaaccatgcgatgagcgagatgccggtggcagcgagcagcaggtagacgagggggtctttgaactgcgccaggaacttcttccattttggcacgggtggtgcggatgcgagctcgttcggcccgtattgcgcgagtcggcgttcagcttcggcttggctcagaccggtgttcggatcgacgccgagcgatgcggccacggcttgcgcgtcggcaagcgacgggtcgatttgtggcggctgctggttttgctgatcctgccgaatctgcgtgcgatcgcccgtagcggaatcgccgtcaaaattggcatgggactggatggactgatctttcttgcgatcatccatggtgatctccttgggagcgccgcggagtagtcagctctcccccgtcttacgtatgcctcgaatcgcggaaatcgaaaatccgcggaatcgcaagcattttgcaaaggcgaggcaacgctgcgcggttgtgggcaccgggcggacgccatcggcgcatcctgttattatcgcacatcctcggcgtgtgaaaaatagacatgtggcggaacgatgcatggcacgcgacgggtgcacgataccatgaagtgtgatatattatcggtagttagtaaaatcattactaaacggtcgtgcaacatcgcacggcgcaaccgcaacgatgcagtgacaccaagtaatacagggggatgcaagatggcagatacagccgaactcgcaatcgtacatgcaaccacggcaagtgcaagctggctcaccgatccgacggtgttcgcagcgaaccgcaagccggcacattccagccaccgatatgtcatcggcgagacgagcgagccgaagcagagcctcgacggcgaatggaaggttcgtatcgaacaagcgcgcaacgtggacgtggaaagcgctccgttcgcggccgtcgatttcgaggatggcgatttcggcgcgatcgaggtgccgggccacttgcagatggccggctatctcaagaacaagtacgtcaacatccaatatccgtgggacggtcacgaggatccgcaggcgccaaatattccggaaaacaaccatgtggcaatctaccgccgtcgattcgcgctcgacgcgcagcttgcgcgcacgctggaaaacgacggcacggtcagcctcaccttccacggtgccgccaccgcgatctacgtatggcttgacggcacgttcgtgggttacggcgaggacggattcacgccgagcgaattcgatgtgacggaagcgctgcgaaacggcaatggcaacgccgccgattcccccgaagccgagcatacgctcaccgtcgcctgctacgaatattcgagcgcctcttggctggaagaccaggatttctggcgactgcacggcctgttccgcaccgtcgagctcgccgcccagccgcatacgcacgtcgaaaccgtgcagcttgaagccgactacaccgcagccgacaccgccggtacggccgacaccgccgaactcaacgcggcactcaccttgcgcaaccccgccgacgcgatgactatcgaaagcacgctgcgcgacggcgacggaaatgtcgtatgggaatcaacgcaggcctgcaacggcgaaatcgcccttaattccggcaaaatgacgaacatcgcgccgtggagcgcggaatcgccgacgctgtacacgctgaccgtacgcgtcgtcggacatgacggcgccatcatcgaaaccgtaacgcagaagatcggcttccgcacgttccgcatcgaaaacggcattatgacgctcaatggcaagcgcatcgtgttcaagggcgcggaccgccacgaattcgacgcgaagcgcggccgcgcgatcacccgcgaggacatgctttccgacgtggtcttctgcaagcggcacaacatcaacgccatccgcacctcccactaccccaaccaggagtattggtacgacctgtgcgacgagtacggtctgtatctgatcgacgagacgaatatggagacgcacggcacgtgggtggcaaacaatgtcgagcgtcctgaagacggcatccccggcagccgccccgaatgggagggcgcgtgcgtggaccgcatcaacagcatgatgcgccgcgattacaaccatccgagcgtgctgatctggtcgcttggcaacgagtcgagcgcgggcgaggtttttcgtgcgatgtatcgccacgcgcacacgattgatccgaatcgtccggtacattacgagggttccgtgcacatgcgcgaattcgaggatgtgacggacatcgaaagccgtatgtacgcgcatgctgacgaaatcgaacgctatctgaacgacggcagcccggcacatacggacggtccaaagaagccgtacatttcctgcgaatacatgcacgcaatgggcaattcgtgcggcaatatggacgaatacacggcgttggaacgctacccgatgtaccagggcggtttcatttgggatttcatcgaccaggcaatcgagaccaagctgcccgacggcacgacacgcatgtgctacggcggcgatttcggcgatcgtccaagcgattacgaattctccggcgacggcctgctgttcgcagaccgcaccccctcgccgaaagcgcaggaagtcaagcagctgtatgcgaacgtgaaaattgtggtttcggtcgatgaagcgcgtattacgaacgacaatctgttcgtgtctacgggcgattatcgcttcgtgctgcggattttggccgacggcaagccggtatggtcgactacgcgccgtttcgacgtggccgccggcgagagcgcttcattcgaagtcgattggccggttgatgactaccgcagcaacgccgaagagctggttttagaggtatcgcagcagcttggcaacgcttgcgattgggcaccggccggctacgagctggcgttcggccagtgcgtggtggcaggtgcgaagaccactgcagatgccgttgacgcggccggagctccggccgacggcaccgtcacccttggccgctggaacgccggcgtgcgcggacagggtcgtgaagcactgttctcccgcacacaagggggtatggtttcatatacgttcggcgagcgcgaattcgtgctgcgccgcccgtcgatcaccacgttccgtccgctgacggacaacgatcgcggtgctggacacgctttcgaacgtgccgcgtgggcggtcgcaggaaagtatgcgcgttgcgtcgactgcgcgatcgcaaatcgtggagaaaatgccgtggaagccacgtatacgtacgaattggcgattccgcagcgcacgaaagtgacggtccgttacgttgccgacacggccggcctcgtttcgctcgacgtcgagtatccaggcgagaagagcggcgatctgccaacgattccggcgttcggtatcgaatgggcgctgccggtggaatatgcgaacctgcgattctacggcgccggtccggaagagacgtacgccgaccgcaggcacgcgaagctgggtgtatggagcacgacggctggcgatgattgcgcgccgtacctgctgccgcaggaaaccggcaatcatgaggatgtgcgttgggcggagatcacggacgattccggccacggtgtgcgcgtgaagcgcggtgccggcgcaaagccgttcgcgatgagcctactgccgtattcgagcacgatgctggaagaggcgctgcatcaggatgagctgccgaagccgcgtcacatgttcctgcgtctgctggccgcgcaaatgggcgtcggcggcgacgattcgtggatgtcgccggtgcatgagcagtaccagctgcccgccgaccagccgctcagcctcaacgttcagctcaagctgttctaagctaagccagcttcagcctcaagcataaccgccgattcgcggcataattccggccgacttgccaataggcaggccggccgattctgttgatggctgaaaacaggcagggtgcctaaaatgaaagcacgtctttgaagcaaacgacgcctcaaagcatgtttttctgaaggagggcatcatgagctatccaaatatgaatcccggcaatcccaacgaccccggtcaaccaccgcagccgggatacggcgcctatgcaccgaaccagcaagcgcagcaatcgcaacagcaggacggtccacaaagcggcggaccagatgccgagcagacccctcgctattccggcaatccatatggcaacccctacggcaatccgtatggatatccgtacggtaatccgtatggttacgacccgaatagccatagcaacgacagtggcgagtgggagccggtaagcccgttcaagttggtggaatcgtggctgccgcaacgcgcgaagaatgccattcgcggtgtgtacggcgtgctcggcgtgatggcgattgtgctcggcattgcgctactcatctggccgggggtgacgctgaagatcgccgcggttgcgttgggcgcgtatttcgtgatttccggggtgatccgtatcgtcaccgcaattgtggagctcggtctgccgggaggctggcgcgtgcttgacattctggtcggcctgttgctgacagtcggtggcgtggtcatgctgaagaatgcgaccctgtccggcgccatgctggcagtgctcgtcactatggtggtgggcctcggctggatgatggaaggcgtgatggcgcttgtcgaatcgtggcgcatgccgagttccgcatgggctgtgatttacgcgctgatttcgattgtggccggctgcgtgatgctgttcagcccgctggcctccaccggttggctgattctgtttggcggatgcgcgttggttgcacttggcattgtggcgatcgtccgcgcgttcacgtttggcaaggtcggcaagtccggcaagaagcgctaactacgcgtagttctcccgtataggcgataaacccatacgggagaacgcgacgtgccgtacgattgacatgattttatagtcgcgctatgctaagtgaaacgtttcgacgaaacgattcgataaatagcggatagaacggcacaagagggaggcgagacgcatggcaggcatcaaagacgtggcccgcgaagcgggagtttccgccagcaccgtctcctatgtactatccggcaagcgttcaatctctgcgaaaaccaccggcaaagtcatggccgccgtagaaaagctcggttacactccggacgccagcgcccgtaagatgcgcggcatgcgcaaccagatcatcgcgttgagcgccccgattcgaggcgacatcaaccaggccaggtacaacgcctacttcctgcgcaccgcatgggccgcaaggaatgcagggtatgacgtgatgttgctgaccggtccggatgcagtgaaggatatccgccgcgtgacgcaaagcaatcttgcggatggcatcgtgctgctcgacgtgaagcaggatgacgagcgcgccgctcaatccggcactttttccaagccgtgcgtggctatcggctatccgtcgtcgcacgccggctgcgcctgcgtggacatcgatttcgcgctgatgggccgcaaggccgtcgacttcctgtacgagaagggacaccgcaccgtcgtgttcctgcgcaacaacgaatccgactacaaccgccattccggttacgtcgtcatcttccgcgaaagcctgctggcgcacgcgaaggagctcggcatgacggtcatcgaatccgagcattacgaagcggacagcttcgacgcacagcacttcgtcagcaccgtcttcgcgcaccccgaccgcccgaccgccatcatcaaccaggcgaacgcaagcgtcctcagccaggtgctgatggcgttgcgcgacgcgggcatgtcgattccgcaggacgtttcggtcctgtcgtgcggcacgtatttcgaaggcgagccgacgcgcttccccatcaccgaaatgccggtcatgccggaggagctgtgcgccgaagccatgaacctgttggtctccgccatcgaggagcacaccgacatcaaaggttccgtggaactcatcgaacccgcgctgaagcgacgcggatccgttgcggaagcggggtccggcggaacaatatagattttcctgcgattaccggaaggcagagcggccggacggaatcgcaaggcaacataatttcatacggataatcgaaacgtttcaatgacgatataacggcctccgaagaaaccgaacaaacgaacaagccgggcgaaatccggcgaatccaaacggaccgcggaatcgcacgcacgtcatcgaaacgtttcaatacaaccagatgtgagccgtgccgcagggcgcgcctcaagaaggaaacaaggagaatagcaatgaacatcaaacgaggactggccacgctggccatcgcagcactgtcgctgacctccctcgccgcatgtggtagcgataccgcacaggacgaggaaaagccggacagcctgtcgttctggtactacgaagaggacgacgcaggccagactcaggcttggcgtcgcgcggccaaggccttcgaaaaagagaccggcgtcaagatcaacttcgagcgcaagtccttcacccagatcgcgcagaacggcagccaattcctgaactccgacgaagccccggacctcatggaatccaaccgcggcaacggctccgccggcgtgctctccaccatgggcctgctcaccgacctcggcgactatgtcaagcagtacggctgggacaagaaggtgaccggcgcaaacgcagcagtcgccaagtacgacgagaacggcatcatggacggcgatacctggtacggtatgaccagctacgctgaattccagcgcgtctactacaacaaggacctgttcgccaagtacaacatcaagattccgaccacctacgacgagttcgtggacgcctgccagaagttcgtggacgccggcgtgaccccgattgcagccgacgcgcaggaatacggcgtgatgtggctgtggtggcagctcgtttccaagaatgccgactccaagttcatcgacaactggcagctgtacaggggtgacgtcgactggaattccaaagtgctgaccaactccgtcaagaccatcaacgagtggcttgacaagggcttcatctcccgcaacgccactggcatgaaggccgaggacaccacgcaggccttcatcaagggcgaatatccgatctaccagactggtacttggaaccagggccgtttcgtcaagcagatcaagtcgttcgattgggacgcggccgtcatgccggaatccaactacgcagtcggctgcgcaggcaacctgctggtgattcctgagaagtcgcaccacaaggatctgtccgccaagttcatcgactacgtcctctccgatgatgtgcagaacttcctcggcaacgcaggcggcattccggtagcggcagacaccagcaagatcaccgacgcgaagagcaaggccatgatcgaggaatacgattcctacgccaaggacggcaagctcagctactacccggattacgcggcctccaacctcaccgacgcggttccagcggagttccaggagctggtcaacggcaccaagaagccggcagacgtgctcaagaacatccacgagaagtacgacaccggcgtcgaggacatgggcgtcaagaacaactaaaaacaaccgatccttcctttccattccaactccaataatggtgcggcccgtcttcgggcggaccgcaccaaccctttcctcccccatacattccgcacgtcgcatcgcgccaaatcgtgcgtcatcacagaacaatccatcggaaatccctcggatcatcaatatttcaaaggacttgcaatgtctcaaaagaccaagcacgaagcctccatgtcgagacttcccggcaaccgctccgcgaaattcgttccatacctcatccccggcctcatcggtctgttcgcggtagttgttgttccgttcatctggaacatctacctgagcttcacccgctggcgtggcgtcggtcccgtcaagtgggtcggcctgaaaaactggaaacgcctgttctccgattcgacgttctggatttccttcgctaactcgttctggatcatcgtggctatcgtggtcatccctaccatcctcggcctgttcatctcgtctctgctcaccgacgtgatccaaaagaagttcggcggcaaaaccgcttccttcctgcgcgcgctgttctatttgccgcagctgcttccggtggccgtcgccgcaatcatcatgggctggatcttccgcccggaggacggtgccgtcaacgcactgctcgccaagatcggcttgggtgcattgcagcacaactggctgggcagccctgacagcgcactgccgatcctcatgttcatcctggtgtggatccagctcggctacccgatcgtcatcttcatgtcgggcctgcagcgcgtcgatccggaactctacgaggccgcaggtcttgacggcgccaactggtggcagaagttccgcgtggtcaccctgccgtccatcatccctgaactgctggtggtcatcctcaccgcaaccatcggcgcactgaagaccttcgctccggtctacctgctcaccaagggcggtccgggcacctccaccacggttccgtcgtactactcctacaaccagttcttccaggtgcagcaggtgggctacggtgccgcaatctccacagcgctgactgtggtaatcatcgtcttctccatcgtgttcaccctcgtgcagaagcacgtcgagaaggaactcgtctgagagaaaacccgaaaaacaatcgcaagaacatactaaaaatccgaaaagcaaaggtgccatcatgacttattccatgtccacggccgccgcgcgcaaggcctcgaagaaaacgcagcacgtgcgttccgcaggtgactggatcaccctgatcctgctcgtcgccggagctctgctcgtcctgttcccgctgctcgtcctgaccgtcaacgcgttcaagacctccgccgattacaacgccaccggcccgctctccctgccgaagcacttcaccatggagggcatcatctccttctggactaccaccaacttcccgctgaagttctggaacagcttcatcatctccctagtggtggctgtcgcggcggtcgtgctgtcggtgctcaactccttcgcgctcggcatcggcaaggtcaagggcaacacctggatcgtgctcggcatcatgctcgccaacatgatgccgcaggaagcgctgctctacccgctgtacaccatgttcaagcaggtcggtctgtacaacaccaaactcgcgatcatcatcatcttcaccatcatccaaagcgcctacggcacctatctgctgtcctccgtatacggcacgttcccgcaggccatccttgaggccgcggccatcgacggcgcctctcgctggcaaatcctgcgcaaggtggtgctgccaatttcttggccgaccatcagcgtgctgttcgtgttcttcttcgtgtggacgtggaacgaatacatgattccgatggcgttcctcatgagcgatgacgtacagaccattccgctggcactcgccaccctgcagggccagcgcaccatggaagcgaccacgctggcatcggcttcgctgctgagcatcatcccgaccatcatcttcttcatcatcttccagcgcaagctgtcgcagggtatcaccgccggtgcagtgaagtaacgcgacccaacaacgctgggatgttgtgaaataacgcaaaaacagatacaaccggccgcggcggctttcagcaccgtggccggcattatcgacgcgcccactgcaagggggatctacgatagtcggcagtggtaggcggcacacccatttccgcgtttcctaagctgtttaacaaaggagagaacaatgaatactatggcgacttccggtttcggcaacggtgccctcgattcgctagcaatcgcgacggaccacggccgtacacgttgcgtcaacgccgaaaacccgaccggcggcaagggcactgcagccaccgccgccagcgcgctcggcccgtcacgtaagggcagcccttgcatccagacgatcaaggcgggcgattcggtcacgctgatggacgtcgatggcccgggcgtgattcgccacatttggatgacggtcaccgaccgcacttccccgaccggtccgaacgtactgcgcaatctcatcctcgaattctattgggatggcgaggagacgccgtccgtgcagtgcccgatcggcgatttcttctgctgcggtcacgcacaggcctgccgtatcaattccatcccgatcatggtggtgccaaatcgaggtttcaactgctatttcgccatgccgttcgagcacgcgcgcattgtgctgcgcaacgatcacaacgaggacgtgccggccttcttctaccaaatcgactacacggaatacgacgcgctgccagccgatgcgatgcgcttccatgcgcagtggcgccgcgaacgcgtcaccgaaattgcccgtgactacacgattctcgacaatgtgcacggccatggcgcgtacatcggcacctaccttgcgctgaccgcgctggaaagccgctggtggggcgaaggcgaagtcaagatgtacatcgacggcgatgaacagtacccgacgtggtgcagcaccggagcggaggactacttcggcggcgcgtggagcttcgccgacttcgacgagcacggccgcatgcacgagaacacgttcaccggaccgtacctgggattcccgttctattcgcagcgcctcgccgcacatcgcgaaagcgactactgggatgtggccacacccgtcatgcgcggcctgtaccgctggcacattccggatccgatttatttcgattctgacctgcgcgtcacctggcagcagatcggcaccgaggaagccggcaatttcgagcggcaggatgacgtcgcgtcggtggcatactggtaccagcttgaaccgcacacgccgttcgatccaatcggtgaccgtcacttccgtcagccccgctgatttacgattattccgctgatttacgccgatatcgccgtatcgtgcgttgacatgggaatggatatgttccgtctcgtgtcagcgtacgatacggcgattgtgttgttatgcgggcacagtaatcacattttcttcaagataacccgatgattttacaatagaaatgacgattgcggcatgccagacgcataccgacgtgcgtatagtaaaggcacaacagaaaaacaacagaagaacgaagaacaagaaaaacaacacaatagcgacgcaccgcacgatgtagagaagaaaaaaagaagcaagaaaccaggcggtcgtccgaaaggaaacatcatgaagaacaacgacactttcaaccagatcctcaactccaacctcgcttccatcgatccgggcttcggccagttcgcacttgccaaggcttccgctgatctgatgaagaaggtcctcaacaagtaagaccttcaagcaggaaggcaagccgaaccgcgtcaggccatctctttgaaacagaccgcgtgaggcaaggcaccgccgcagcgaacgctgcggcaccgattctcttctttccgattttttaaatcgcatagcgggaggccgcgattccaaccgaatcgcggcctcccgctttttcatacgcgcacatgcacccctgtcttgccggcaatgtccattatttgtgccacacaatcacgccaatacatcgctttccgtcaacttcgcacgaacttaacagcaacttaccagcgaacttaacagatgcgaagttgccgttaagttatgttaagttgtctggcaagttcggtggcgtatctaccgcacgccacctgcgcagcgcaaccgctacagttcctccatcgcaagattgcgggctgcggcgcgttcgcgggggccgcgcgtcacgtagaagccgatcgccacaattacgaacatcaccgtgcagcaggtccacagcacgtgactgccgaacgcgttcaaaatccagcctccgacaagcggcgaaaacgcgttggatagcgaccacaccaggttgtacaagccctgatacgtgccgcgtacatccttcggcgcgatattcgccaccgtcgtagcggcaatcgggaatgtgccaagctcgccgagcgtccacagcacggtcgcaatcgcgaacgtcacccacgaatcggcgccgatttggaacgcatagccaaccgcggtaatggacatgcccagcaccagcacacgggtgttgctcatccgctggaacagcgcgatcgcaggaatctgcagcaaacacagaatgcctccgttgatggtcagcaggctggaatattcgtccgtaccaagcccaatctgcgtcatcgaaatcggaagtccgctgacgatctggtaatacgccagcgtgtacaggaacatcagcaccaccatcgacatgagcgctttgtcggtgcaggcacgacgatagctgcgccaaatggagaatttcgattgctgcgattgagccgtttgcgcagtgccagaacgttccacaggttgttccacggaacgttccacggagcgtttcacagaccgtccgacaccgtgcacgcccagcccggcctctttgaagaatgccatcatcagcaacgtagcgaataccaacacagccgcttccgcatagaacatcagcgaataggagattttgacaagctggttggcgatgatcgggccgatagcgaagccgaaattcgcagcccatgtttgcagcgaatacgcacgcttctgcttgcgaaacggcaccacgtcggaaacgtaagccgcgaccgcaggcgtcggcatagatgaaatcgcaccgtatatcagcaacgtaatcgccataatccaaggattgccgatacaagccaacaaaaccagcatcaccgcggaaccgagattgccgataacaatcatcgcggggcgcccgaatcggtcagacagcgcaccaccgtacaggcagccgaaaataccgccgaaaccgtacatggagacgatggtgccggccacgcccgcgctcacatgcatgtcggagacgaggtacatggaaagaaacgacgtgacgaaacggcccatccacaggatgagcagcgtggcccacaagccccagaacatgacgggcaaaccgaaaatctctttgttcttctccattcttgccatcatatcgagcaatatcgagcagacgcgaagccgccgccttttcccggggtgctgggacaatggacaactatggcaatgaaaaaaggaccgaccaaggggtcgggcggaaagcatcgtaacgcgctgaagggcaaggggccgactcccaaggccgaagatcgcgtatatcacaaggcttacaaggcgaagaaggcggcggatcgccgcaagatggccgatccacgactggcggcacgtcgtcgcgtggcgaagttcacttcggaatccgacgatctggtcatcggccgtaacgcggtgcttgaggcgctgcgttgtggcgtgccggcaaccacgctgtatgtggcggcacgtatcgagcatgacgatcgcacgcgcgaaatcgtgcgtctcgccggcatccacggactgcatctgctggaagccgacaggcttgaaatggaccgtatcgcacgctcgtcgaaccatcagggcgtggtgctgaaagcccagccattccagtattcctcgctggcggaacttgtggatcgtgcggacaagaaggcgcgcgccatggaagcagccgattcggaaagcgcgcgcatcgcggcacgtccgctgttcatcgcactggacggcgtcaccgatccgcagaacctcggtgcggtcatccgttccgcggccgcattcggcgcgaatggcgtgattctgccggaacgtcgttccgcttcggtcaccgccgccgcatggaaggtgtccgcgggcgccgcagcgcatatgccggtggctcgcgtggtgaacctgaccaaggcgatcgaaagcctgaaggaacgcggctactacagcgtcggtcttgacggcggcggtgacgcgctcgtcggcgaaaccggcttcgaaaccgatccgctggtggttgtgctcggctcggaaggcaacggcctgagccgtctggtacgcgaggcgtgcgattcgatcgccggcattccgatgtcgaatatggtcgagtcgctgaacgcgtccgtcgcggccggcatcacgttgtatgccgtggcacgcgcccgtcgcgaggccgcagcagccaagtaatcgtttattacgatatttatgaaaaagctcaagccttatggcttgagctttttcatatgccattaacggctaatggctccacaccgcagcgtccggatcatcgtccgggttgtagccgtcctcgtcggtgccgtaagtgtattcgtcatcgatcacgccggaatcggcctcggcgttcagcgcgtcgacatccttcgaatcgagcttgtactgcggcagcacgttctccacatagctcttcacggcttcggtcatggacacgtcgtggccggccttctccgcaaggaaccaacgatggtcgagtacctcatggaagaactgcgccggctcgatctgggagcggtattcgcgcggaatcatgcgcacggtcggctcgaacacctcgcgcatccagtcggtggccacgatttcgagatcctcgccatcacgccacgtggaggtgcggtaggcgtccagatcgttgagcagacggcgggcctggttctcctgcacgtcaagaccggtcagtcgcagcagcttgcggttggcgtagccggcgtccaccacgcgcggacgcaccagcacgcgcttgccgtcctcggcggtcttcatttccagctcgtccacgtcgaagcccagttcgttgagcttattgacgcgcttttcgatcttccacatctcgtccgggctgaacttgtcggtgtcggtcagcgcgctccacagcgaatggtagcggtccaccaggcggtttccgatttcgatttcgtccacgttgctcggcagcaatgcgccggaagacagatccatcagttcgccgatgatgttcgtacgggccaaatccacatcgtattcacgctggccttcggtgaggttcacctgcagatcgccggtttcggcgtccaccaggaacgcggagaaagcgtcggcgtcacgcaggaacagcacgttagacagggacacatcgccccaatagaagccggccaggtgcagacgcaccatcagcacggcaagcgcgtcgatgagtcgttcggcggtgtcgggacgcaggttgcgggcgaacagcgcgcggtacggcagcgagaatttcagatgcttggtgaccaggatggcttccagcggctcaccttgcgcattatggcggccggtgaccacggcgatcggctgcacggtaggcagttccagcttctgcagtcggcgcagcagctcgtattcgcgttccgccacgttgcgtgtgatttccttcatggcgtagacttcgtcgcccacgtgcacgaaacgcaccacgtgcctggagatgcctcgcggcaggttgaccagcaggtcctcaggccatgttgccagcggcttctcccacggcagcgtgaacatcttcggattcgaactcgcggcggtgatcttcaacgcctgcggctccgggctctgcgctgcggggtcctcggccttcacggaagtggccttaagcacacggggatccatctgtggcaattcatgtgattccatagctcttcaatttacccgctgacctacccacggcaggcggcaaagggactacgagtgtcacgatgagaacagcgggaaaagaaaagccccgcaccaacgcggggcttttccaacgagacaataagagaggaaagagaatgtctcgtttaatggttgacggacgtttgcacatccgccaagtattggttcaaccacccgccaagcgttccataaggaacgcccgacggttggttactcgttatcgtctcagttcagacgcagctcggtggacggagcgaacaggtgcatcttggacgggtcgatcttgatcttgacggtatcgccgaccttcggaagagcacgcgggttcacgcggatcgtggtgagcttgttctgatcggacatcatggtggacgcctcagcagcggagccatcggtgatgatgttgccgtagatgtagccgtcggagcccagatcctcaacgttcatgaccttgagggagaaggcgttggcctcatccggggcagccaaggaggcgtcttccggacggaagccgaccacaatctggccgttgtcttcggcggtgagcttgttgacggcctcagtcggcagatccacggtgtcctcgccgatctttgccttgccgttgaccaccgggtgggtgttgatgttcatcgacggggagccgatgaagccagcgacgaagacgttggccggacgatcgtacagctcagtcggagcgccgacctgctgcagaatgccgagcttgatgacggcgatacgatcacccatggtcagagcctcggtctgatcgtgggtcacgtacagggtggtgacacccagctgacgctgcagagcggcgatctgggtacgggtctgcacacggagcttggcgtcgaggttggacagcggctcatccatgaggaagaccttcggctcacggacgattgcacggcccatagccacgcgctgacgctgaccgccagacagagccttcggcttacgatcgaggtactcggtcaggtcgaggatctcagcggccttctcgacgcgcttgcggatctcttccttcggggtgccggcgatcttcagggcgaagcccatgttgtcggcgacggtcatgtgcggatacagagcgtagttctggaacaccattgcgatgtcgcggtccttcggctgcatcgtggtgacgtccttgccaccgatgaggatgcgtcccttgttgacctcttcgaggcctgcgagcatacgcagggtcgtagacttaccgcaaccagacgggccgaccagcaccaggaattcgccatccttgatgtcgaggttcagatcatccacagacggcttgtcattgcccgggtagatacgagtaacatggtcgaatacgacttctgccatgatttgtcatcctttcagaggcaggtacgtgcctcacgatccgttgtaaagggatttttgttcggtgcccatcctcgcggcttactactttgacaaagccacaattcaaagcgtttacttatttggtttggcgaagatctcttcgttgagccatgacctactatacacacccaaaccgaatcgtcaatgcgtgtcgcgggttttcaccgctcaaaacagtctattagggggttatcatcccctcaaatcgatggtttttcatcacaatatcctcattccgcgagagaatggacggtagtctgaacggtgagacgtggaggttcatcgtgcgcaatatccgaatcggagtcgtcgaggacgaccctgcaagctgccaattggtactcgattacctcaatcgctaccaaagcgagaccggcgagcaattcaccgtctccgtattcgacgacggcgcgcgcatcgtggaaaaatacagccccgtctacgacattctgctgctcgatatcgaaatgaaggaaatggacggcatggaagccgcccgtcgcatccgcgagcgcgacgacaaggtggtgatcatcttcatcacggccgcgccgcaatacgccatcagcggatatgaggtgcgcgcgctgtcgtacctgctcaagccgctgccgtggttcgcgttctcgcaggaactgaagaagtcgatcgacatggtgcggcgcaatgacgacgattcgatgcttatcgacaccggcaaagggcagatgcgcctgaatctggcggatattctgtatttggagtcgattcggcacaccatcgtcatccatacgcttgacggcaagctgtccatcaacggcacgctcaaggatatggaagctaagcttgccgactaccatttcttccgctcgaactcctgttatctggtcaatctcaagcatgtgacgggcgtggcggatcaggattgcatcatgtcgaacggcgagcagctgcgcgtgagccggccgcgcaagaaagcgtttctgacagcgctgaccgattacatgggcggcggcagatgatcggggcgatcgcaggcatcgcgcatatcgcaaatatcgtgaatatcgcagatgccacaaatgccgcacacattgtgcacgtgttggcggcgtcggtaccgtcgacggtgccggtcacccacaccttgcccgacattccccgttcgtataccgccatctgcgaatgggcggcgtgcatggtgtacatcgcggtgctgtaccgacgtgtgccgttgcgtcgttccatcatcgtcagcgcggtcggtctacccgcgatcgtcgccgtgcagtatttcgacggcagcatgccgatctggttttggatcgtcggcatgctgctcgccttcggctgcatgtacctgacgattctgttcggcgccggcaccggcaaacgcgaaggactgtacatcacggcgcgcgcgttcgtactggccgaactggtggcgtcgctgcattggcagatcgtcacgttcatcggcatgcgcaacggccgattcgcggattacgattggcatgccgtcttactgctcgttgccacctacgcattgtgtttcggcctggcatggctggtggaacgcggcaatttcagccaaaccacacccacgctaccgaccgcctccgcggcaaccgcgacggtggccatcaccatcgtcaccttcgccatgagcaatctgagcttcgtttcgaccaatacgccattctccggttcgatgggccaggaaatcttctatatccgcacactggtggatttctgcggattcgcgattctatacgcgcaacaggagcaggctcggcgcattgaagcgagcgcggaaatcgcgtcaatcaacgcgcagctggacagccaacatcaggagtacctgcagtcgaaggagaacatcgaatcgcttggtcggcttgcgcacgatctgaagcatcagatcgcggcattgcgcgccgaagtcgatcctgagcacgcggcggcaggattcgagcagctggagaagtcggtgcagcgatacagcgcccagcagcataccggcaatcccgtgctcgacgtcatcctcaccacaaaagagcgcacttgcgccgatcgtggcatcagtttcactgccgtggcggatgggtcgctcttgtccaatatgtcgtcgatggatatcgcttcgctgttcggcaatgcgctcgacaatgcgatcgaggccacgtcgaagttggccgatccggaacaacggctcatcaaactggcgttgttcgagcagaattccttcaccgtggtccgcgtcgaaaattattacgattcgcggctgaagaaagatgccgaaggcaatctgcgcaccacgaagcgcgatgaccagcatcggcatggcttcggcgtgaagtcgattcggcacatcgcgcagcagtacggcggcgaagtgacaatccgcaccaacgaccactggttcgtactcaccgtgctgcttccccgccagaccggcctgatggccatgtgaggatggcgtccatgtgaggatggcgagccggcaatgcgaaggctaacgatctgcagctttcgcccgcggtagatgccaagcggcaagcggcttggccagacgggaggcggtgaacgcgctgacggccaccgcaaggctgattggcacgaacaggttgatcggagcgtcggccaactccatcaccaggcaaatcgacatcaacggcgcctgctgcgaggcggcgagcagcgcgcatgcacccagcagcgcatacatgccaatcgaattcgtgtggaacacctgcatccaaagaatgcccagaatcgcacctccggaagcgcccaatgcgatgcccggctgcagcacgccaccggaagcgccggaacgaatcgtcagcaaggtgacaatcgccttcgccacgaaactcaacagcagaatcggcagcacggccaaatcggccttcgaggagaaactcagctgcgcggtggcgcggccattgcccatcacctgcggcacgacaatcgccacaacgcccgtcagcaggccggcgagcggcatcatccacagaatgcccgctccggatggcttgtttttctccgcccactgggagccgcggcggaacagcgcgccggcggcgccaagcatcagtccggcaaccagtgcgaacaccatgtagtcgggggtaaacaggccgtccgcctcgccaatcaaatagaacgtgtgcgtgcccttgaccaggctcgccacccatgaggcgagcgccgagcaggcgaacgcgagtgagaccgtttcgagcgtcacgtcggcgagcaggatctccaccgcgaagaacgtgcccgcaagcggcgcgttgtagacgcccgcgagaccggccgcggcggtaatggccaccagcatacgcgtgtctttcacgtcgagacgcacccagcgggcgaatcgttggccgaacatcgcgccaagctcgcgcggagccacctcgcggccgatcgacatgccggtaccgacgataaaaatctgcagcagcacatgtacgatggtctgccagaccggcatcagcgcaccaccgacggctttcttgacggatggcactgttgtggtacgcgtgcgcagcagccaccagatcacggccgcgatggcggcaccgaccgtcacggaaatcgcacgacggatggcaggcacgttgaacgggccggattcatgcgcgttctcgatgtatccaagcgcgaaacgttcgacctggtacagcatgagcgtcagcaaacctgcggccgcgccgatcgcgatgccgacgacggccaccgccgcgatcagcgccggtattctgccgattttcggctgctgttccgcctcgtcctgcgattgatccgacaccattgcctctctcacgttgtgtgtacctcgtctccagtccgtctcgtcatacgtgttaccgcatcaccatcgttccaccgacggcggatttattcgccaacatcccccaccagaacatgaattccaatgtcagtcacacaacttgcgtctgcatagtgaacggccgatcaggctcgtcgtcctcggcaacaaggccggccacatccgccaaacaccataaggcgtacagcggcagattcatcggcggcaaatatattggaatatatagcattcaagacacaagatgcacaaaatagacaatttcaaatcgccgtttttgcacaaaacagataatttccgccacagccaaagacaaggaaatcaaacctccgccacaccagggaaagcgcaaatccgcaatgtgaaacgcagaagagttacgtgcatggctcgcatgttgaaaacatgagcaaccatgagcaccagagaaggaatccacccgtaacacaaccgccgcagtccggaaatattagcaccatgttcctgttttgccgttttcataagcgtgatatcgatggaatcgcaatattcgttcggctcattcgaagcatcaacgcaatacggaaaagagaagccatggccagcatcagcacaaccgcgcaagcgatcccgcaaacgccgccgcaaaccccatcacacccttcgatgcctatttccagcactgtcaaagccgtaccccgctccggcatccgcgacgtgttcgaccgcgcactcgccggcgatgcggatgagctgcgcgaaggtctgcgccggctgcgcacattcgcggaacagatatgaaaagcccgtccagggaaaagggaagacctggacgggcacaaggaaaggaagagaggaatcagtgcagacttacttggcggcctccttcttgtcgtcgctcttcggcatgacccagaacttgagcagcggatagctgacgatcacggcgagcaaggtgttgaccacggatgcgatcgtgcctgcgatgccggcgttcatgccccatccctggcacagaccggtcacgtagcccggcagcacaaggttcactaccacgatgatcacggcgaggatcacatacttccaagcggcgtccttgaagctggagtcggacttgaatacccacttcatctgcacgaagaagttcaccacctgcgcaagcacctcggccagcaggaaggtgaggaatccgcccaggccgttgcccttggtgtcatagttgaagatcaggaagtggaacggctgcgtgagtcccagacccgtgatgaagatggcggtgccgatccacgtcaccacgaagcgggtgatggtggagatgttcgacagcacgttgaacaggatgaactcccagatgttcggatgatccttgatccactggcggatcgggccgaccttcttctcgccggcagcggtttcggccggcttcgcagcattgttgtcagtcatggttcagctcctttgcggtgtgcttgtttgcggattggttgcggaagaagccggcgatcacgccgcccaatccgcggaaagtatgcccgttggcgatgttcacgatggcgtcgaccatcgccgagtcgaccatgccttgggtcatcttgctcatggcgcgaggcggcatgttcaggatgaacagggtgttcagatccggcgagccggtcttctggcggatcttcgcttcgcgcttggtcagtgtcttggcgacggtacgcgccacgaagcccttggaatccacccacgacatgatcggatcgttgacgccgaacgtcgtcggcttgccgtgggcaagcacctcatggccgaacagcacggccatttcggtgtcggtcacgtccttgacccggccggtcagatagtggccgatcgcgggatcggcggcgcaatcggcggtcgtgcaatcgccggccacggtgtgaggaatcgcaagcggcaaatgctccgcattgtcgccgaccagcagcgtccattcgccgctttccgtcttccatgcattggcggcaacatcgaaatgacggaacgtgtagcggtcgaaatcgatatgcacactcttgctttcatgcgcggccaactctaccttgacgaagcccttcagctcacggtcgggatggagcacgccaccctgcggcgcgcgcacatacaactgggccacggtggagccggcgacatcggaatcattggtgacgacgaaatccacaccggtcgcggtggcggtgatcgcgctgtacgtgaacgtggagtagctcagaccgtagccgaacgggaagcgtacgggcacgcccacggtctcgtaatagcggtagccgacgaacgggccctcgcggtagatcgcgtcacgcccaatggccggataccagccggagcttgggcaatcctcgtattgcatcggccaggtttcggccaaatgtccggatgggttgacttcgccgatcagcgcacgcacggtggcggaagcgccggcctgaccggacaatcctacgtacagcatggccgcaacatcgtcgaaccacggcaattccaccggggaaccggcaacgagcacgatcaccaccggtttgccggtcttcgccaacgccgttacgagatcgttctgcacctgcggaatcgccatggtggatcggtcgaggccttcggattcgctgcgttcgtcgagaccgacgacggccaacaccacatccacggcgtccttcttggcgagcgcgacggcgtcgttcagcagcacctcatccggcttgccttggcggtcgtagccctgctcgtagccggccaataccagtccttcggcgttcttgacctcgtcgaggatgttctcctccttggtggcgttcaccttggatgagccggagccctgatagcgtgcggccgcggccatatctccgatgacggccacgcgggtgcccggtttgagcggcagcgtggcggcgtcgttcttcagcagcacgctggaatgttccgcgaccgttctggcgatatcatggtgcgccttcgcgatgtcgtccgacagcagatcgtcgcggccgacgccgacgagcttggtcgccgccgcgattttggcgacttccgcggcacgcttgttgatgtccgcctcggcgagcgtgcccgctttgaccgcgccttccagctcgcgcacggaggtgaaacctggcgacggcatttccagcgagccgccggctttgacggctgcgacggcggagttggagccgccccaatcggagacgaccatgccgtcgaagccccattcgtcgcgcaggatatcctgcagcagatgcttgttttcgtgggcgtagacgccgttgacctcgttgtaggaggtcatgatgctcatcggcttggcctcgcgcacggcgatttcaaaaccggtcagatacaattcgcgcatggtacgttcgtccaccacggagttgctggcctggcggcgcagctcctggctgttgaccgcgaaatgcttcgggcatgcggagacgccgttgctctggatgccgcgaatgaggccggcggccatacggccggcgacgatcggatcttccgaatagtactcgaagttgcgtccgcacagcgggttgcgtttgatgttcatgcccggtccaagcaacacgttcacgtcgagatcgtgagcttccttgccgagcgcctcgcccatctcttcggcgagcgccggatcccaggtgttggccacggtgcaggcggtcgggaagcaggtggccggcttggatgagccgatgccgaggtggtcgccttcgccaagctgcctgcgcacgccgtgtgggccgtcgctcatgacgaagccgggaatgtcggcgcgatcgttgccgcgcgaatcccattcggatccgccggacagcatcgccgccttttcaacgatcgaaagatcttcaagttccatgggttctccctcgcactaggtgttgccaaaacctgctttgccgagcctgccctgtccgctccgcccgactgcgctgttttcttgcgatttcccgctgccgtaccgcgctgcatcgcaccgtgccgcacgcgggatttcgccgctagtttgattgaaccagcttttgcgatgccatcaccgccgtattacacaacctgtcgttttgctcgcacaatcggcatatgggcgcggtgaagagggtatgcggtggcgcagaacgcgcataaaatcgcatcgttccattttgcaattgatggcaagcgtttcgatatgcgtatatcgttgcaatttcaagcgactcgccgatattgatacctttttgcgcaagcgctatcatacttaacgaaagtaagttttgctaacttttcttcaatgcggaacatgctttgatcactcaacgcggagagcgatgtttcgcagcgcacagaaaggataatgagatgcgcgaccagcaaagcagcgacacgagcatctccctggacgccaatacggacgtccagcatcgtcacgatgacccacaactacaatctcgtgttccccaccgccatcgtcatcgcactgtgcgctggcgcgtcggtcttgaccatcaagcgcatcaagtaattcaaacgggaccgtaccgtcgcatatgatgacacgatcccaatccagttctcccgatttttcccacactcaaaggagccccacatggtagacagcacactgttctcgctggccacgctcaacgcccatccggcaatgaacccggattcggtgatccagggcgatcattggcgcatcggcctcatcacggacgcgctcgtccgtttcgaatggtccgacagcggccgtttcgtggatgacgccacgcagatggcgatggtccgcgatttcggcgaaaagcctgaattcaccgtcgccgaacgtaatggctggctggaaatcgacaccccgtcgctgcatatctcctacaaccagcgcaagttctctccggaaggcctgtacgcaaccgtcaagcacgtcaacgccatcgaaaacacttggcattacggcgacgtgcagcgcaggaacctcggcggcacctaccgtacgctcgacgaggcgaacggccgcatccccgtcgatccgggcgtcaacagcaccgacggttgggcgatcatcgacgattccaagtcgaacgtcatccgcgaaaccgccgaagtgaacggcaaccacaacgatttcggcacgtgggtgaccccgaaggaagagccgaccaccgacctgtacctgttcggctacggccaccgctaccgtgaggccgtgcacgccctgtaccgcctgaccggcccgaccccgctgctgccgcgcttcgtgctgggcaactggtggagccgctaccaccgctataccgaaaccgaataccgtcagctcgtcgaacgtttcgaaaaggaaggcatcccgttcaccacggccgtcatcgatatggactggcacctggttgacgacgtcgacccgaagtacggctccggctggaccggctacacgtggaacaaggacttcttcccggatccgaagcgcttcctcaactggctgcacgagcatggcatgaaggccacgctcaacgtccacccgagggacggcgtgcgcgcgttcgaagagctgtatccgcaggtcgccaaggccatgaacatcgatccggaaagcggcgaggccgtgcagttcgacctgaccgatccgaagttcatggaggtctacttcgaccagctccaccacccgatggaggaagatggcgtcgacttctggtggattgactggcagcagggcggcctgacgcggcagccgggcctcgacccgctgtggggcctgaaccacctgcattacctcgattccgcccgcaacgacggcagcgactacagcgaacgcaacccgcgcccgctcaccttctcgcgttacgccggcccgggctcgcaccgctacccgatcggcttctccggcgacaccgtcgtgacgtgggagtcgctgaagttccagccggaattcaccgcctgcgcttccaacatcggctacggctggtggagccacgacatcggcggccacatgttcggctaccgtgacgaggagctggaggtccgctggtaccagctgggcgcgttcagcccgatcaaccgtctgcattccaccgattcgccgttcaacggcaaggagccgtggaacttccacggcgatgcggaacgtgcgatgacgtccgcgctgcgcctgcgccatgcgatgatcccgtacctgtacacgatgaaccgtcgcgccgcattcgacaacgagccgctcgtgcagccgctgtactgggactatccggaaatcgaagccgcatacaagctcaccgacgaattccgtttcggcaccgagctgctggtcgcgccgatcgtcgatccagccgagcgttccgtgcagcgtgcgaaggccgacgtgtggctgccgcagggcgaatggttcgatttcttcgacggtcgccattacacgtctcgtccggccgaaggccgccgtctggaggcttggcgcgatctcgaccgcatgccggtgttcgctaagcccggcgcgatcgtgccgctgcagatgcccgccgagggtgaggcgctcaactccgtggccaacccgcgcgcactgcaggtagtggtgttcccgggtgccgaaaacagcttcacgctgtgggaggatgacggtgccgcacagagcaaggatcgttgggcatccaccgaaatggcgctgcgttttgagggcgattccgcacagttctcgatcgcccctgcggaaggtgcgacggacgtcattccggcttcccgcgattggacggtcacgttccgtggcatcgctccggaagcgatgcacgccgtccgcgcgaccgtcgacggctctgccgccgctccggaagtcgcgtacgatgcggaaacgctgagcctgaccgtcacgctgcgtgacgtgccgacgagcgccgtaatcgccatcgatttcgccgacggtcttgccgttgcggacgatccggttgaagccgacgcgttcgccgtgatgaaggatgcgcagatgctgtacatgaccaaggagcacgcataccgcgcgatccgcgagctgggcaaggatgcgctgccggcactgagcacgctggaggatctgcacggcgttggcgcgcagaccaaataccagtcccacatgccgcagccggtcatccaggccctggccgaagtgctgacccgcaactgacctcatcgcaataattcaaaataaaacgcgtgcgcgtccggatggtttccgcccggacgcacacgcgttttgttttatgtacgaaattagtatgactcgggcttggccgttaacggcacgctttgaaaactcagtgatggctactttacgcaacgcgctactgttcggtggcacatcgccgtttacgactttggctgctcttatcattccagccatcgcaatcggactaacagtggccagtctgcaatggcttcccaaaggattgtatctattgctgatactgggcttcggcatagtggtacaactgcaaataccactgttcgaacatgcactaaaaccctatgtaaataaggtggccgcatagcagcaagcaagtttccaagcttttgagcaaatacaataaagctcaatctttcgggcggtagcagtgctaccgcccatttacgttttcattcgcatttcgtatgaaccgcatgacacttttctctttaaggcatcgaggtggtgacgttttcttggacttcccgaccgggaggagaacccccttatggcgaagtacagcaaggagcagcgcgacagggccatggacctgtacatcagatacgagcgctgcgccgcggacgtggattggctacaatgtattagacagtccgatgagggacgaatgacatgagattgacctaccagaagggcgacaagctgaccctgccggccggcaccaccgtcctgtactcgcaatggaagcggatccccggcaccctgacctgggtgaagaccgacaaggattccggcgaggtcctcgcgggcagcgaatggaccctcaccccgaaggacggccagccgaccgccatcaccgacaacggcgaactcgaccaggcaggggaggacggcgcgttcaagctcaccggcctcgactggggcgaatacgagctcatggagaccaaggcccccgaaggccacgaccccatcagcgcgccgatcaccgtcaccatcgacgcgaagcacaccaccgtgaacatcggcgacgtgagcaacgcgaagacccccgccaaggtcacctacgaccccaacggcggagagggccagaccccaggctacgacgtccacgtgggcgacactcccgaagcctccgagaacaagttcaccaacaaggacgagtgcaaggagttcgccggctggaacacccagaaggacggcaagggcaagacctaccagaagggcgaccaactcgacccgctcaccggcaccaccatcctgtacgcgcagtggaagaccaaggacggctgtccagccgcccccgccgcgttgcaggagctcggcaagaccggcgcgggcatcacgccgatcgccatcggcatggccgcggccaccctgctgggcgcatgcctgatgatcctgcgccggcagcgccacgcacgccacgcctgacataggccgattgacgaaagagcggggccggccggccatgtgaaccgcggccgggccccgctctttccctttcccaccgaatctttaaaggaagaaatccagatgaagaatccacatagtctcgaaaaacccgccgcgacgctgatcgccgcggccacgctgctggcgggcatgggcctgcccccggccgccctcgccgcggatggatccgcctccgccccatcctcatccgcatccggcaacggcgcggatgacaaggaccagacaaacgccggtgacaccaccacctggacgctgatgggcgccgtcctcacggccgacgacaagggcacgctcaccctgcccgacggacagtccctgcccacgttcgacaagcgccccgacaatgccagcgtgcagggatccgacggcaccaccatcccgctgaccctcgccgacgcggccgaggagcatcccaacctcggcgtgaccacgggaaccggcatcctgaccgccgaagcgaaggacggccaccccgccgtccacgtgcccgccacctggaccacgggcacggcgaccacgctgagcgacggcaccccgttcaccctgaaggacggcgcatgggaggcatcctacgggcgcacgctcaccctgaaggacgacaacgagccgccagtgaggaacatcggcctgtccgacgggttcaaacacgagatcacctggggcgaacccacattgcatgacggcaaggtcgtgcgcgagggcaccgcctccggcgagatccagggccagaaatggcaggccaccctgaccgccgaacgcgacaccgaccacacgggcctcacgcaggccgtcgccgcggcccgccaggcatacgaccagggtgccggcgaatacaccgccgcgagcctcgagaacctggccgacgcgatagaacaggccgacgagctcgaccggaccggcgcgaccgacgaggccatggacgcgatgcgcgaccggctcgccgaagccgtcggcaacctggacacgatcacctggaagacggacggcacgacgctctcccacgagaagggccagggctacgacggcaaggccccggacacggccgacgccgcgcccggcgacaccgtggcgctggcctcgaacgacccgaccttgggcaaactcggatccatcaccatcggccgcgtccagaatgacgatccggccacgctgacggacgaggacctgggcgtggcccgcgccaccggcaccgcccactacgaggggatcacgccgaacgggaaccgcccggccacctggagccaggactactcgtacacgctcggcaaacgcgtcgaggccaccggccccgacggccacgacatcggattcatcgccggcagcggctatctgtccgccaccgtcaccgcaagcctcgaccaggcgaaccaacccaaggacgccgacgtgaccatcgacggccggaaagcgcaggtcacctggagcggccaggtccacaccaccacgaccgacaccaccaccacgtacacccgccagggacgcgtcgagggcgacgtcaaggtcgcgggcaccgaccggacccagcattggatcgtctacgtcagcgcctcgcgcaccgaaggccacgtcgccggcctgagcctgatccaacgcaagccggatggcaccaccagccgacacgacatcagcggcttcgacccgtcgaggcacgaatacgcgatcaccatgcccgccgacgccgtcgccgaccagtacaccctcggccacaccagcgccgccggcgacaaggccgacgtcagcgagggcgaccccgtcgccccgaccctcggcgcgaacgcatcccgcatcctcaagaccaccctgaacggcgtgacctacaccgtgaccgtggacttcgagaaggccaagcccacgccctccaacccgcacgcacgactgaacggcctgtacgtggacctcacgggcaaggcggggaagggcgcgctgatcgacggctgggacccggacgtgctcgactacaccatccgcatcggcgcgaacgaccccggcgcgtacatcctgcccgaggccccgtccggggtgagcgtcaaggccggcgacgtgacccgcgccggctacgccaccacccaatactggaccacgcgctcggccgacggccagtcgcgcacgtacagcgtgaccgtcgtccgggaccacgggacgccgaccgccgaggaggcgttcacgcccggagccgccaaggacaccgacgggcagacgcccgccgcaagccgcgacgacaccacgctcgtgagtcacggctacctcctggacggcgaataccacgccgtgaaagccacggactacacgatccccgagggcggcacgttcgcctacgcgagcaagcagggccagattgtgcaggtctccgaatcaaaggtcaggggcatgagctggaggtacacgctcaacatcctcgccccggacggcgtgaccctcgccaaccccgctcccgcattcaccgtcacctacctcacccgcgcgacgcacgaggccgccatcacgtccatcatcgtggacggcagggccatcgacggcttcgacccgtcgaagcacgagtacacggcgcaggtcgacaacatcgaccactggaccgcatccgccgacttcgacaagtcgaccggcatgggcgtcaccatccacaaggaccacgacaaggccaccatcaccgccaccagcgccgacggcctcaccaagtccacgtacacgctcaaggtctccgagaagcccctgacgctcaaccgcgccggcatcgacggcgcgaccgtggagggactcgccagcacgggcgcggacacggcaagcatgatcagtgtcgtcgccgtgctcctcgccgccggcgtcgcatgcctggcggcgggcctgacccgcaggctgcaccgcggcaaacgcgacgacgccccgtccgacgacgggaccggcgtccaggacgccgaataggcggcctcccgttcgccgcaggggtcccggccgacgcccaaccgcgccggccgggacccctcgcttttgtccaaaccgggacgcgggacacggccgtaccgtgggcatgtcatcggaaaacctctagtcgaaaggaaccatcatgtccgagacaatcaccctcgccgcgggatccagcagcgtggtcaccagcgcgttgcagctgttcagccagttcgccatcatcggcggcggcctgtgggccgtgtggggcgtcatcaccctcgcgggcggcctgaaggaccagaacggccccgccacccagtcgggcgtctggcaggtcgtcggcggcggcctgatcatcgccgccgcggccctgttctccaacatcgccctgtagacgggaggccacgcatggtcgatttcatcgtcggcatcctcaactcgatagggtccggcgtcggcgacgacctcgtggccgacctgctgaagacccccgccgaatacaacgcgggcatgtaccagctgagcctgaccatcgcccgctcggccgtcaagcccatcgccagcacgatcctcgccatcctgtgcgtcctcgaactcgccagggtcagcacccgtgccgacggcgaccgcgaactgggcgtcaagctcgtcgccatggcgatgttcaagctcgtgctcgtgttcaccgccgcccagcacagcgagctcatgctcaaggccatcgacgagattggcgagggcgtgatgggcggcatccattcggccgcccccaccacgggatccgcgtcgggcctcggcctgggcgacagcatgcgcgacgccatcgactccgccggcacgttcggacagatcccgtgcctgatcctgctgatcatcccgttcctcgtctccaagggcgcgaccatcgtcgtcaccgtcgtgatcctcctgcggttcgtgcagatctacatgctcacggcgttcaacccgctgccgatcgcgttcatcgcccaggaggagacccgccagtggggcgtcaactacttcaagcagtacgcgtcgctggtgttccagtgcgccaccctgtatctcgcgatactcatgtaccgcacgttcgtgggcggcacgttgaacccgagcaagtacaaggacggcgacagcctctccggctgggtgctcgacaacttcaccggcctgctcctggcgagcgtcatgctcatcggcatcgtcatggcggccaattccgtcgccaagaagctcttcggcggcgaataaaggaaaggaaccatcatggcgttgcagatgcccgtctacagggagctgaccaccatcgaaagcaaggtgttcatggggatgagctggcggcagtgcctcgccgccgtcatcctcgtcatcgtgtgcgggggagggtacgtcggcctgtggctcggcctgggcgtcgaccccaacctcgccatgtacctgatcttcccgcccggcctgcccatcgccgtatgggggtgggtgaggcccaaggggctcatgcccgagaaatacctgaaatacatcctgcgccactacacgcagcgcgaggtctacctgctcgacggaccgggcaggccctgccgcgccggcgcgaaaccaacgatcaaggaaaggtgagcaattgttcggcaagaagaagacccgcgacccggccgcggccgaggccagggccaaggagcgcaggaggaaggcgacgcacctgccgaagggcgtcaaacagctcatcggctacgacgcgatgctgcgcaacgggatcgccagcctgggcgacgaccggtggagcgccaccatcctcttccatgacatcaactaccagctgagcccggaatcccaccagatggagatcatcgaccggtgggccaagctcatcaacagcttcgaggccggccagagcgtgcagatcgcctcctacacgcgttcgcgcggcgtgcgcgagatcctctccgacgtgatgatggacgagaggggcgacagcctcgaccactaccggctcgactacaaccggctcgcccagggcaagctcgaatccgtcagccgcgacaccagcaccgtgaagaccctgaccgtcacggtccaagagagcgacgagcaggccgccgtcgcgagcctgaacgccttgtgcaacagcctcgtcagccagatgcgctccatcgacgcgtgcaaggccacccggctcgaccgagagcaccgtctgcgcctcatggccgaggtgctccgccccggcgaggagttccggttcagcgaacgccgtttcgagcacgcgcccggcaaacccgacacgaaggacctcgtatgcccgtggagcatcgacgcgcgcaaccccatccagctggacgtcgaatcattggagtcgaggttcctgcaccgcaccatgtgggtgtccggcctgccgcccgaactgagcgaccagctggtcaacgacctgaccggcctgcgcgcccgcgtcgacgtgagcatccacctcgcgcccatggaccgcggcgagagcatgacgctcgtgcgccgcaagaacgccgagatcaagatgcaggtcatggaccagcgccgcaagaaccgcaagcagggcctcgaccccgacgacctgcccgacgacctcgccgaccagcaggagcagctcggacaactgcgcgacgagctgcgcaccaccaaccagaggctcgtggactcgatcatcgtgatcggagtgtccgccgcgagccaggaggaattggaggtcgcgtgcaggaacgtgaaggccaaggtcaacgcccagtcgtgcacggccgagagcctcaagttcatgcagatggagggactgaccgccgaactgcccctgggcaacaacccgctgcccatgaaacgcaccctgaccacgaattccgccgccatcctcatcccgttcaccactcaggaggtgttcgaaccccacggcctgttctacggcagcaacgcccgctccggcaacccgatcctcgcggaccggcgcagccacatgaactccaacgggttcgtgctcggcacgtccggcggcggcaagtcattcaccgtcaagcaggagatcgccggcatgttcctcaacagggacgacgaggtcatcgtcatcgacccggaacgcgaatacctcgccctcgcggccgcgttcggcgggcagatcatccagatcagcgccggcaccggcacgcgcgtcaacccgatggacatcgtcctggacgacgacgcggcctccgaccccgtcaaggacaagaccaacaacgtggtctccatggtcggcgcgctcatcggcggcatcgacgggctcgacccgctccagaagggactcgtcgaccagtgcgtcagcaacctgtacacgcgctaccgcaaccagggcggcggcgtcacccagcccacattgcaggacctgcacgacgagctccaggactgcggcaacgacgagggccggtacctcgccgacgcgctcaacccgtacatcaccggctccatgagcggcttcaacggtcagaccaacgtcgacctttccaaccggttcaccgtgttcgacgtgtccggcctgtccggcgagctccgcacgttcggcatgatggtcgtcatcgaccaggtttggaaccgcgtgatccgcaacaaggcggccggccggcgcacctggctgtacgtcgacgaattccaccggttcttctccaaccagtactccgccgcccagttcaaggacatctacaagcgcgcccgcaaatacggcctcggcgtcaccggcatcacccagaacgtcgaggagatcctcgacctccaggacgcgcgcgagatgctgtccaactccgacttcctcatgctcctgagccagaacagcaccgacgcggacgccctgtgcgagctgctgaacctgagcgaggagcagcgccagtacttcaccggcgtgctgcccggccagggcctgatgaagatcggcagcgccttcgtcccgttcgacgggcgcatcccgtcgggcggcgacctctaccggctgtactccaccagcttccaggaacaggaaggaaagtagcgcatcatgagccaggcccatgcccgccatgcgggcgcacgctccgcctaccgggccacgcgccgcgtcgacacggccggcgcgtggcggacgtcgaaccgccgccgaccacaggcgtcggacacgcggcacgggtatgagccgtccccggcccccatggccgcataccggtcggagtacacccgacgccatccgcaacggcggcaggcccgcgcgtcatacggcggcgcgggacagtaccaccgccatcggcggtacgccgtccgcacgcaatcgcatgccgcgacaaccccggtcgaccggcagcggcgcgaccacacgccgagccgataccgggtccccggcgaccggacccgcgtgccgactgcccggacgtccgcgcgccacgccgcatacgcccggaccggaagcccctaccatctgcacggcggattcgtgcgccgcaccgtctcgcggcgcacgaatcccgtccgccccacaggagccggacggcaggtcgggaccggtgcgacgggcggtaggagggtcttccgaggcaccgcgccgacacgatacgccgcggcccgcgcccatgccgtccccgcgcagccggccaaggtccgcgtccgccgcgggaccggcctgcgcgaccggctgggccacgacaccaccatgatggcgtcgaacgccgcgcaggccggcatcgaccgggccgacatcgccgacaccatgggccacaccgccatggaactcaccgccaggacctcaatgtccgccggtgccacggccgcgcacgccgtcggccatgtggccggacgggcccgcgccgtcatgacccgccccaaacgggccatggtcgccgcatacaaggccgaggaaaagaccgcgagacagctggacagggcgctgcggaaaggcaaaccgggcgcggccagggccaaacgaatcgccgacgcgaggaagcacgccggcaagcctctcgtattatccgacgcgaagcccagcgcccgcatcggcggattcgccgccaagggcaaggcgagccgcatgatcggcaagcatgtcggcggcggcctgaaaaaggcaggcaggggcgtcaaacgcatcggaaccaccggcctggactggatggacgaggcgtccgcacggctcaccgccgcggacgacgaccccgcgtctcagctgggcgccgccacacgcgacctgaccttcaaggccgcccgcaagggcgtcaaaggcgtcaactcgtccgcccggttcatctggcgccaccgccgcgcgccggccaaggccgtccgcggggccaaggcagtcgggaccacgggcgcgcgcgtggcccgcgctgccgtgaacctcgtgcgcgccgccgcgtcccgcatcgccgccggcgccgcctccatcagccttcccatcgttccggtcatcgcggcgctgatcgccgtgctcggcgtgctcctggccgtcatgggcgcgttcctgggctccagcgccagcgagtccaccggcgtcgcgaacgtgcccgccgagtacgaggccgacgtgatccgcgccggatccatctgccaggtcgtcacgccgagcatcatcgccgcgcagatcgaacaggaatccaactggaacccgaaggccggatcgggcgccggcgcgcagggcatcgcccagttcatgccgggcacatgggccgcccacggactggatggcgacggcgacggcaaggccgacatctggaacccgcacgacgcgatctggagccagggcaactacatgtgcgacctcgcctcgcaggtcgagacggccaagaaatccggaagactggccggcgacacgctccagctgaccctcgccgcctacaacgccggcctcggcaacgtcctgaaatacggcaccataccgcccttcaccgagaccacgaactacgtgaagcggatcatcgacctggcccgaagcaaatacacctcgtcgggcggcgacgactcgggggcgaccgtcggcacattgagcccgaagctcgtcatgagcgacagctggcacgtgaacatcgaggccatgggcttgcactacgcgcgcttccccgactacgacacctaccagtgcacctggtgggccgcgatgcgacgcaaccagataggcaagcccgtcgacgcgcacatgggcaacggcgcgcaatggaacgacaccgccgcccgcctcggctacaaggtgggacgatccccgaaacccggcgacgtgatgtgcttcgaggccggcgtgctcggagccgacggatactacggccacgtcgcggtcgtcgaacaggtcaactccgacggctcgatcctcatcagccaatccggcaccggctggatggccgtcgtcacccagaccatcagctccgcgcagctcaaggccaacgccggaggagtcagcttcatccactaggaaggaaaagaaatggacgagcacaaaaggaacatcctcatcatcgcggccacgaccgcggccatcatcctcctcgccggcgtgaacatcgcccacatcctcgcgacgtccacgccgcggacgagcgaagcggaggagacgacatccacggccgccatcggcggcacggggacctccgcccccaagaggaagaccgccgtggaacaccagaagccattggaggtgtgcgagaggctcgccccgaaggccgccgccgcatacacctccaagggcgaagaccgcgaccggctcgtcaagcggtacttcacggccgacgcgcagggcctgaacatccccaccgaccggatcgccgaacaacctgacgtgcaggcgtccggcggcatgaacgccggcaccgacacgaccgcgacatgcagcgtatggaccgggctcgaatcgccatggaccctcacataccagtggaccgccgacaagggctggaaatgcaccggaatcagcggtccactcgaaggcgcgtacacgacactcggggacaagaccccggatgagaagggcgagggcgaggaatgaggaccgacaggaagacgggcgagccgatcctcagccccaggctctcggccgaccagctgcacgccatggccaacgaccccggctggcgtccatggatgcgcctgatcgccgaacatccaaacgcgtggcccggactcgttgactggtggcgcaccgcgcaggagcagggcttcgacacggccggtgccgcgccggaaccgcccgaatccatgcgcggccgccgccgcgtcgccataccggccgctccgctgccgccggagaacggggccgagccggaagcggccgaccccgtcggatccaccgacggatgggaatccgtgcccctcgcatcggaggagggtctcgccgccgatccggcaccgtccccgcccgagccggaagaggacgccgggcggcaatccccggaccccgaccgtcgcgaggagccggaaccggagaccatgcgggaggctctggacgacgccgacgacgacttcgccgcgctcgaacaggtcgccgacaccgagccgtccaccatggacatcccgcccctgccggaaccggcggaaaccgaaccaccgatggacgacggaacggacaccgaccccttcgccgacgtcagggtgcgccgcgcgatcccatggaaggccatcggcatcaccgtcgccgcacttctcgccgtcggactcatggccggcgggggagtcatgctcgcccgccaccacggcgaggagacggcccggcggacgctcgcccaggcgacggccgactgccggcaggcgcacgacacggccggccggcagcgggacgcattggaacaggcggtggaaaaggcccgccggctcacatccgccacaggcaaggaccaggtcacggaccaatccaccctcgacgccctcgacaaactcgccggcaaggccatcccgaagcttccctcatgccccgcctcggacccggataccggccgcgtctccacggccggcaaggaatacaaacgccgcacccaggcgctgcgcgacgcgatggacaaggtgaaccggtccatactcgacaaaaccgtgaaggacgcgaaaaaactccacgacgaatccgctgggaaggtcgccgacgagagcacccgcacggacctcgccaaggcgatggaaagccgcgacgcggacgccatccgcaaagccatggacaaggtgaaccggtccatcaaggccaagcaggacgacgacaaagccaaggaagaagaggcccaggcacaggccgcgcagcagcaggcgcggcaatcccagcagtccgtgccgtccacgggtggccagaccacgcgccgcagcggcggctccacgtatggcggcaccaccggccggacctacgggggaaccaccggaagaaccaccacgcccgcgccatcggccccatcgacgccatccacaccgaccccgcagcctgcgccgtcgaccccgtcgaagccatcaggcaccgacggcgcgaccgtcggctgagaacgaaagaataggtgatggacgggcttcctttgacggatgctccctgatccgcgtatcattgtttccgagccattgtagaccgctcaatcgtcgcgttggcgatatttatgcggctaaacgcagtcggctcgtatcatggctgcgtttagccgttttccgtttttgatcgcggttatacggtttcgtcgtgaacggtgatggatgacaggagcttcatcgaaactggttcggggacgcgctctttcatgaacgtcagccaatgcgaggccgtccgcaggggaatgccgaagacttcatgctccctccggcagacggacaacgcgaggttacgcacccagtcggcgacctcctcgcatgttggctgcactgactcatgcatgggtgctctcaaccgctggcacagctcctccaagcgtgcgcggtgttcgggatcatcaagctgaatctaacgggtgtgttgtactttcaattagataacggggagaggataacactgaggtctggggatatcattggacataggataaggtaatgaatcgagtttgtttcggtggagcggaggaactatttatggaacgtataaatgtcgatgtatcggatttatgtctctgggagacgaacccaagagttgaaccatcaatcgaccagatggatgaactcaataaaatctataacttcagcgcacagtctcaatcgacatcaaagcggcaattgatgaatcttgcatcgtcaatagcagagaatggctatcagaacgatgttgagccgatccttgcgacaagggccggcgacaagtatgtgattcacgatgcgaataggagattgtctgcaatcaaattgctgcaaaacccagattgttaccgtgaacttcttgatgaccgagattacaagagattgaagaaccttgttgcggaatatccgcagaacattccaagcagtctggacatcgttgttttcggcgacgatgaacaggataagctgagggaaatcctcaatcgaaagcacaacggccctcaggacggtgccggcacgattccatggagcactgaggccaaagcccgcttttcaggaaggcagacgttttcggacaagcttgaaacgccgttccagaatcaatttggagagtccttgacaagctatctcggaggctcgaacgctacgaccagcacgagaagggttttcaactcggctccggtcaaggaatatcttgatatcaagaatccggataaaataacccccgagcaactggacaaagtcaaagaacttgctgatgagattaagggatattgtcaagagaacggcatccttatttcacgcctcaagaaagatgccatcaagcaggacataatcattcctcttcaggaaaagggccaaggaacggtcaggtcgccaagacttgccacgaaacgcctcaatcatgatttcgcccgcaagttcgccacaaatcgagaccggcaccttggtgcgatgtacaacaatccggaatggatgaccgacgcgccggaattcgaagacacgaactttatgctttccgctttgaacgcatatggggtactggaggacgacagcaccaaaagatgggcgaaagcattcttgattgcgccggcgatacgtgtgatcttcgaactgtcccttcttgcattggacaaatcctgcgatgagattcatcttccccaaaaaggggtcagcgcaaaacataaagagaatgtctcatatgtccatagcctgtttaaaaacaacaaattccaagactatctgcaggccgggaggattgtattcgacaccttccaagaggctcataatgtaatcgaaaataccgatttcggcgagtccgttgaatactcatcgcttgggtcgcacaagtctatgaaggattacgacatagataccatcatgaggctgtcgaatgatgcggtattgtttgctatgctctgtcagcaatatgtgcagttcaaaaaacagggtgtatgactcgaacgaactggccaaaatgggaatcttctaatatcattcatgtttatggtgcaaagcaagctgacaaacggttccaataccccgttgcgataccccggcgggaaaggcaaaatcacacgtttcgtggcaaacgtgttggagactaaccatataaccggaacctatatcgagccttttgcaggcggagcaggcgtcgctatcaatcttttgttgtcgggtcgtgtagatgcagttattatcaacgaccttgatgacggcgtatattcgttttggtattctctcgtcaacgaacccgaatatctactacgtgaaatcgaccgcgtccccttcgactattcggatgaaaagcccacggctcaatcttcgaagtacttggaatactggaaggctatcaggaaaagatacgatttcaaccattattcggatattcgacggaaaggattcgacttcttcatgcttaatcgcatgaacgtaagtggcatcatcaaaggtgggccgataggaggtgccgcccaagacgggaaatacaacatttcttctcgatttaacaaaagcacactcaagaagaggatagagcgaatagcagcggaaaaagagagaatcactgttagcaacctagaggccagccatttcttcaaattgctttctgatggcaaattctgcgatatgaagaacagtctcatatttgcggatcctccttactatgtgcagggacggaatctttataattcatatgcaaccgcaaccatccactctctggtcgcgaagcgcctcgtcgctgaaccggattggaactggatactcacttatgacaaagcgcctcaaatatgcaggttgtattccgataagaacgttaaacaatatgaatatcagatagcttattcagcgaataaaagaggatactattctgaatacatgttcgcatcgagaaagatgaccatgcaatcatatgccaacgtgactcttagtcaaataagcgacgagggtaacaacaccttgtcataattatgtggatgcttcaggtttgtccattgtcggcatctaactcgtatccgtcgcatgatatcgcgctgtacaaggcgacggacggcaaggtagcggacgacaagacccgagagaccctgttgaaggcggtcaaggcccgtgacgcggaggcgatcgcgaaagccgtgaaagaggtcaacgaatcgaaaacggtgaaggccaaggccgaacacattgtagaccgctcaatcgtcgcgttggcgacgtttgcacggctaaacagtcggctcgtatcgttggctgcgtttagccgtcttcttcgtttggaccgtcgcggtcatacattctgacaatcgagaacggtgatgggcgttgggagcttcatggaaactgattcggggacgcgctctttcatgagcgtcagccaatgtgaggccgtccgcagagggataccgaagacttccgccagacgtttcgttgcggggcctttgttgagctgggcgaccgaatagactcgtgaggcccatttcagggtgtcgggcgtggggccttgcttgcggagcgcggagaaatcaacgctgctcagcgcgtcatgttcccaatccggcagtgggccgaagatattggtcccgccgtccgtgatctcataggaccacagtgggggatggtaggcacggatgatctgctcgatgggcagccgtgcgatgtctctgatcttgagttcgcgcgtggtgccgatctcgcagttccgcagcacgatgcgctgctcttcctcgctgtaccccatgtgcaggcggatgtcgtatttcccggtgcggtcctccattgcgcggatgcagtagtcggatctgacggcgattcccggggcgatggagacgaatgatgttaggtccatacggtccaaatccgtgaagacgatgaatttccatttgtctacctctaggacgtaggtcgagtctttgccggagccgggcttcatgccgctgccttccatccttcggagtgcttgagtgtggatttcggcttggcgatggtcgttcccggccatgccttgcggctgaggaacgggtggagccctcgcaggttgtagatgcatttgtcgttgtccaattgcgcgagctcgtcgggcgtgaggagttcgcgtccggtgcgctggtagttgatcgtgtggctgccggacacgcccttcgagtcgctggtggtgcgtaggtcgatggtctccttgccgagcagcttgctgagccattcggtggtggactgctcgttgccgccgaggaagagcacgctgtcgcagttgccgacgatggtctcccacgagtccttgtacatggtcttcagctgggcgatggtctggaggatgatgctgacgctgaccttgcgcgagcggatcgtggcgacgagcttgtcgaagttcgggatgcgtcccacgttggcgaactcgtcgaggaagcagtgcaatggcgtggcgaggcattcgccggggtaggcgcggcagcggcggatgatgctgtcgaaaaggcattggtagaagatcgcggccaggaagttgaaggtagggtcctcgtcgggcagggcgaggaatatggccgtctttttgttgggatgcctgtatccgccctcgtcctggtatcctcctatccggtcgatgccgaggttgtcgtcggagaggatctcgcggaccgggccgacggtcaatggggcgagacgcacgccgaggctgatgatgatgcctttcttggtctctcccgcgccctgggtgaagggccggtactggcgggcggcgaacttcagaccctgggcgagccgccatgcctcccgcaggtccgggtcgtcgtggtccgcgcccgcgcgttcccattcggcgcgggtctcctcatagatctccgtggctgtccgtgcgacggcgtcgacctggctttccttggtctcgtcctgttcgctggcctcgagcaggtctcgcatgtcggcgaccgcgttgagggtctggccggcgtcgatgtgcaggcagtccttgaggatgtcgtcgggcaggtagtagacgaacgcggtgagcgcggtcaggaggctgcgttccgatttggtccagaagtcgtcggtctggtgctccttgggtgtggagccgttggtgttgtccatgatgttggtgaccaggcgcatgatcgccacgtcgggtttcgtggggtcgatgtagcgcatggggttgaatttcgtctcgctggtcaggtccaccaggtcgagctgtttgaccgtgtagcccatcttctccagccttccgccggtcttcgcgtagagttcgcccttcgggtcggtgcaggcgtagttcatgctgcctttgaggatgttggggatgacatgtgtggcggtcttgcctgaaccggatccgccgatcacggtggtgttgatgtttcgtcgtgtggcctgcgtgtcgacgctcaggccctctgtggccgtcatctggaggttctgcctggtgtcgctgtcggtgtatggggccatctcccggctggtggaccagcgtgctgagccgtattcctcgccgtctcgccagttgcgctggctcatgctccaccggtagaggtggaacaggccgaccgcgcacgcgccgcccagtccgcacaggaggctggtccgatcgaatcccaggtcggtcggatgctggagcatggtcgtcatatcgtccatgatttgttccaggctttcgtcggccgcgatgccggcttggatgcgggaggccgcaagatcggcgagccagaatcccgcgaggatggtcagcgtcttgatgacgattcctcttattcgttccatgagtgttccttttctactgttttctttcggcgaggttctcgttgagtttggtcttgaaccggtcgtacagcgtcttcctgctggtgatcctcgcgccgtccgggtctgttccgttctcggcatcgttttcggcggccgtttccgcgtcccgtgtgccgactgcctggggtgagagcgccgtgatgatggtcatgccggccgacgtggcgtcgatgctgaacggccgtcctccggccatgagcgtggacatgagccggccgacatggctgtggatgtcgatccattcgccggtatcggtcttgtccggcttggcggcgctgacggtggtccgtgtcattgtttctccggctcgtcgtggctggggtcgaacgcgaggcttgtggcctcgatgtcgatgccggagccctcgtcgccggcggtgcctttgaccatgaggcgggtccccttgcgcgcgttgcggctgatgttctccgaatgctccgcgctacgggcccggatggtgatctttcgcccgttgccgtccggatcggccaaggtttcgagcagccagtcgtcctgtacgcgcagtggaagcggatccctgatgagcgtgccctcgaaccagatgacgggctccagggtggggtgttcttccgttgccatatgttcctcctataaggtgaggggcggcgtgcgaagccgcgcgccgcccccggtggatgtgtggggctacagtcccagtccgtggcgtttgggcgcgggctgctcccgcgcgggtgccggccgttccggttcctgccggtcgaggcctcggtcccgttccggcgagggctcgtccagctggtcgagctggcggagtgtccaggtggacagttcgccgtcgtatgacgcgcgggcgaggatctcgtcgcggttgtcccagacgagctggtcggcctgctgttgggtgacgcccgtccagtcgccctgcgcgttgatgcgcatgagctggtccgtccgcgggttccatccgcccatttcgcgtttctccgcgatgtccgctgcggtgagaccgtcgccggcgagctggaccgccttgtcggacgggtaggtgaggtaggcggcgatgtcgttctcggggtcgtgcgcgttgacctcgcccacgatgccgtgcaggatgccgaccgcggtcgggtcgggggagtcgtatcgttccaggatgtggctcgcgcgcaggcaggatgccttgcggtgctgctcgtagagcacggccggatcctcatcgaccttcgtcacgacgcatccggcgtcctccctcgccttcatcgcctggtcgcggtcgaaggcggtgctcaggtatgcgatgtgccggtcggggtctccgggcttccgccaccggtaggcgtattcctccggcggctggtgcgcggccagatggctcggttcggatgtgtgggccttgcggaggccgcccgcgcgttcccattcggacaccgccttggcgagtcttttcccggcgtcgggttcggcggggtcgatgacggtgtgttcgcggtcggccatgtcgttgtcgtcgtattgccattccgcctgtgggcggttggcgtaggtcacctcgatccgtccggccagccggtccgtgtccttccatgcggggttgtcgtggaagtcgatctgcacggcgcggccgtccgtgagccgggcttcgaggtagtggcccatggcgttgccgccctgggtgacgccgtcgatgtcggggtcccgttcgagcagtcgtccgatgctttcccgtgtcaatggcatgcgtgcgctcctttccgtttttgtggtttcccggtctctactttccgtctcccggggctcgtcgggtttggacgtcagccgttcgagttcggcctgtttttgccggtattcgtcctcgtgggcgaatggttcggccagcgtctcccgtgcggcggcgagttccctttcggcgtccgccagccggtccgtgagcttgccggggtcggtggccatgttcttgatgatccggtcgagctggctgacgatgctggatggtccggtcaggtaggggccgggcatctccgtgccggattcgtgctcgtggacggccttgacggccagggtgatccttccggtgacggccgcgcggcgtgcgatgacgggcaggccgtcgtattcggctatcgtgtccccgtcgtgcgcctggtgggcggcctggtggaggagtctgcatgcggtctgccggtcgccgaccggttggccgttgatggtcatgccctcccatcggccgttcatgcgcgcggtctggtggatgctcagggccttggaggcgagcggcttgtcgtcggtcttctcgcggatcgactggcgcagaagttcgacgcgtggctggagctgctggccgatgtccctgcgggtgtcggccttctgttgcgcccatgagacgcgcaggagcttcagctggttgatctcgttctccaatgtcatgcggcgttggatgtcggggtctccggtggccagcgccttgatattggcgagggtcaccacgtcggcgtcgaggtccgcggcctcgcgggctgggctcttcgagctcatgagctggctgatgaacctttgcttgcgttccacggtctggtagctgtacgcgtcgaacgtgccttcggtcacgtaccggtagtcgcgcacgtggtcgtacgtgttgccctggcgttggatgcggccgagacgctgttccaggtcggcgggacgccaggggcagtcgaggtcgtggatcgcggcgagccgttcctgcacgttggtgccggttccgagcttctgggtgcttcccatcagcacgcggatctcgccggaacggactttggcgaacagctgctcgcgtttggaggggttgtcgcccgcgtcgtgcacgaacgcgatctgctcggccggcacgcccaattgaatgaggcggtccttgaggtcctggtaggcgttccatccgcccgacgcgggcgtgctcgagtcgcagaagacgagctgcgttcccaggcgcggcgtctcctcatgccagatccgggcgacgttctcggcgcatgcctggatcttgccgttctccaacggccggtcgtcctcgtgtcccttgaggagcttggggtcgagggcgatcttgcgtccgtcgcccgtgatccgcaggaggttgtcgatctcaggcggcacgtcgccgtcgcgcacgcggtccgccctgtcggacagttcctccatctcctccttctgccggtcggtgatgggcactgggacgggcacctgctccagttcgggcagtggcagctggatgtcgtcgttggtgatcatgtcggtgaactgcttcaccgcgttcatcagttcgggcaggttctggaaccgcgcgaacctctgcttgacctggaagccgttgccctcgggtttcagttccacggtgggcacgacctggccgtaggcgccagcccatgcggcgaacgtgtcgagaccctgggccttgagggttccgggcgcgaggtagcgctgcatgttgtacagctcgctcatgctgttggataccggcgtgccggtcatgaacgcgatgttgccgccgtgtccggcctcgcgcagccattcgcatttgtcgagcaggtcctcgcatttcgcggcggacgacagttgcatgcccaggtccgcggaggcgacgggcacgccgaagttcttgaagtggtgggcctcgtcgacgatgagcatgtccacgcccagcgattcgaactcgatgcccgccaatgccttgtcgtcgcgggattccttgccgtcgcgcaggcgctgcatggcggtctcggcgcttttgcgcgccgcctccagccgtttgacggtcgggtccttgtcgcccctggccttggcggcggcctcgacggcctgggcgaactcgtcgactcgggcgcgcatgttgcgcagccggcgttccttgctgacgtgcagctggctgaaccggctttccggcacgatcgccgcgtcccagtcgccggtggcgacccgtccccagaaccggcgcaccgattcgggattgcgttgcgcgtccttgtccatgacgaggatccggccggccgggtagagcttgagcacgtcgccggcccactggtccacgaggtggttggggaccacgagcatcggcttggacgccttgccgaggcgtttcgcctcgtgggagagggcgacgccctcgaacgtcttgccggctccgacgacgtgggcgatgagggtgccctcgtcgctgcgcagggcgcgggccaccgcgtccttctgatgcggacgcagggcgacgccgtgggcgatgccgggcgtggtcaggtaggatccgtcgacgtggcgggggcgcatgctgttgaatctgcggttgtacagggcggtgagcctctgcgcgcgggcggggtccttgaacacccattggttccacgtgtcgcggatcgcgttggccttctcgatggcggccatcgtggccttctggtccttgacgcgtttgggtttgccggccggcgtggtctccgtgggggagtccttggtgacggtgatctgcgcgttgttcaggcacgcctccagcagttggaacgggttgcggtcctcggtgccgtacgtcctcgcggccttgtagtcgatgtcgccgcctcccgagtagccgacgcgccattgtccgagctgggggatccagtcgatcgagtattgggcgagcttgccgggcgtgagcccgtggccgtggacgttgaacgtctccatcatgaagtcgtggacgtccctggcggggatccacggggctcccagcggcgccttgatctgctcggcctccaatggggtgggctgcacgcgttccagcaagccggccacgtgttcgagccgttccgcgtccgcctggtcggcgtgcgcggcctcggcgcgctccggctgcttacgccattgtccgagctgctcctcgcggcgcgctcggaactcccggtagtcgtcggggcgcgcgtcgatggcgcgtggcgggacgccgtaggcgttgtgctcccgcgcctggcgcagtccgtctggcagttcgcgggcgatgccccagatccattcgctgagggacatgtcggtggcgagccgttcggcgagccgtgtgggctcgtcggtgccgggcatgagagtgcgtgccatcgcgccgatggtcgtgtccgtccagacgggccggccgttcgcgtcgtcggcgcgccagctttcgaacaggttggagaggatcgcggtcttgtcggcgatgtcgagccggtcggtgtgggcgatcttgtggacgaagagggcgaggtccgtgacgggcatgtcccgggcggcgaggatcggcgcgtagttctgcggcgcgtcgccgtcgcgccatgtccagcacaatgcgtcccacagcgggctggtgccgtgcgattggtgccatgccggcgcgtgccacggtttcctctcgccggtgtcggatcgttcgagggtgacgcgcgcatgctgttcgggaagttcctccaccgcccgccaggcgagggcgaggacgagttccgggttgcggctccagcccatggtccatgcgttccgtccggcgatgcgttcgatgaccggtgccggatccctgtaggattcggcggagtacgggtccttgaggctgcgccacacgtccgcgcccgcctcgctgatccattcgcccgcccgctccgtggcgggcatgtcctccggcgtcgcgtaggtggatgccgtgaactcggtcatggcctcggtgccggcgcggcgcttcagacggtcggccatggccgtgacgcggtcgagtttcgtgcccacgtcgccggtgaggtagtcctcggcgggcatgaccgtgccggtataggggtcgcgtatgatgcggtcgcccaggccggcctcggcctcctcgacggtggtgtcggcgaggcgcgcgatgagttccaggtcgaccctgccggcgcggtcgaggctgatgttcagcgcgtcgtccaggctgtccgcatggtcgggcatgggcggcacggggctgatggtccgttgcgagaggcatttcgccttgccgacgaaccttcctttttcgtcggtctcttccaacgccatgacgaggtggcggccggattcctcgctgtcgtaggcgcgccggttggcgcggtcgttcaggcgtccgaactcgccggtgaaccggtcgtatgcctggtcgagttccttgcgtttggtctccacggcggggtcgtccacgtgggcggggtcgagttcgaggcgttggagttcgcgcgccaggtcgcgcaggcggatcatgccgcgcagtcggcgtgcctcgtcgccctggccgtgggcggcctcggtgacggtggcgccgtcgccgtaccagaccacgccgcgctggtcgaccgagtattcgaacggggtcacatggtccgggcggacgatgacctccgcgcgttcggccggttccatctcgcccagctgcaacggcggcctgccgtgggtgatctgcatggagagcagtgtccggagccgttcgccgatccgttccgtgtcgccctggaagacgacgtcgaagtcgccgccgaaccgtccgatcaccggtctgatgtcgcccaccgcgtgcgtgggcatgtcgttggcgaccgcctggttgacgttgacggtcacgtcctggtagccgggcacggcgatcggcgtggagtggatccatgcctcgtcgggcgtatggtcgagcgtccgttcgcgtctgcgcagcacgagcacgtcggtgacggcctcggtgccggcctggcgggcgaacgtcgaggacggcagacgcaccacgccgacgagctcggcttttctcgcgaggtcggcgcgcatggtctcggagcgtttgtcgagcgtgtacctgctggtcagcagcatcgcgacgccgccggggcgcagcgcgtccaccgagcgttcgatgaagtagtcgtgcagggggaggcgggatgtgccgccgtccgtggtccggtagtcgaggctgatgtcgcccgagtagggcacgttgccgatggcgaggtcgaacgatccctgttggatggtgcagtccgcgaggtccgcgttgaggatcgtggcgtccgggttcagcgcggcggcgatgcgtgcgctgatcgggtcgagttccacgcccgacacgtgcgccgcgacgtcgtcggggatgccggccatgaagttgccggtgccgcatccgggttccagtacctggatgggtgtggggccgatgcggagcgcgtcccacatggccttgaccacggggccgggcgtgtagtaggcggtcagtgtggaggcgcgggcctgcgtgtactcttccggggtgagggcctgttctatcgcgtcgcggatcgtccgccattcgggcttgtccgagaacgcgtccgcgcatccgccccagccggaatatccgcgtagtgtgtccatttgcttcgctgagggccggccgccgttgtctccgccgagtttcttgagtgtctggatggcggcgatgttcgcttcggcgcgttcgcgtggcgaacgcgcgcgctgcgcgtcgagggatgctagaagctctccacgacctcgtggatcgccatgctcatcgactccgactgggcctcgttcatcccgttgagccggtccaggtcggtcagctgtggtgccgccttcaggcagtccgtccggttgagcaggtgcctggactccattagctggtccatgatctgcgcctggcgttccctcgtgcgcgtctcgatgtcccgcagatgctcctcgagcacgttggccatcatcatctccctgaaccgctggggatggtgctccttgagccagatgagacgcatccgctggatgccgtggacgctgttcgtcgtgaacaccttgtacggcagtgcgtcctcggaatacaggttcggcagcgtctccttcaggcgttccagcttcctgctgttctcctcgtagcgcgccttgagctgcgggtcggtccatgtcatctcgtccatcgtcgttcctttcttcagtgttgttttccgtgccggaggattgtgtgaaacgttttaccacaggttgcggcatggtctcgccgggcgtggcggcgccgacgccgagcttgttctcggcggcgatccgcgcgtcccgccggccgagtccgcggagccggttctcccggtattcggccgccacggcggctatcgtctcgtcgtccgcgccgcgcgcgcggagccgttgcaccgcgacatggcccaccgttatctcgtatccgcgcacctgttcagctatcctgtcggcctgcctttgctcctcctcgagaaggctgaacaggtcgatctgctcgtattcggccgatgctgtccgctttgcgtataggcgttttctcgccatggtttgctcctttcttatagtgttttccgttggccgtggttccggtcgatgccgggtgccggcgtggctgtgttgagtccgtcgaggttctccctgagcctggtatggaaccggtcgagcgttgacttcaggtccgtgtgccgtcgttccggatcgtcgcggcgcgtcgtctccggcggttcggctttcgctcccgggtcggcggccggcgagccggcttcgtcgtggtcccgtccctgttccgtctccttggtcggttccgtttcccgtggcgtgcccgtcgcctccgcgtcctgttcgacggttggctgggtcggcgttttgtctctgtcctgcgtcggttcctgtgcgccggcgagttcctggatgaggagcccggcggcctgacggcgttgacggctggtccaccgtccctcgtccgctccggcggtccggtcgacgaggcggcgcgcccatttcaatgcgacggccggcttgtacgtgccggcgcgctggtattcggcgaaccggccctgcatgcgttcgatctgcggccaggattcctccacggtcttcgaggcgagtcccaccgatgccgtgtcgagcgactcctcggcgtcgcggttgcgtttctgcgcgtcgatgatcgcctggacgagcgtctgcgggtcgacctgcatggtgcggcgttccgtgccgcggccggtgaacagttcgaccggggtgccgggtctgaatctgaggttgacggcccgtccctcgttcttctgcttttggttctttccgctcatgaacatgtcggtggcccagccggtcaggtccttgccgtcgatggcggtgccgcgggggagtccgacgatcatcttcggccagtcgcgtccgtccttcgcgtgcaatgtataggtgtgtgcgagcctgttcgccacccacgcgttcggccagacctgttttgtcgtcgcggccgtccgagccggtgtctgtgtcgcggcggcggggtcggtggcctgcgctggttgttcctgctgggggagcgccggcgtcggtgagatggggcgcccctggaggatggatatggcggcttggtcggtgaactcgtcccagtccggggcgcgccggccgtcgttcaggtgcagcagcggcttctgctccagtcccggtttgagcagtccgctgcgcatgacgcggccggtcatgccctggacgacggggccgccgtcgcgttcgcgccagtactggtattcgtcccggtagacacggctttgggtgagcagttcgccgtcgctcatggtcttggcggggaaggattccctcatgtcctcgctgtggctgatgcaggtgacctgcatgctcaggtcgtcgtattgcaggtgcttgaagctcatcgcgtcgaacagtccctgctggtttcgatgccaggagaagaccatgaggtcgtatccgttgtcctccaggaagaacacgcaggggcgtggctcgtgctcgaccgcgttctgcatgaggctggcctggagcaggttggggtcgagccggcccgccgcggacgcggccacggcgagactggcgctccatcccatcgggagcggcctgcccgtcgtcggatccatcatgcggtactcgcccggcgtggtcacggtgtcccaccggtcgggatggcggtggttccactgttcgatgcccgcgagcatcgcgtccatcgggctttgcccgtccgccggtctgatggcgaaggattcggtggcgcgggtggtgtcgccggcgattgtgttccggtgaacgatggtttcgccaggaccgtagatcatgcccaccgagtcctcgccggccgtcctcgccgtgccggccgtccatatcgtgtcgccggacgaggcccacatggtcacgggccatggggtcgggtcgttggtcccgttgatggtgtcctggaagatcgcggcgcgtttcgtcgactgttcctgctggttcattgtggtttcctttcagcggcccttgcggggcgtgcggtccctgttctgggtgggtggcatgtgattcttctgttcggtgaggttctcgttgagccgggtcttgaaccgttcgagcagtgccttcttcgaccggatcggcttcggcttctgctctttgccgtccggcttgggagcgttggttctgtgctgcgtctgctgttgcgggtccttcgactgggtttcgtccggtgtgggttccggttggttttccggctccgttgccggcgtctcccggcttggctcggccgtccgcccgcgggtctgctcctgggtttgcgcgccctgtccgtagtcgtcgcgcaggatggtgtcgagctcgtcgcgcaatgtcgggtcggcggcggccttgccgatgatccggtccgcgaagtcgcggccggcctgctcgttccatgccgtgtcgcccatgagcctgtcccatgagagttcggggtggcgggcagcgaggctgttcgcggccatctccatgacctccggatccacgaagtcccatgcgatgcgctgcgtcggcatgggcttcgcctccggttcgacgggcgtatcccgcgccggggtttccggttcgcttcgggtctgttccgtcgtccgttcctgctgctccgtttgttgttcgacggtgaagtcttcgtcggcgacgtccaggcccatgttcctgaaagcgcgttgcacggcggctcggatgtggtcctcgtccctgccggcgaagtgcaggatgaactggccctggtcggtgcgttcgaggtgatagtcgatgccggcggtcttgaggctgcgttgcacctcgcgcatggtcgagtcgtcgagttgcagctcgtgcaggtcgccgtccttcttcctctgcaatcgcttctcggacatctcgccgctgtcgattttgtttttgacggtctcgccggcggcgtgcacgccggtcttggcgagcttcatgccggagcggagcagcgccatggccacgcctttgggaattctgagcatgagcctcgcgcctccggtgatgatggtctggacgacgttctggatcttctcctccgcctgttcctcgattggcattgcggtttcctttctgtttgttggatggtgtttcctgggacggttcagatggaccgtccacgcttgtgctgctgctgccgttcgcgctgttcggtctccgtctgctcgcggtcgcgggtcgtgtggatctcccgttcgatggcggacagctcgtcctcgtaccggtcgcacagggcctcgcggcgttccatctcgccgcgcgtctcggccacgaggtcggggtcgccctgttggatcgcgtcgtgcaatgcgatgacggcggactggagttcgtcgtgcgattcgcgtaccttcccgcgcagcagactgagtcccttggcggcgtcgccgcccgcgaggcgggtccatcggatcgccgcgttcagcgccttcgcctcgccggcgagccggtcgaggcggcgcgcctgtgcctggtaccagcgctgctgtgcggggctcaccccgtagcgcaagggcagccgttcgggcgtggtctgcggttcgagccggctcgtgggctcgccgaaccactggtagaggccggtcgtcggggtcttgccggcgtaccggttggacgggtcgaggatgatctggtcgcggtcgcggggaaggaacgcgcgcagcgtggagccgccgtcgtccacgagacgcttcgcgtcgaacgtgatcttcttcttccggtgggtgccgggcagccacacggtgaccgtcttcctggtctgtttggcgacgagtctgcggttgaacgtgatggggatgacgggcgtgtgcgcgagtccggccatgatgttcgtcatgtcgtacgcctggccgagtttctcgtcgcggaccttgaagccggtgtccttgagcgtgtacgtgaggtgccggccgcggacctcgacgccgacgcctcggatgtcgagcatgtccctccagtcctcgaagttctccgccgtggacgaggtcaggtcgatcagcatgcggagcctgtccttgacgcccaggcctttcgcggacgcgtagatctcctccatcgacatgccgtaccggcgttccaacggctccccgcccgaggccttccgcgacgtcgcctccggttcgttcgcgctccgcatgggtgcttcatcgacgcgttcggggtcgcgcgccggcggcgtttcggtgtcgccggcggctgtcgtaccgccacgcatcttgcgcgtctgttcctccacgacggggttgaacacgacgctcagtccctcgcggcggcatatctcgtcgctgaccgcccgccactggtcgatgatgtccttgggcagctcggccttcagatgcttcccgtactgggaggcggcgcacaccatgatgtggtcgtgcaggtggtgccggtcggtgtgcgtggcgaccacgaacttgtattcgccgcccgtgatcctacgcgcgaactccacgccgagctcgtgcacccgctcgggcgtcacggggtcgtcggggctgaagctgagcttgatgtggtaggccagccggctgttcttccggatgcctttcggcgacctgcggttgtcgtcgagcatgccttcggccagcgcgtcgtggtccgtcctggtccgttcgtagttcgagctgaccagtcttccgccatcggtcttggcggggttgatgatgtacgccatcgccccgttgtcgccgccgagattcgatttcacgggtttgccgagcttgaccaccgccatgctcacgcgtccttccgggcttcgcgcctgtcggcgaacaggtcgccgagcagctgctcgatgcggtcgaacgacgcgcggatctcctccacctgatcgggcgttatgtgctcgttcgcgttggcccagtgggctatctggttgacgttcacgccgatgcggtcgatctcgcgggcgatcggctcggggtccgtcaacggcctgatctcggtgacgtggatgcgccgttcggacagcatcctgcgtgcgtatgagctgaacgaacggtgttccggagcgtatctggtcagctcctcatacagcttccgcacccgctcccactcgtccggcgtgaacgtgattcgcttgcagatgttccgatctctgcctgctgcccagctcattccacacctctctgggaggtgcggagttgggttttctgtgatgccgtgtgagcggtctggaggctctgccgaccatggggtacgggtcttcccggcaagccgattcgcaccgcgaatcgagtgattgtagctacaatcacgtcgcttgctactcccatatccatttcatggattgggagcgatttcacacggcatgattgcgcaatgccgtgaaggataatcgcgttcacccctcgctcctttcgcccatggccttgaggggaaggccggtgtcttacgccaatcgtccgtcgtggaaacggcggcgggtttggacacttggagcgcgggaaatgaaaaggccccgcgaaaaaatcgcggggccggtgggtcgttggtggcgcgtcatgtccgtcatgcatacgggcatgaaaaagccccggccgtcttgatgacggtcggggcagggacacgcgggttcctagatgacttgcatgtcggagcggacgcgttccgcggcgatgtcgatgtctccgggccatgagggcacgccgaacgcgagtcgcacgcggtcgaacgtctgcgggtccttgagcggtttgaacatgccacggtcgacgtatcgggacatgtcgaagattccggtcgcgccgtcggaacaggtgaccttgagcttgtagcccggcatgggttcgcattgggtcactttgattgaatagtcgatggtcatgtccgtcgcctccttgtcagcgtagcgggtcgattctgaacgggtgctcgaggttgaaggccagctcccagtcggcctccagctcttcggcatgcagcagcacccatgcctcgaccagtttgcgctgcttgcgcgggaagtctcccttgagcagattgccatcgaaggtgaaggacgcttcgtggccttggtatctggcgtggatgtgcggcggaacatggtcgtccgcgttcatggtgatgatgattccgaagaacatgctgatgaccggcatgcccgcctccttgctttcgttgtcttccattctaggatatttttcttttgaccggatggtcaagcgaaagcgccagcggtggtagcgggttccgtcatgagaacgcgtcgaaaccccgggtttcgctgcgcgggcgttgacgggttccgcgtgccgctatgatcaaggcgtcagccggccggtcaaaagaaaatcttcgggatgcgcgcggcattggtgccgtgctccgtttcccgtcggcgagccgtggcctccgtgccatggcgacgccctgtcaggtccgggaaccgttcccggcgcgtggagtccagaggacggtagccgtcctctggccgccggaggcgccgcccgcatgacgcgggcggcatcggtcccggtccgtcactcggtcggggaacggcgatgacgtttagccctcgacacttgtccagtagaggccgtcgtcggggatgtcgtcgacctcgtcccacatggtccgggcccgttcatcccaccatgccgcgtcgtcccaatgcgcgtcggcctcgtcgtatccgacgctgccgttcgccagagtcgcgtaccggtcgaagtcgatgcccgtcgggcatatggcctccatctgttcggcggtcgcatagtagatgctgtccagatggtaggcctcccgtccggtttccaagtcgtgcgcggcgaggttggcccgcgccgtcccggcgagctcgtcgtgtttggcccggaaccattccaaggccacgttctgctccttcatggtcgggtctcctttcattccgcgtgcccgaacggttcgtcggtgaaccaccagtccctgatgacgagcatccagccgctcctttcgagcagcgggtcgatgtcgtcgggcgttacgatgtcgcccgcgtggttgacccatacgctcttctcgatgctgcatggcggccatccgccgtcaccgcccctgacggcgtagcagtgccatccgtcggtgatgtcgtgctcgtggagacgcacgtcgctccacatcgcgtcgacgcgcccctcgtcggtctcgaagacgacgtgctgcaattccatcggttccatctgcatggtcccactccttagtgtcccgccggcattcctgtttccctttcgccggacatggggcagcctcgcggtcccgccgcgcggtggaggacgcgtgggccgtgctcgcttcgggataatcgggcgaagccctcccggagcggagcacggaacacgcaggtccgaagacgcgggcgcggggctgcgatgatgaaccatggccggccgaccgttcccttccaggcgtcgacgcctggaaatcccggaagggtcggcgatgatcgcgcgcggccaccggggccgcgctctgtttccggcgaagccaggatcacacgcgtgtgatcctggcggagcccgactgtccaaaccggcgcacgtccgatcgcgtgaacatggttccagccggattaaaaccgggatgaaaaagactggaaaggaacacggacatggcatccgattacgtggacgacttcctgcgcgacgaacgcgagtcgttcaagcgcaaggaggcggcggcgaagaagttcgacggccgcctcgacaatttccgcaagagcgcgcaggcgctgcgcgacgcggcgaggcaattcgaggaggcgttccccggcatgagccggacgatgatcgcggacaagctggcgatgaccggaacggagaagaacatcgcgttcgacgcgaagggcgagctcgtcgccgcgccgggcggaagaaagaccccaccctccgaaccggagaccgtcgccgaatcggatccggagacgaccggatccgacatccagacgacggacgacgagaccgccccgcaggacgccgccgaaccggacacgtcggatgccggacgacccacgtgggcgtccggcaactactgatgatcggatgtgatgcgtaatgcgattgatcatcgccgagaagcattcggtcggccaggccatcgcccaggcactcggcgggcatgcggaaaaacacgacggctacatccaggtcggcgacgacctggtcacctgggcgcagggccacctcgtcgacctggccgcgcccgacgaataccagggccacgactggggcaggtggagcctggacacgctgcccatcgacccgacgcccgactggcaatggaaggtcagccgggagaagggcgcggaccggcagtacaagatcgtcgcgggactgatgcgccgcgacgacaccgactcattggtcaacgcgtgcgaccccgaccgcgagggcgaggccatcttccgcaggatcgtcgcgcatgccggggtctccaagccgatgcgacgcctgtgggtcgcgagcctggaggaggacgcgatccgagccgccctcgaatccatgagggacgagacggactaccagggactcgccgacgcggcgatgatccgcgcgcaggccgactggctcatcggcatgaacgcctcacgcgcatacagcctcgtctacaacgcgaggttcaccgtcggccgcgtgcagacgcccacgctcgccatgatcgttgaccgcgaccgggacatcgccggccacgtggcccgaccatactggaaagtcgtcgcaccgatgggcggatggaaactggccggcgaacgcctggacaagcgggaggacgccgagaccctgctgcgaatcgtcaactcggacgacttcgccttctcgatcttcaaggccgaacgccagcagcagcacgacgcgccgccgcacctgtacgaccttaccggattgcagaaggacatgagcagactgcacggcctgaccgccgcgcgcaccctcacggcgctccaatcgctctacgagaagcgcctgaccacgtatcctcgcaccgactcgcaatacatcacccacgacgacctggatacgctacgcggcctggccgaaggcgaccggctcgtcgccggcttcatcgaaccgtccgcgaaaccggaacggccgcgactcggactgaccgtgaacgacgcgaaggtcgccggccacaccgccatccttcccaccatgcaggccgacaaggcggcgctcgacgaactcggcgacgacgaacgcctcgtgctcgtccgcgtggcgcgccgcatgtgggaagccgtgggcgacgactacgtgcacgacgtgacgaacgtcgtcgcgaacatcgacccgcattggtgcgagaagcatccggacgaaggccgcctcctgtccgaaggcgaatgccgtttcaccagccgttccgaccaacccgtcgctcttggttggcgcgccgtcgagcatgccgccccgcaggaggaccagggcgaggaggacgagaccgcgggcaacatcatccccgccaacctcgccgccggagtctcaatcgcccccgttccacatggcggggcgactctgtccgagggaaagacgaagcctccgaagccgttcgccgaggcgacgctgctcgccgcgatggagcacgccagccgccgcgtggaggacaaggacctcaaggccgccctggacgacgacgaatcccattctggaggcatcggcacgccggccacacgcgccgacgtgatcgagaagctgatccgcaccggatacgtggaacgcaagggcaagcagctccgctccaccgaacagggccggtccctgatcgacgtggtcgccccgaagctcaaggacgtggcactgaccgcaggcatggaacgacgcctctcggaggtcgaacacggccaagcggacgcctcgcaggtcgaaacggagttccgcgacctcgccgcccgcatcccggccgacgcgcagaccgccgtccgtcaggaccacgtgcagacgaaaaggaacacggaatcgttcggagactgcccacgctgcggcaagcccgtcgtcaaaacgggcaaggtgttccaatgctccaccaaccggcgagagaagcaacccgacggcacatggaataccacggagggatgcggctggcgcgcctggacgaccatcgccggcaagaccatcaccgacatgaccatgcgcaggctgctcgacggccggaaggtcagcctcaagggcttcacctcaaggaagggcagtacgttcgacgccgcgctcctcatcgacaaggacaagggcatcgccttcgacttcggcaataacaacaaggaaaggaaaaagaaatgacggagacacagcagaccatgaccgaattcacctacgcgacgggggagaccgacgtcaccggcgaccggttcagcccgtccgtggtcctcttctggctcaagaccagcgtcgccgcgagcaacatgcgcgtgatgtacaagagcccgaacaccctgctgggcgtgatcccgctcggctcgaacacgcagacgatcccgctgcgcaacatcgcgtccgtggacacgaacacgaagttcaacctcggtagcttcgtctggggcgtcgtgttcctcatcgcgggcctcgcatgcctgtcggacagcgccgcgcttggaatcctgttcctcctgctcgcggccgcgaacctggcgaacacgatgagcgcccagctcgacttcgtcaaccaggccggcggcaggaacagcgtcaaggtgtccatcctcgaaaaggacaagctcatgcagctcgcgcagaaaatccagcggcttgtcttcgccgacgttgaaggccagcgccacaaggaaagcatggacatggcgcagaagcagtacacggcccagaccaacagcgtcctgatccagcagcagatgctcgaccagcagcgcaaggccacggccgacgataatccatcggcatcggccgagtgacgaaacgggacacggcttcgaccgtgctccgggaaacgccgggttcgccctgtggaaaacctcgattatactaaaagtataatcgaggttcgcgcaggcggatccggctttcttatatccaggaggaaccatggcggaagaggattggagcgaggccaaggcgtggatgcgcgcgacgcgcgaacgcatcggcatgacccagcacgacgcggccgtgctcgccaacctcaccgtggacatggtcaagaaatacgagtcggagaaataccggatccaaccctcggagaggatgagggagatgctcgaacactatctcgccgaacataggcgcgccgtcgcggctatcgtggaacggcacaggggggagaaaagggccgtgctctcgttctcccgcgtctccgacctgcccgagggactgcccgactgggtccgggccgatgagtccgtgaagcgccgcgccgccgccgtgcgcgaggccgccgcgctgctcgaggcggagggcgtggccgtcacctacacctacctgcccgaaaaaacaatggaataggaaaaagagagaaggaaggccgatcatgttcggactctatatgctcgcgatatacctgggcgtcgccgtcatcgtcgccggcttcgtcgcactgctcgtcgtcgtcgcgctggcggtggggctggtcacgcatcccatccgcacgattgccctggtgttccacaagctcactgccctggccgccggcctggcgctgatcctggcgctggtcgcctggttctggaccgaccatgcaaagccggacttcgtcccgtgcttctggggctccatcggcgtgatcgtcgcctccgtcattatccgcgcgttcgccgagtggattctcgaacggcccaccagggccgaacgccgagccatgaaacgtgccgccgcgcaggaaaccggcagggtgacgatgtgcatgccggtatcggaagaggtggccgcggcgttcgaatcgacccgggacggccggcgcgcctccctatgacatgcaggccgcaggacggaacgaaccgcggctggaataatggactttgcaaccggaacacgaaaagagggacatgatggccaatcccgagttatcgcagcgcatacaggaactgcccgaggaactgctcggccttgaacgcgagccgggaatcgccgaacgcctgcgacgaatcgacgtgctgaaggaccgtgcccgcgcactggaccccctggacggcgtcgaggacatggcgctggcggattacgaccgcgactggctggtgcgctacacctacaattcaaacgccatagagggatccacgctgaccctggaggacacgtccctggttttggagggcgagttcgtcccgtcggattcgccggcacggtacgtgttcgccgcgcgcggcgtcgcggacggcatggcctacgtgcgcgaatacgcccgggaggggaggagactggatgaggaactggtccggcgcgtccatgaggtgacggcgctggacctccagccgttcgcccgcggcacgttccgcccctacggttatctggcgaggatcaccgcgacccgcgtcaagaccgccgacccgctggagatccgcgacgacctgcgggccctgatcgacgggctggacgcgagcggcgctcatccgctgctcagggccgccggcttccatgcgatgttcgagaacatccacccgttcatggacggcaacgggcggaccggccgccagctgctcaatttcatgctgctgaagcacggctatcgtcccgtggcgatcaagtatgacgccaagcgcgactatgcccgcagtctggagacctggcaggtggatggcgatcccgtggcgttctgttccgtgttccttgactgcgtggaacaggaggaacacgcgttcatcgaactggtcgagggattgcgtcggaagccggacgccattcgcagcaaaacggatctgttggacaggttcggcgacacgctgcggcagaaccttgcccggcaagacggggatggcaagagtgccggaattgatcacgagggtcctgggtgccatatgagccattaggccgaaagcaccgactttggagtggatggggaagaacaaggtggtcgcataccaccctcaagtgccataccgtgtactcgaacgcatccctgaaaagagcgttttggattcgcatggatccgattgcggcaacatggtcatccatggggacaatctcgaagcgctcaaggccctgctgcccgaatacgaaggcaaagtggattgcatctacatcgatcctccatacaacaccggcaacgtggacgagctcaaagacgtggatctcatgtccgaggaatgtccgatacggttcatcatcacggtggaggcgttgagcgaggggctgggactgcccgttcgcctatgtcctggcaaccgtcgcgaagtcgtccacgaactttgcggtcatctgtattttcttctgtacgatgtcgtccgtgtcgtcatttttaatggcagcgatggcaagcatggtctggtgcttgctgctgttgacagttctgcccctcgccagaagctgttcgaccatctcttcggtaaggggcgtacggtgatggattccgggggctgaaaccgattccgttatctcgttttttcggtatttccgtattccggtatcttggcatgcgtcatttacctacatttttttggtaaatgtagattcctccgacaggctgaagatatccctttaggattttatcctgacgaattttctccccgaggatcttatccgaatagtccagtagataatcaagagtcgcctgatacggttcgagcatgaagacgcatcggcttagcgactccaggtaatgaagccgctttctgcgtttcctctcattggataatggctgcaaaccaggttcggtcattccgttgcgaaagtatttatgccatttgcgtgacaatgaggggaacctgattttaatccatgctctttgtgcccaggttggggatacgcgtgccgccggaagcgttatgaagcattcatcgtagaatatggaattcttatatatggcttcccatatcggcatacttccttcagcgtctttcatggtctgattgactcgttcggcccatttgcggaacttctcatatgccgaggaggccaacccgaggaagaaaccaaacagtgcgctgaagaaattctggaaaaccggattcgattcacttggaatcaagaaaatggcaatcaggcaaatggcgctcagcccgacggcaatcgcagccggtctaatgcggcggatccgtcgtctatagaaatccggattcatattcagcaacttgcccaagtcgttaatcaaacatcccgaagcggactcaggatacacctttatatcgctggctgaatccgcggtttggtttcctccatcggtgtcatgtctatcgaaaccgtccatgccgaatactgtcttgtatgagatgggattctccttaccgagataaataagcgaaaccatcatacataactttctgattgacgctcattccgtccaaaacgatataagcagtctcaaagcgcgatcaccatcggttcgcgggtcttctcgttcatcggtttctccttgtctcggttttccagtgtttccatatcccggtttttcggtatgtagttctttcggtatttcggttttaggtaaaacggtttcccggttttcaccggttccggtatcccgttccagcaggatcttcctgagcctttccacctcgtcccggagcttgccgatctgacgctccttctgggcgatgacggtgcggtggcgtgcctgacgtgtcatgcgtggcatctggcgaaaggattgcgactggaatgaaggactttaggagcggaatcaggcgcggctccgtctaagggccgtcggttttgctagaatctaaagagaaaaggaggtgcaatgttcggaacgatatctgaatccgagatgcgccgccgcacggagaacgtcgggctgtcggtgcagtccgtgcggttggaaggcggcgacgtgacgagggccttcatgcgcgatgccggagaatatgcgcgggggagcatcggcagcgccgagcttctttcccgcacccgtcgccgttacggattggagtgacgatggcgcttgtcttcgatccctacctgattccgggaacgaacgtgctgcggaaccttgtgggcgccacggacgaggatgcgctggcggctgcggagaacgatctctgctccgcccgcgccgccattctgagagagaatctcccacctgcggaggggacgctggaacagcttcgccgcatacaccggttcctcttccaggacgtgtacgactgggcgggggagatacgaaccatcgacatgggcaagggcgaggggcttcccttccaaccgttggagctgtttagcataggggtgcactactccgagggggtgcttcgcggtgacgatcttctcaaagacctcggtcatgaagaattcgtgaagcgtctgagcgtcagctacaacaacttcaacatccttcacccgttccgtgagggcaacgggcggacgcaacgcattttctgggagatcatcgcgcgcgaggccggctggcattttgattggggactcatcgacaaaaggacgaacgatcaagcctcgatcgcggggatgcaacgaaacgacctgcgtccccttgaggatatgttcaggagaatcgtcaagccgttgtccgaaccgttgaccatgtcgaatgatctggcccatcttggtgagtatgcgcaaccggcgaacaaggcatacgacatgtctcccgcacagagacaacatgtgtgcgagcattactcctatcagcgtgccatcgttcctccagggcaggaaaagccgaaactcaggcacaggtcgagatgattttcggataacgcctcacgtatctaagtgttgcgacggcagatgccgcaacgcttagatgcgtgggtctgttccgtttgatgccggtctttaccggttttggtttttcaatatttcggtttttcggttttgtgggtatgcctatccggcctggtttcgttcccttccgtcgtcttcgagctcttccagtcttctccggagtccggcgacggtctgtcgcagctggtcgatttcctcttccttctgggctatctgcgccttgatgccggccggatccccggcggggaggtattcgagtgccagcctctcggcgacgtcgcgcctgtgtctcggcaccacgcgttggtagcatcggacggccacgtcgacgtccacgtggccgagttcgtccatggtctcgcgcagcgtgccgccctggatcatgaacatcgtcgcgtgcgtcgcgcgcagggagtggaacgtcacgtcctcgcggttgattcttttcctcgcggtgcggaactgccgttggatcgtcgtcgggttcaggacccgttccgggtgcctgaccgcgtggaagagcatcgtgtcgggatccctgtcggggcagaacctgtcgatatgttccctgatgaggcggcagaccggtgcggggatgggtacgactcggtggctttccggggtcttcgtctcgtcgagccggtattcgcccagatcgtccggaccctgcgtcacggaatgccgcacgtacagcagcctgtggtcgaggtcgatgtccctgagttgcagtccgcagacctctccgatgcgcagcccgcccaccagcagcgcgagatggatcgacagtcggtagtattccgggaagccttcgaccagcgtgtcgatctcctgcctggtcatcggcgcctgctcgcgtcttttggacggtctcttcctcgtgacgaggttgcatggattcgaggacaatagcggcggccccccgtccggctgccgctcggtcgcggccctcatcacgcgcttgagcagccagaccgcgtgctcaagcgcggagggacgcacctcgtcgcatgccttcgcataccattcgttgacgaattcctccgtgacgtcgcacatgggcgtctcgccgaaccaggggagcagtttgtccaacgccgccttctggatccgcttgcttctgccgctcagctccgacccgtccttcttccgcaggttggcgacgaaacgtgtcgcgtatgaggagaacaggaccctgccgtgcatcgtcctcgccgacggatgcgtccacctgcggattccctttttatggtcgatgacgagcgcgtgctcctcgtcgagccaacggtacgcctcggtctggaattccaatccgaatcggcggtagattctttgcctgggattgacgggactctggtatcgggcctgccaggagacgatccttccgtccgcgtccttgcgggcgacgacgcatccccattttcgtcttttcctgtctccgttggacatcggttgttttgtctttctctacttcttggaaaaccattagaagaaagagtaattgcctatgccggtgattttggataaggtgccatcctgcggcctcggggattctatttttcgggaaaatcgggattattcagagtggttttgattggaatttcaacgattttcagtgatgtcgcatcccagaggagaagcatcatgcgcatgtcgccttcggaggtgcgcatgataatggtagtcatggtcctaagtgtctcatgggcttgagaccgggtgggaatgctgcggctcttgctatcgtgcgtatgagccgcaagcgctatgccaaacttgcggctcattctagataaaactagtctggatttaccaggcagatttggttatctaattattgttattactctttatgggcggataaccataatatacggaatcgtaatgcggtgaagaagtattgtattttaacaacgtgtatgattctgcctcaccaacttttgtaatattttttgctagactggctggtgtattgatggccccagcgtcagctttactgctgctactggcaattgaattccaaatttttgaagcgaaagtagaacagttggtaagataaccccatttatcgttatttttaatattagtatttactgtatttaaatcaatttgccttaagggtaattgaatggaaacattctgaagattaataccattggaattaagcttcgaatcaagattgagccacagacccttatgttctctactgacatctacagattcatcccaagtgcttgctgttatagatttaccatcagcaacgttaatcccagcaatgtttaccgtagaaccagacaggtttgtgatcataagccaagaatgaccgagattcgtgaaactagatgatgagccagatcctgtagtggaataaatccgcagtaaagctacagcctctgcagcgcgcgttttgtaattagcgccccgagaaggagatgagataattctcagatcttcgttatctgaggctttctcaagatcttccagagaagcattagacggaaagctagatagggtaggactcctatagggagtctccatagattctgctgccgacgcatttactgtcacagttccagccaatattacagatactagagtagcggcaatttgcttgagtttcttcatttatttctcctttttatcacgaataaaatagtttcgacggcaccagcagtgataaggaagggaactgctcgtaaaaaataaaggtatgaaggaaagctggacacgtattctggatgtaggtagtcaaaaataaagccgcttactgtgcgtaggagtccggcacacactaggagacctacaagaatgtggcaaattcggcgcatattgactcgattctcgaactgcggaggaatgagtcctattgtagtaggacttgctggagagaccaggctcagttcaaggaacagaaaaagtgatatgaactgattttttgttccgcattcccctagctcgatgggagatgatgggattatggcaaagggcacttgatgcgcgggcgagttcaaggtgaaggccgtccggttgctgacggaattcagggcctcatattcgtcgagggtgaacgcgatcggcgcggcggcgaggtatgtggggatagcgcaggaatgaatcgggatgccattgtgacggccgggacggttgcgcgggacgcgtatcgttctgcccgttgtccgacgcggaggcgtgctgctggacgaatgcttttgggcgtcacccatgctgaacatcatgaaaccacagggtgtattgttcttttccatgccggtcgacgaagacgctgagcgccgacagaacggtggagtgttcccggattattttcgggtgcctgtaggtgcctcgtggaaaatgagcgtgaccgacaggtttcccaaggacagaaaaccttggaataaagccgaaaacagtcgatcacagttatcatgcgaggtgcgcatgatgatggtagtcatggtcttaagtgtctcatgggcttgagaccggccggtgggtgcatgagctatgctccttgtgggacctgcccggttgtgaggactactctcgggagagacatgatgttcggagcggttatttccagttgaatgtgtagctttggtccggctgttcctcgccatgggtggtgacggtcgggatgttgccgtgccaggtgacggtgaagttgcccgagcctaatgatttgccgtcgttgtgcagatccgttttgatttccgtgacgttctcggaaccgataacactgggatcggtgtcccaagagactttgaccgtgatgctgcttgggccgaagaatatgggcgagccgagttcgctgatggtcacttcgcaggtgccgtcagcggatttcgcattcacgatgctgtggggcatgtctatttgcgtccatatgagggtgcagccgccggcccagaccagcgcgatcgcaagaacgatgtgctcgatgatgtgtgccgctttatgcgagtatccttcggtcataaatgtccccacgctcgtgtcatcatgccatagccttcaaccggagccttttcatcggtcgttgaaaagatggttggcgatatcgccccgaccgccgaagccggacggcacgtcacccgaagagttcttagcgaagtcgaacaatcccatggtcatgcctctttacctttgggaaaccaatatgcctaccgtatcagttgtcggcgtcatcgccgaggcttgcgatttgcggaagtggcccatatccatgcatcgcgtcatgaaacggtacgccgtctcgcgcgtaattcgtgcctgtagaatctttaaagaccaagtttgaagggagcggaatcatgccacgcaagctgattatgtgcggggaccatccggttcttgcgttcgaatacgatcccgagtccggtcgcgcgtgctcctctggcgaggtccttgaccatgatcgtctgcccctggagttcaccacgcacggcaagagcgcgctgtatgccaagaggatcgacgaatggtggaggtcccgcgccatcccctccacccgcgacggcatccgccgcgtgctcgaatcgcttggcgcggcatcgaccggggagctgctcgaccggacctacggtttgagcctgtcggaccagtactgggtcagacgcgaggatgacccggccgaatggaaggacgtcaacttcttcgacaatcccttcgacgaggcgctgggcgagatcctgctcacctcgtactcgtcgtcccatgacatcagcctcaacgcccccgacgtgtccactggcggcgatcttcccaaacgctggacaatcgacagggccaccggcaggagactgctcgtcaagtcgggccgtactggccaggagcccatgaacgaggtcatcgcctcgaggctctgcatgcgattgggcgttccggccgtccggtattccctggcgcgcaacggcaaccgtctggtgtccacatgcgcggacatgctctccaatcatgaggagctggtctccgcctggcaggtgctccaatccgtcaaggccgtcaacggcctcaactcgcatgaccagtggatccgcgccgccgtcggcttcggcgcagacgaacgggcggttcgtgacgccacggacgattggctcgtggtcgactacctcatgcgcaatacagataggcattacaacaacttcggtctgatccggaacatcgagacccttgcggtccgcccggctccgatctacgacaccggcgcgagcctgtggagcggcgagctcgatgtggacggccgagactggttcgccaagccgttctattcggcgaccggacgcccctcggccttgcggcagctcaaactggtggaggattggggccggttcaatctggatgctctgtcggactggcccgacgaggtggcgcatgagttgtcgcgcatgcgcatgttcgcgcccgaacgcctcgatgccatccgggtacagttggtaaagcgtatcgggatgctccgcaggatcagggaaggtgaggtccttcgtgtttctggcccgatccgcaataaaacggatttgatggacaggtttggcgagacgttgcggaagaaccttggacaacgggacggggatgccagaagcgtcggaaccggaccggatgcgttgagccgtcatctgaaccgctagcgcaacgaatcactactggaataatggactttgcaaccggaacacgaaaagaggagcatgatgcctaatcctgagctgtcgcagcgcatacgggcattgcccgaggaactgctcggccttgagcgcgagccgggaaccgccgaatgtctgcggaggattgacgcgttgaagggccgggcccgcgcgttggagcctctggatggcgtcgaggagatggcattgtcggattacgaccgcgactggctggtgcgctacacctacaactcgaacgccatcgagggatccacactgaccctggaggacacgtcgctggtattggagggcgagttcgtcccatcggactcgccggccagatacgtgttcgcagcgcgaggggtcgctgacggcatggcctacgtgcgcgaatatgctgaggaggggcggaagctggacgaggaactggttcggcgtgtccatgaggtgaccgcgctggatctccaaccgttcgcccgcggcacgttccgcccgtacggttatctggcgaggaccaccgcgacccgtgtcaagaccgcggacccgctggagatccgcgacgacctgcgatccttgatcgacgggttggatggctgcgcagcgcatccgctgctcagggccgccggtttccacgcgatgttcgagaacatccatccgttcatggatggcaatgggcggaccggccgccagctgctcaacttcgtgctgctacggaacggataccgtcccgcagccatcaaatacgatgcgggtcgggcatacgcgcgcggcctggaggcatggcaggtggacggcaagccggattcgttctgctccattttcctagactgcgtggaacaggaggaacagacgctcgtcgatctgatcgagcggcttcgccatctgagataggtcgcgggaacactcgtatgcttctttcgtgtgcgtcggtaagccgctgatatgcacagaagaatgagattattcttgggttcctgtaggtgcctcgtggagaacgagcgtaatcggcatgtttcccaaaaatcgaaaaccttggaacaaagccaaaaacagccggccacgtgtatcatgcgaggtgcgcatgataactgtagtcatggctccaagtgtctcatgggcttgagaccggcgtggatgccgacggcacggatacaggacggcggattggtagacgcgtagtattaagacggtgttcgaacggtcaagaaaagaggaacgaacatgtcgatgaaggacgcgctgaagaaagctaagatcgccgcgatgaaggccaaggacaaggccaagctcaacccgatcaacctgacgttggcggacatccagaacctggagatcgccaacggtcacggagcgaccgacgaggaagtgctcaaggtcatccagaagggcgtcaagacccgtcgtgagaccgccaaactgtacgaagacaagggactggcggacaaggccgctcccgaaaccgccgaggccgatttcctggaaaccttcctgccggcggccgccagcgacgaggactacgccaaagccgtcgccgacgccgtggcagaagtgaacccggccggccccaaggacatgggtcgcgtcgtcaaagccgctcgtgccgcgcttgccggcaaaaccatcgatggcggcaagctggccggtctggtcaaggccgagctcaacaagtaatcgtctacgagcagcgtctctttccgtgtacgaaaagcgggtccaaacaacaaacgtttggacccgcttttcataaggaacgcgaatgtgctggctcaacgctcgtgatggtcgatatggtcggacaccacgtcgccgatggtctgcacgatctgcacgagaatgacgcacaggatcacggcaacggtcatcacgtcgtactggtaacgctggtagccgtaacggatggcgatatcgcccaggccgcccgcgccgacggtaccggccatggcggagaagccgaacagggtgatgaacgtcagtgccgcaccgcgcaccagcgatggcaggctttcgaacagcagcaccttgaacacgatctgcaggttgctggcaccgaagctttgcgcggcctccaccagactgccgtccacttcggcgagcgactgttccaccacgcgcgccacgaacggagccgcggtgatgaccagcggcacgatggcgcccggcacgccgagcgaggtgccgacaatcagtcgggtcagcgggatgatggccaccagcagaatgatgaacggcacggaacgcacgatgttcacgatccagccgagcacggtgttgagcggtgcgttcggacggatgccctttttcgcggacgtgatgagcagcacgccgaccggcaggccaatcacatatgccagcagcgtcgccacagcagtcatgatgatcgtgtcacgcacgccttcgaccagcagttcgccataatcggcgatgaattgcgaaaccacctgtcccatctcacttcacctctttctgggcggaatcatcggccgccccattcttcgcgccatccgccgtttcgtgcgtatgtcgatggttcgtcaccttcgcgtcggcgatcaaagtcttcagaatgtcactgtgcggatcggcgaacagcgcttccgtatcgcccatttccacaatgcggcctccgtctatcatggccacacggtcgcagatgttgcgtgccacggacagcgaatgcgtgatgacgaccagcgtcacattaagttcacggttgatgcgacgcagcaggtcgaggatctgcgccgtcgtggtggagtcgagcgcgctggtggcctcatcgcacagcatgatggacggattgttggccaacgcccttgcgatggccacgcgctgctgctggccgccggacagctggctggggtagcggtcggccagatcagccagaccgaccagatcgagcagataccgcgcacgttcctcacgcttggctttcggcgtgtggttgagttccagcgggaaggtcacgttgcgcagcacggtgcgctgttggaacaggctgaagttctggaagatcatgccgattccggcgcgcacgtccgccagctccttgcctttcacgccggtgatgtctcgtccgtcgatgagcaccttgccggaagtggggcgttccagcaggttgatgcaacgcaccaatgtcgatttgcccgcgccggacgagccgagaatgccgaagacctcacccgaatcgatggtcaggttaatgtcgtgcagcacctcatgcgcttcggcgccactgccgtagcttttgtgcagatggtcgatctgaatcgtcataatgtcctgttcctaatcgtgttccataacaagaatgccgcagggtagtatacctgcggcattgaactcctactgccgaagcgggtcttagaagaccggaacgacagcgcccttgtagttcttgttgatgtagtcacgcacctcgtcggacttcaaagccttcttgagctccttggtcttggcggtgttctcattgccttccttcaccacgaggatgttctggtaggtcttcgcggccagaccgtcggccttctcggtggctagcgtgtccttggtcgggtcgaagccggcctggatggcgtagttgccgttcagggctgcgatgtcgacatccttgatgacggtcggcacgacggcggcctcaagttccttgaacttcaggtttttcggattggaggtgatgtccttcggcgtggcgttgatgtccttcggatccttcagcttgatcaggccggcatcctgcagcagcagaagcgcgcgggcctcgttggtggcatcattcggcacggccacggtggcgccgtcctgaagatccttcagctccttggtcttgcccgggtacaggccgaacggctcgaagtggatgccctccacggacaccagatgcgtgcccttctccttgttgaagttgtcgaggtacggcttgtgctggaagtagttggcgtcaacctcgccatcctcggtggcggtgttcggctgcacgtagtcggtgaattccttgacgaccagcttgtagccgtccttctcgacgagcggtttgaccgccttgttcaggatctccgcgtgcggggtcggggaggcggccacggtgatggtcttgtcgtcctccttggaggcggcaccgttggaaccggaattgccgcagcctgccaggccgaaggtcgcgagcgtggtgacggcgagcagtgcgccgagaatcttcttgttacgcatggttgagttcctctctctcaatttcgctacacggcccggacgcttactgcggttgcgggccaacgattgaccaatatagaggaacctgtgacggcaacacgtcgcgcgcttatcggaattatttataaagggcgcgaaaaccgcaggaatatgcgaaaaacagacttgtgaatcgtaaataatcttgcggaaacaccgtcatataacgccgaaatgcttaagcgcgttggctatgccggcgtcgtcgacgctgtcggtgacgtaatcggccgccgctttcggctcgtcggtggcgttgcccattgccacgccgattcccgcgaatcgtagcatgtccacatcgttgccgccgtcgccgaatgcgatcgcattgtctttcgtccaaccgaaatgctccagcatcacctgcataccaaccgccttgcctccatcggcgggaatcagatcggtgaaagcgggatgccatctgacgccgcgcacgttgctgcacatgctggcgatttcggcttccatcgtctcgtccacatacgggctgatttggaacgtggaatggtttgcgatgcgttcgcgcggatcatgcacgtcgattttcggcgcggtcttgccgagactgttccacgtgcgttccaatgcggcgttcgtgcgattgaaatacccgtagtcgctttccgcatagttggcgaccacgtcggcatgcgtttcaagccagtcggtgatcagcttcacgtcggcctggtcgatcggatgccggtagtcgagaccgtcgcgcgtggtgcaatactggccgttaagtcccacgatgccgtcgaacgtgacgggaatggtatcaagcaccacgcccatgtaggagggtgcgcggcccgaacagatgaacaccttcacgccattgcgctgcaatgcatgcaacgcgtcgacggtggactgcggcaccacatgcgtgacgaaactcgtcaacgtgccgtcgatgtcgaaaaacgccgtcttgatgtcctgagccatgctgcctccatgaaaaaccatgtcaaacccggtatccagcttacgaggatatgtgcgaaaacgtcgtgcacggcacggaacacgaccacgaaaataggaaaaacggccggatgtgcctacaatcgtcaaccatgagcgaacatatcgaaatcacgccggagatcatcgaaatcaggcactatctgcatgcgcaccccgaacgcagcttcaaggaatacgagaccagcgcctaccttgagaagctgctgcgcgcacacgacatcgaagtgctcaacaatccgctcgaaaccggcgtggtcggactgatccgcggcgaccagccgggaccacgcatcgcattgcgcgccgacatcgatggtctgcccatccaggaagacaccggtctgccgttctcatccgtcaacgacggcgtgatgcacggctgcggccacgacctgcacatgtcgtacatgctcggtgccgcgttctggctcgccaagcgccgcaaacacatcaagggctccatcaaactgctgttccagcccgccgaggaacttggcctcggcgcgaaggccatggtcgacgcgggactgctcgccgacgtatcagccgccatcggcgcgcacaacaacccgaactacgcgcccggacagatcgccgtcggccccgaaccgatgatggccggctgcgtgaaattccatgtaaccctgcacgccactggcacacacgccggctatccgcacaagggcaccggcccgatcgaggcgctcgccacgatggtcctcgcattgcagaccatcgtgagccgtaacgtatcgccgttccatccgctcgtgctgtccatcaccgaaatgcacggcggccacgtgtggaacgtcgtacccgacaaggcgagcttccaaggcaccgtacgatacttccacaagtccgacggtgaactggtggggaaacgcttcaagcaacaggtccagtccattgcggccggttacggcatcaccgccgacatcgattgggacgacttccagaatccgctcgtctccgatacggaactttccaagatagtcgccgacaacgtgcgcgattacgcccagctcgaacccatccacccgtcgatggcgggggaggacttctgcgatttcatgcccgtcaccatgcctgtgttcgccttcatcggatccaacggcgaggaaggctgcccggattggcacagcccgcacttcgtcggtcttgacgaatcgctgcaagccggcgtggaattctacgccaacgcggcgctgacggtgctcaacgaactgtcgtgacgccacgtgcggaacgccgtaatcgcaattttcataatcgtaaaaacacaacatatccaacaaatcaacggtaggttaggcagctatgacagacattcgcttcgcactcgcccaaatcgacatctgcgtcggagaccttgattccaacgccgacaaggtcatgcgatacgcgcatctcgccgctcagcagggcgcgcaagtcgtcgtgttcccggaaatgacattgaccggataccccatcgaagacctcgcactgcgtgccaccttccgcaaagccgcatgggacaaagccaactggctcgccaccgaactggcgtccgacagtctcggcgaactatatgtggtggttggcactgtaggcaccgaccgtgaaacctccaaaccacgcaaccgactcgtcgtcctgcacgacggcgtggtctgggccggctacgacaagcatttcctgcccaattacggcgtgttcgacgaattccgcatcttcagccccggcaacaaatccatggtgctcgacgtgaacggcgcgcgcatcggcgtggccatctgcgaggacgtctggcaggacggcggccctgtggccgaactcgccaaggagaacatcgacctgctgctgaccatgaacggttcgccatacgaggaaggcaaaaccgacacccgtctcgacctcgcggtgcgccgcgcggccgaagtgaacgccccgatgatctacctgaaccaagtgggcggccaggacgacctcgtcttcgacggcggcagcttcgttgtggacaccgacggcaccctgcttgagcgctcgccgatgttcatggaggatctgagcttcttcgacttggacacgtccgcggagcatcagaaggtcggtacgatcgcagccaagcccgatccggacgaggaagtgtacaccgcctgcgtgctgggcctgaaggattacatggccaagaaccatttcaagggcgtgtgcctgggcctgtccggcggcatcgattccgcgctcgtggctgccatgacggccgacgcagtgggcggcgagaacgtgtacggcatctccatgccgagcatgtattcgtccgacggatccaaggacgatgcagctgatctggcgcgcaatatcggcgcgcattatgacatccagcccatcgagccgctgttcgtctccttccaaaaccagctggaactggaaggcgtcgccgccgagaacctgcaggcgcgcatccgcggtgtcatcgtcatggcctactcgaactccaaaggactgctggccgtggccaccggcaacaagtccgaactggcatgcggctattccacaatctacggcgatgcggtcggcggctatgcgccgatcaaggacctgctcaagacccgcgtgtgggagatctcccgttggcgcaacaaggctgccgccgccggcatgggcatcggcggtctgcatgtcgtcggcaacgagcaggggagcgcgggcactccgctgccggatggtgtgatgatccccgtcaactcgatcgagaaggcgccgtccgccgaattacgcccagggcagaaggattccgattcgctgccggaatacgcgctgctcgatcaagtattggcgatgtacatcgagcatgctcatggccgcgccgacctgctggccgacggcttcgacgaggcaaccgtcgacacggtcatgcgattggtcgaccgcgccgaatggaagcgtcgccagtatccgctgggaccgaaggtgacggcgctggcgtttggacgtgatcgccgtctgccggtcaccaacgcattccgcgaataatcggcgatcgcaagtagaacatcgagagccgaaggaagccgatatggaaaagcagtggtatttcaacaccgtcaccgagcagccggaattgggcatgatttccccggcaagccaccgcatggggccgtacagaacccgtgaggacgcgctcgacgcgtggaagatcgtgcaggaacgcaacctcaaatgggaggaacaggaccgcgaatggaaacgctggtcagcggacggctcggcatcttccgaaaagtgaattccatatgaaaaccacgcccgattgtgatttatgtcactaatttcgggcgtggttttcaggcttttcgcagatgattgccgttacaatcgtgaaatagcgacggcgtaacgatgcgtcgccaaccgacacccagtaaggagtggaaatggcagcagttgatgcaacggcggtctcccaggaggaacttgaggctaaggcttgggaaggcttcaccgagggcaactggcagaaggacattgatgtccgcgacttcatccagaagaactacacgccatatgagggcgacgagtccttcctggctgacgccaccgacaagaccaagcacctgtggaagtatctggacgacaactatctgtccgtggagcgcaagcagcgcgtctacgacgtggacacccacaccccggcgggcatcgacgccttcccggccggctacatcgattccccggaagtcgacaatgtgattgtcggcctgcagaccgatgtgccgtgcaagcgcgccatgatgccgaacggcggctggcgtatggtcgagcaggccatcaaggaagccggcaaggagcccgatccggagatcaagaagatcttcaccaagtaccgcaagacccacaacgacggcgtcttcggcgtctacaccaagcagatcaaggtagctcgccacaacaagatcctcaccggtctgccggatgcctacggccgcggccgcatcatcggcgattaccgtcgtgtggccctgtacggcgtgaacacgctgatcaagttcaagcagcgcgacaaggactccatcccgtaccgcaacgacttcaccgagccggagatcgagcactggattcgcttccgcgaagagcatgacgagcagatcaaggccctgaagcagctgatcaacctcggcaacgagtacggcctcgacctgtcccgcccggcacagaccgcacaggaagccgtgcagtggacctacatgggctacctcgcctccgtcaagagccaggacggcgccgccatgtccttcggccgtgtctccaccttcttcgacgtctacttcgagcgcgacctgaaggccggcaagattaccgagaccgacgcacaggagatcatcgataacctggtcatgaagctgcgcatcgtgcgcttcctgcgcaccaaggattacgacgcgatcttctccggcgatccgtactgggcgacttggtccgacgccggcttcggcgacgacggccgtaccatggtcaccaagacctcgttccgtctgctcaacaccctgaccctcgagcacctcggacctggcccggagccgaacatcaccatcttctgggatccgaagctgccggaagcctacaagcgcttctgcgcccgaatctccatcgacacctcggccatccagtacgagtccgataaggaaatccgctctcactggggcgacgacgccgccatcgcatgctgcgtctccccgatgcgcgtgggcaagcagatgcagttcttcgccgctcgtgtgaactccgccaaggccctgctgtacgccatcaacggcggacgtgacgagatgaccggcatgcaggtcatcgacaagggcgtcatcgacccgatcaagccggaagccgatggcacgctggattacgagaaggtcaaggccaactacgagaaggccctcgaatggctgtccgagacctatgtgatggctctgaacatcatccattacatgcatgataagtacgcttacgagtccatcgagatggctctgcacgacaaggaagtgtaccgcaccctcggctgtggcatgtccggcctgtcgatcgcggccgactccctgtccgcatgcaagtacgccaaggtctacccgatctacaacaaggacgccaagaccacgccgggccacgagaacgagtacgtcgaaggcgccgatgacgatctgatcgtcggctaccgcaccgaaggcgacttcccgctgtacggcaacgatgatgaccgtgccgacgacatcgccaagtgggtcgtctccaccgtcatgggccaggtcaagcgtctgccggtgtaccgcgacgccgtcccgacccagtccatcctgaccatcacctccaacgtggaatacggcaaggccaccggcgccttcccgtccggccacaagaagggcaccccgtacgctccgggcgccaacccggagaacggcatggactcccacggcatgctgccgtccatgttctccgtcggcaagatcgactacaacgacgctcttgacggcatctcgctgaccaacaccatcacccctgatggtctgggccgcgacgaggaagagcgtatcggcaacctcgttggcatcctggacgccggtaatggccacggcctgtaccacgccaacatcaacgtgctgcgcaaggagcagctcgaggatgccgtcgagcatccggagaagtacccgcacctgaccgtgcgcgtctccggctacgcggtgaacttcgtcaagctcaccaaggaacagcagctcgacgtgatctcccgtacgttccaccagggcgctgtcgtcgactgaacggcacaatcagccaaatgaaagccgtcgcatgaaacgacggtaatgcgaagggacggagctcgtggcttcgtccctttcgcttttcccatatcgttttcccatatgattgggatggcagatgaaaggggacattgatgtctgaacatattttccgttccacgaccagacacatgctgagggattccaaggactacgtcaaccagacgctgatgggaggcctgtccggattcgaatcgccaatcggcttggaccgtctcgaccgcatcaaggcgttgaaaagcggcgatatcggtttcgtgcactcgtgggacatcaacacttccgtggatggtcctggcaccagaatgaccgtgttcatgagcggatgccctctgcgctgccagtactgccagaatccggatacttggaagatgcgcgacggcaagcccgtctactacgaagccatggtcaagaaaatcgagcggtatgccgatttattcaaggccaccggcggcggcatcactttctccggcggcgaatccatgatgcagccggctttcgtgtcccgcgtgttccatgccgccaagcagatgggagtgcatacctgcctcgacacgtccggattcctcggtgcgagctacaccgatgacatggtggatgacatcgacctgtgcctgcttgacgtcaaatccggcgatgaggagacctaccataaggtgaccggcggcatcctgcagccgaccatcgacttcggacagcgtctggccaaggcaggcaagaagatctgggtgcgtttcgtgctcgtgccgggcctcacatcctccgaagaaaacgtcgagaacgtggcgaagatctgcgagaccttcggcgacgcgttggaacatatcgacgtattgcccttccaccagcttggccgtccgaagtggcacatgctgaacatcccatacccgttggaggaccagaaaggcccgtccgcggcaatgaaacaacgtgtggtcgagcagttccagtcgcacggcttcaccgtgtactaaacgcccgtcctctcaatggcttccccatattcgctggatatgcggaacgcctcatattggtccatgccgccgactgaatcgatggcatggaccaatttattcatacgctgaaaaatcttcacattcgacgcgtggcaaagtggttcgaaatactacgaaatgcccttctctgtcgtagccttgaactatggcagacatctttgattttccacgagatgcgcgcaacgtggcgcgcgccgatggcaagggagcggatatgggcggcgaagccccacagaccatgcttatgcgaccgcagggcgttcccgaccaagtctggaacgcggtgctttccgtggactgtatgcggcgtttgaaaggcatgacataccgtgagattccggtgcccaattccatggcgaacttcggcatcggcgtcgcgttggaatgcgatgaaacatacgcatccggctggatcatgatcctgtactcgctcaaattccgagaggactggcactcccactggcgttgcgtggctttcgcatccttgccactgcccgacaaggaggacgactgcctgactccgggcatgtactgggacatgatgatggaacgtctcaatccaaacgattccgaacatgtatccggcaccgtcacagtcacccaaaacacagcattcggccatgaccccgatgtgcccagggtgggctgcgagatccgggtgtcttggactccactagactatgccgatggaggccttgacgccggctcccaagtcggacagtgggcgtcgttcctccggtccatgacgcaatccgaggaggaaaaccccgttgactgacgagccgaagctgctggcggaaccgcgcgaaggcgtgcccaacgtgatcgacacgttgccggcattccgtgactattgcagtgagctggcttcctcacatggctcccttgccgcggacgcggaacgcgcatccggcttccggtatgggcatgaggactggttggtgcagttcaaacgcgacggagccggcatcggcctgctcgatccgcaggcgctcgccgcggccggggcggattggaacgatttcaaccgtgccgtcggagatgcggtatggattctgcatgattccctgcaggatcttccgggattcgacgaactcggcatggaaccgcaacggctgttcgacacggaaatcgccgcgcgtctgctgggattgaaacgattcggacttgccgccgtcaccgagcactttcttggactgacccttgccaaagaacattccgcggctgactggtcgtatcgtccgttgccccgtgactggcgaaattacgcggcgttggacgtcgaactgctcatcgagcttgaaacgaagatgcgcgccgaactcaaacgccaaggcaagatggaatgggcccaggaagagttcgattacgcgctcaaagaaggtctgggaccacgcaaggagcatccgattccctggatgcatgtctcacacatcactgaagtcatgcgtgaccggcaggcgctggccatcgtccgcgcgctatggacccgccgtgacgaactcgcgcgcgaatacgacatcgcgccgaccctgctattgtccgacagctccatcatcgaagtggcgaaacgcaaaccacacaacgctgcgcaattccgttcgattcgctccatcaacgaacgcgtgcgcatccataccgattccgaacaggacaagatgttcgaacggtacgcgccgattcaacgcaaaatcaaaccgagcatgtggaagaacatcatccaggacgcgctcgccctgccgccaagcgaacggccggacgtggacggcggcgccgcgcggcgtcatgaatcgcagtccgcttcggctcccaaatcgattcgcgtgtggaaggaacggtatccggaacgtctgcaagtgctcaacagggtgcgcaaggcggtctcccagatagcggaggacacgcgcacgcctgtggaaatcgtcatcaaaccgcagtatttgcgtaacctgtgctggacggacgaacctcgtaagcgtgacgtcgcgcgattcctcagcgaacagggcgcacgcgattggcaggtctccctagttgcagagtccgtaagtcgcgctattatgtagaggttgcctaacggcagaaatatgaagaaccgtatttttcaggagcgcaagcgtgaaaatcagcgtcaggaatcttgagccgaccaaggtgaagctcaccgtcaccgtcgacccggaggagttcaacccgtatctcgacgaggctcgcaaggaaatcgcaaagcaggtcaacgtgcctggcttccgtaagggccacgtgcccggcaagatcatcgaccagcgtatcggcttcggtgccgtcgccggcgaagctgtgaacaacggcgtgccggagctgtattccaaggctctcgaaaccaagaagatccacccgatggcccagccggagatcgacgttcaggacgtgccggaatccgccaaggatgagaccaagctgaagttcgtcgccaccgtcgagcgtcgcccggacatcgaactgccggctcttgacggcatggagatcgaggtcgccaaggccgaggtcaccgatgaggacatcaacaaccgtctggaagccctgcgccagcgtttcggcaccctcgtgagcgtcgaccgtccggccgccaagggtgactacgccaacatcgacctcaacgccgaaatcgacggcgaaaccgtcgactcccaggagggcgtgagctacgagcttggctccgccaccatgctcgacggcctggatgaggccctcgaaggcctgtccgccggtgaggaaaccagcttcgaaggcaccctcgaggccggcaagcacgaaggcgagaaggccctgatcaaggtcaaggtcaattccgtcaaggccgaggaactgccggaactcgatgacgacttcgcttccgaagcatccgagttcgacaccctcgacgagctgaaggaagacctgaagaaggtcgccgctcaggacgccgaaggccgtcaggccaccgccgctcgtgacgcgttcatcgccaagctcgaggatggcctcgagattccggtgccgaagggcgtcaaggccgaaatggtcgagcagcagctcaagaacgtgaccgctgatccgtccaaggccaccaaggagcagaaggccgaagccgaagaaaccgtggagaaggaactgcgcgaccagatggtgctcgacgtgctcgccgagaccatggacgtcaaggtctcccagggtgaggtcttcaacttcctcgcctccatcgcccagcagtacggcatggatccgaacgccttcatccaggccatcatccgcaacggccagatcggttccgctgtgcaggaagtcggccgctccaagggcctgctctccggcatgcgcgccgtgaccttcaagtccgagggcgagaccctggacctgagcgccttcctcggcgaagccgctgaagacgaagagtccgagagcgtcgaggctgcttccgctgccgccgccgtggctgacgagctcgcttccgacgagaagtgagaccgattggccgcctgtgggcgttgtattgacgcagcacatgcgataaaggctggaatcctaagggttccagcctttttctatgattcctttgccttgctttacactggaatacagtgtgtgactggaggaacaatgaatcagggattcgcggtggttgatttcgaaaccacgggattgagtccggcgaaaggcgatcgggccattgagatcggcttggtgcacgtggctccggacggcacgctcgaagacgagcatgagacgctgattcatgtggatcgcagtgtcggtgcctcctgggtgcaccatatcaccgcgcgcgatctgctgcacgcgccggatttcgaaggcatcgcacatgaactgcgtgacctgcttgccggccgcgtgttcgtggcccacaacgtgtcgttcgactcgcggttcctgctcgccgaatactcgcgcatgggcgcctccatacctgttcatcagagcactatgctgtgcacgatgaaactgtcgcggtcactgattggtcgcggcaagctttccgactgctgcgactacttcggcatcgccaatgaggatgcgcacagcgcgttgagcgacgcgcatgccacagcgctgctgctcggacggctgctggaagccgatccgaattggcccggcttccagcgtcgtctcgaatcggccgcggatgccgcggaacagtggcccacattcgccgcattgccgaaagggcaatggctgccgcgtggtacgcacgccgcggcgcacgccagctgaccttcggacattggtccagcgggggaagcgatttctaatatccaagctcggaacttgcaggaactaggacagcaggaatttgatttcggcgaagaattcgcggaccatgttgttcaccagcatatcgggcggtgaaccggccgcgatgccttgggcttcgtcaagtccattgtcatgcgcgatctgcaatgcgcggaacatgtggaagtcattggtgatgatgccgacggacgcgttgtctccggcaatgagcttcttgctgttgacgatattctcctgggtggttttcgacttggattcctgaaggatgcggccttcctcaatgccatgtgccttcagataatcggccatgccctgtgcctcggggaatggctcgttcgcgcccttgccgccggagacgatgcagatggtatccggactgttccgcagataatcggccgccgtgtccagacgataccgcaaggccttgctggggccggacttgcgcacctgcgcgccgagcaccaccacataatcgagatgctggtcgccccgcgcatgcatgttgctgatgatgcacccctccaccgtgccgaatatggcgatgccgatgcacaccacggcgatgatgacccctcgtatgatgcgggggagcgccacccaccaattggcggcgattccaaccgcgaggagggcgaaaacggcggcgatgaccagccagaccttccagaagccggtacccgaatgtgtcttcatcacggcgaacgcgtagaacgccgacagcaaagccagcgccatgcacagaacggttcctatttgccgtgccatcgtcttcatgccaacctcttatcgtgtggtggtatacgccgcttgaaatccatggtcaagcgtaagcggaatggggttgcggattgttgcgatgcggacgatgtagacgattctttcgcaaatgtgacgtgtatgctgctgatgcgtttcatatgcgaaacgctggcggacatgggaacatggcgtccgtataatggcgcgcgtcgctcctgcccgggccgcgcaggtcgaggaacggccacggcgaccgccgcgatctccaacttacggtgcgcggcgtcaaccaaggcaaggattcatcatggcagagccatcctctgaaacgattacccaaaaaccacgcatcccgatgctgaagcatgctccgcaaacaacggaggaaacacgcagatccctgaaatggcgtgtcgtcgacatcgccgtcggagcggccgtcggcgtaatgtccggcgtgatgttctgggtgttcgatggcatgtcctatggcttgtttcctttactgactctgatacttccaggctccgcggcactgctgcacgcattgttctatttccctgccacactgggcttgctgatcgtacgcaaaccgggcgcgtcggcctacgtgctgttagtcgcctcgttcgtggaagtggtgctcggcacgaaatacagtgtgagtctggtagtgatcgcgctcgtgcaggcgctcgccgccgaaacggtgttcgcggtgttccgctaccgccgttggacgcttggcgtcacattgctgtcatccgtggcgatcggcatcgtatacaacttctacctgttgttcttctactaccaggcgttttcgttcttcagcccgcgcggactcatcggcaccgcatgcgaactgctaagcgcggccgtattcgccggcttcggatcatggggactataccgtgccttggccaagtccggagtcctcgcacgtttctcatccggacagtaataacgacagcgcctgcgcgtcctgatgtgcgcgcaggcgattacaacgtgatacgacgattcttgagcacgggaagtattcggcgcacgtcctccagccgatcccgattcaggtcggcgtaaatcagttcgtcgcgttcgccggactgcgcaagaattcgcgcggccggatcaactaccatactatggccgatatcatgcccgctatgctcactgcacgccatgagataacaggtattctccaacgcacgcgccttgcacaacgtcgtccaatgatccaccttgccctcgccccgcgcccaagccgcacttacaaccaacgcatcggcgccggccaccgcgtgacggcgagccagctcagggaaacgaatgtcataacaggtcatcacaccgaacttccagccatcgatatccaccagcggcggaacctcatgccccggagcgatcgaatcggattcgcactcgccgaacgcgtcgtagagatggatcttgcggtattcgagaagaatccggccatggtcgatgacgaggaaacagttgtatggcaggtcgacagtgtcttcgtgaagatggaccgtacccatgacggcgatattgttggcttcgctgataccgcgcagcgcggtgacgaacgggccgtctatggtttgcgcgtggtcggccgtgtagtgtgggtcgtcgtcactccgggcgatcagaccttccggcagcaacaatatccgtgtatggttgcgtgctgcttcgctggcgaacccgctgatgatgttgatgttgtgctccggcttttccgttacggtgaactgcccgaccgccactttcatgtttcgcattgtcacattattgcacgagtcgaagtcggacaggtaaaggggcatttccgtgattcggctgtggcacgaatgtttcgcattcgtgcctttgtatctgcattgttgcgttttggttgatgcggccgattcgtcggcaaacgtatctaaaacctcctgcttttcgattggatttgcgcacgtcttgcggtttctcgatttccttccagacgtgagcgaaaaggggtgtgcggctgaatttcatcgtttttgaaaaccttgattttccaacgattttagaaattgcgattgtcggttcgcgcgcacgtcctgcgatttcccatcattctattcggatgtgagcgaaaggggttatgcgaagtatgcggatgctgggtcagcttaatgcgatgtacaggcgtttgggattctcacagaaacttgtcgacgattccatatcagaacgcgctcgatgatatgtcacggtcgatcacagtggagcaaatcgcgcggattgccaagccgattgtgctccgtcgtcatgtggctgaactgtacatgttcgggtcgatgttacgcggtgaggtgtacgtgaattgagatattgatttcacctatcagcttggttctgaggcaaatccagtggttgacacgctcacacttcgcgatgatttgaaaaagacttttggacacgatatcgatttggtgaggaagaagtatattgccgaacctttgtctgaccgtttggcggagatatagcgtgtgctgtttgtagacttcataacatccaatctgatgttccgtatcgtctgatgtgatttatggaaccatccgcaagagtgcttttcattttgtgctgatcgtacgggcgttcaaagacgcgcaatggtttttcggaccactcggtgctgaggaattcgccgacaatgatgagaaagcggaatgccgttgccatagcgattgcacgagcgggggagcaagctaagaagctgccagacgagttccggaatatggagccagatgttccttggtgtggggtaagtgtgacatgcgcgattggattgcgcatgattacgatgagtctgattgcgactggctgtactatgccgtaactcacgaaataccacaggtttttgcgatattgcagccatatgtggaatgtcagacacaagtgcctaatcgcgattgtttccttgggagcgattgctgtccacagcgatcacttctacggttcccgtcgacgtttccataccatttcgtttttggttgatacggtcgatttcctcctgaacgatgttgcccaagcttttctcatccacttcgacgttttccgctgcggccgattcgttggcgaacgcgttgaaaacttcctgctttcgtgccaatatgtccgtgattttctcgtcaatcgtattttcggcgagtaggcggtagacaagaacgtttctggcttgtcccattcgatacgctctggaaatcgcctggttttcgatggatggcttcaactgtggctcgcatatgattaccacgctggccgattgtatgttaagtcccgttccaccggcaacgatttgtgccaccagaacctgcccagcaggcgccttgtcgaaatcgtcgatgatttcttgtctcctcgttggtgtgatggatccgttgattggttcggtgcattggctacccaacatgtccgcgattttccggatggtgtcaagatagaacgaaaagacaaggactttcctgccttccgacttcgcttcttcgatgatttccagtagacgtttcgctttgccagagtctttcaggtccggtacgttccaggacacgcgtcggatggcattgtagtttttgctgaataccgtttcttcgtacttgcgttcttccgagtcgccaagttggcaccattccttgatttccgacagttccggaagctccgtcagcacatcctctcttctgcgccggtaatacacaggggcgacggtttctctgaactggggagccgaagagagctccttcattccggatatctgcatggcaatgcttggttgcaatagtttgatgagattgatcatctcgtccaccttgttctccaacgcggtgcccgtcatgaatagtaacctttccgcatgctccgcaatcgccttcgtattcttcgaacggttcgtgctcggatttttgatgtaatgcgcctcatcgactacaagcagcgaatatgtgaaatcgtcggaaaacttgaaatacgcagtggtctcataggtggtaacggcaacgccgccggttcgttgccaatcctccaatgctgattctcgactgaagccatgcacgcttatgacccgcagtttgctgaatttttggatctcgcggcaccagttgacgatgacgctcgccggacatatgacaatgaaatgcgttgccccggtattccttaacgaaaccatggtggcgattgcctgaatcgtcttgcccaagcccatttcgtcgccaagaaggactttcttttgatgcagtatgtatttcacgccccattcctggtatcgacgcaaatcgcacagcaatccgtcgggaaagaagcactcttcctgaacttccctggcaaggtctttcggaagcccgtacacagtatcgccattgcccagcagtcccggaacgatttcctcaagcgtattggcgtatgagatgggatgttttttgaaggaatcccatgcatcgtcttctgaaagtgattcgatggcgtcggattcgactcgcagcctttccgcggtttgcccatactcaccgtgtagcgtctcatcaagaagcttgtataactcgatggcgttttgcttttcctgccgggatgcgaacagccaacggaatgttccggctgagaccttgaggccttccagagcgttttggatggtgcctgaatattgctgggatagccggctgctcttatctgccagcggtttcgcctgctggtattgggacactgcgattatcaggcgggttgtatcttcagttcgattatctgcgctgagctgtagcttcgttgttgcagaagcgttatcggctgcttcaccgacgattcgtttgatgattcgcgcgccgtcttcactgatacctcgtacggccgccaactgatatatagaagcggtcagtatatcggcgtacattacgtatccactatcgcgcagcgcttttacacggatgccgcgtttgtcccgattgacttcttctaccgggattttctccatgagtttcagaacctgcgcggcaacgtaacagtttgccgcctgctggatggagtcccggtaaatgacgtcggatgttgcgattccgtctaacgttttctgaattcccggcattgccgggaaatgtttttcacatcggaagatgaaaaggaccgtttcgtagcacgacttttctttttagcggacactcggacgtgttttccagccatcctgcattccttccgcgttttctgcttgtgtcctctgtttagagaaattgtgatcttgatttttcgcaagtcttatgtttcgtcattctactctgaagtgtgcgaaatagggggtatgctgcaagtgagggttgttcaaggaagaagggtcgcagtgatgcgttttgccaccgttgcttttgctcagttggatttgactatttggtatgtcgcgattgttctgccgattctgattcttgcgacaatcgtaacgatttggggcaatcaaattactggcaaggctggtgagcattgggccagtgaggaactgagaaaactgccacaatcagagtaccgtctgctgaacgatttggtgctcaaggattcgacgggactgcatcagatcgatcatgtggttgtttcggtgtatggcatttacgtagtggaggcgaagaactatactggcacgatttatggcgattccaaatattctgaatggttcatgtaccttggcaagaacaaaagaaaaaatccattcgcctttgcggcagaattacgggcacattcaatgtttgaaggaattattgggattggaagattcggttttcatttcgattgtatgctttgcgaatcataccaagttcaaagtgaagactcactccgatcgcgagttcgtggtgcatacgaatgatctgagatctacggtgcttgaccatccgcaatgcatggggcctgacatgaacgcagtggcggacaggttggaaagcctgaatattatagataaggcagttcggcacgaacatatccgtgatttgcagaacacatattccgggaaactctgagagagctagttgagagttgaatgtacataatttcggatggctggatgcgatggccaaacgataatgccggtagactacgtaacgtaggaaacaagcaaggacgatagtaaatgattaccggagcgacgaagaacaaggttgacgacatctggcagcgcatgtgggagggtggtgtcaccaaccccatcgaggtcatcatgcagctgacgtacctcatgttcatgaaatccttggatgacaaggagctcgaagccgagaacatggaaatgctggggatgactgctaagcatgtgttcccgcaaacggaggaaggacaggcaatccgttggagccggttcaaggatcttcctgcggagcagatgtttgacgtggtcagccagaaggcgttcccgttcatcaaaaccatgcattcggataacgcctttgcggaaagcatggaggacgctgccttcggtttcaacaagcccaagacgcttgaaaaggccgtttccggcatcgacgagctgctgtcgaactacgtgcaggacgctgacgatcttggcgacctgtacgaatacatgctgagcaagctcaataccgcgggcacgaacggtcagttccgcacaccacagcacatcaggaacatgatggtggcgcttgccggtccgaaacccggccagcttatctgtgatccggcgtgcggcacggcgggattccttatttccgcagccgaatccatcagaaagaaccatggccaggagatgaccgaggaacagtggaagacgttctccggcgagcagttcactggtttcgacacggatcagaccatggtgcgcatttccgcgatgaacctgctgctgcattccatcgatcatcccgacatccgcaaccaggacagcttgtcccgtctgaacaccatccgcgacaagtttgatttgattcttgccaatccgccgtttaccggcagcgtggatgttgaggacatcgatgattcgctgaaggcggttgtggaaactaagcagacggagctgttgttcgtcgcattgttcctgcgcatgctcaagcttggtggccgttgcgtgtgcatcgtgccgaacggcgtgctgttccgttccaactcgaaagcataccggcagttgcgcgccgaactggtggacaaccagaggcttgaagcgattatctacatgccgtcaggagtattcaagccgtattcgggcgtaagcaccgctattctcgtgttcacaaagacggacgcgggcggcacggacaaggtttggctctacaacatggagggtgacggatacacgctcgacgacaagcgtgacccggacgagaagcacaacgacattcccgacattctcgagcgatggggaaacctcgacgcggaagaacagcgcgcccgtactgataagagctttctggtgccgaagagtgagatcgcggaaaacgattacgatttcagcttcaacaagtacgcggaaacaaagtacgaacgtattgaatatccaccgactgaggaaatcctcgccgatcttgatgatttgaacaggcagatgacggaaagcctcgcggaactgcacaaaatgctcggaggtggccagaatgactgacaaaccccaatttgtcggaaagaaagtgaagctcggagagctgtgcgagatatgctccggtggaactcccaaacgttccgttgctgaatactggaaagatggaaccataccttgggtgaagattggagacatgtccgaaaagtatgtttcatcaactgaagagcgcataacagacgctggatttaacaactcttctgtgaaaatgcttgagcctggaaccctgctatattcaatattcgcttcgattggtgctgtgagcatcttgaagattcctgcgacaacgaatcaagcaattgctggtctcaaaattaaagatgattcacttgatcgcgattttttataccattatttaaaatcccgagaatcgatatcgaaatcatcgggcaggggtgctgcacagaacaacatcaatctgaccattttgcgtaatatgcaggtcacgttaccctcgatagaaattcaaaggagtattgttcggaacctcgaaatgatttcgaatcaagtgacgatagcggaatcgcatcttatggaccttgatgttctcgtcaaatcccggtttgtcgagatattcggagatttcgcttgttatgagacgaagccgctaatcaaatgcgttgattgcattgaagcaggaaagagcccaaaatgtttagctttttctcggaaaatggcagagccgggagtccttaagcttagtgctatttcttcaggcgtgtattgcgagaatgaaaataaggcgcttccgcgtagcgtttcattgacgattgacaaagtagtacatgcgaatgatattcttctttcgcgaaagaatactcctgaacttgttggtcgttctgtacttgttaagcatacagacggcaatattatgtttccagatattatttttcgtatgcatcctttgcctcctataaatgcaatgtatctgtcctatttactggcggggcctttgctgcattcaattcagtcgcttgcgcatggttcggcaaaatcgatgagcaatattccaaaaagtgagttagcgaagctgagcattccgattcctgcgcttaatctgcaaaatgagttcgctaacttcgtttcgcaggtagacaaatcgcgatttgtcgcccagcaacagatcgaaaaactgcaaatgctttacgatagcctcgctcaggagtatttcggagattagagttcgttaaaccctgatattgcaaggttctcgatggcttacggcaccttttttgtagggaaaccaacaaggaggtgccttttctcatgcaacagacaatcgaacgaattgaccgtcttatggcccctatgctgaatgatgagcaggcttcggaacttcatacggtgcttgtggcctgtctaactgagaaaggtgggaatccacgcggtcccgaaacaatgaccgaatgcatagacttgtttcttgccgcgaagaagctcgaaggttgttcagaacggtcgttgcgttactatgcgaccacattgtcccgttttgctacggaaatctccaggccggctcacgacatcaccaccgacgatattcgcgactatctcacacgatattcgcgtgatggccgcgtaggcaagacaacaatcgacaacatccgccgcgtcatctccagttgcttctcctggcttgaagaggaagactacatttacaaaagccctgtacgtagaatcaagaaaatcaggacttcaagaacgttgaaacccgtgtattcggacgaatcgcttgaacaactccgtgactcctgcaaggagacgcgtgaccttgcaatgattgatttattgacatctacgggcatcagggtaggcgagctggtgcagctgaatcgtcgtgatatcgacttcgatgcacgcgaatgtgtggtccacggcaaaggagacaaggaacgacgagtctacttcgatgcccgtgcgaaaactcatctgctcgtataccttgaacagcgaatggatgacgagcccgccttgttcgtttccctgcatcgccccttcaaaaggttagaaatcagcggagttgaagccagactccgcaaactcggcgacgattcgggcgtcaaacacgtgcatccgcacaagttccgacgtaccttggctacgaaggccatagacaagggcatgccgatagaacaagtgcaagtattgcttggacacagcaaaatcgataccacgctttgctatgcgcaggttgatcaggataatgtcaagcgttcccaccgcaaattcatctcatgaagtcgagcaaaccccaatttgtcggaaagaaggtgcggcttggagacattgtcaagattgagaaagcttcaatgccatctggcaataatgtttgggtgcttaacctagatgcggtagaaaaaggtacaggcaaagtcatcgtaaaaaatcggatgaaagctgattctgctggtacttcgactgttgcgtttactgctgatgcggttttatattccaagcttcgcccgaatctaaataaagtggttgtagcggatgaaccgggattagcgacatcggaaatgttgccgcttattgtgaatcccgaagttcttgatcgacgttattttgcctatttgctgcgttctaattcatttgtaaatttggcggtatcatctaccgctggatcgaaaatgcctcgtatgaataaaaaaaccttgcttaatgcggtttttccgattccgagtttggaattgcagcatcagcgtattgatttgctctcttccattgaaaaagcacgaacaaaagcggaattgctgattcaacaactggatactctcgtcaaatcccggtttatcgaaatgttcggagacccagtcgaagagaacagatgggcgcgcatcacattagcttctctttgcactaaactcggctctggcgctacgcctcgtggcggtaaagctgcttataaaacatcaggcattccattgattagaagcatgaatgttcataatggctattttgaatcaaaagatttagcttatatcgatgaaattcaagcaaaaaagctggataatgttaccttgcacaagggagacgttcttttgaatatcactggtgcatcagttgcccgttcctgtcttcttcctgattatttggcaggaggccgtgtcaatcaacatgtttctattgtgcgttgtgatccaaatagaatgttgccgcgtgtcttaaattctatttttacaagtgattcatatcagcgttttcttcttgaacattcaagaatggctggtgcaactagagaagcaattacaaaagacgacttagagacgatgacagttccccttcctccgttaagccttcaatacaaatttgctgctttcgttgcgcaggtcgataaatcgcgatttggcggaatgctccaccttctcaacagcctctctggaattatgcatgcaagcttcttttctgtggctgacacagactagaaacgattggaaaaacactggaataacaccctatgcaagccgtggaagcggtacgatgaactcatatggtgttttccgcggtgtgatggggctggaggggcatatcatgagcaatttttcgttcctgctgggtcaggatgattacgagcagttcgccattccatgcgtcgaagccgaaaaagcgttctccatttctccgaccatgtgcgccatggccacgcgcaaagcgttcgaactggcggtgaaatgggtgtacgcggcggaccgttccatccaaatgccgtatcgcgacaatctccaatcgctaatccacgaacccactttcgaacgcgcgatcggcaaccagaaaatgttggattcgttccaatacatcgtcaaagccggaaacatcaccgtccatggcaagacgcgcatcagtcccaaggacgcgatgttcgatctgaaactcctgttcgtgttcatccaatggatcgactactcgtacggcaaatggtacgaaaagcgcgtcttcgatccgaaacaagtgccgtgcgtccaacaagcgctctcccgtaaggaagtccaagccaaagaagacgccgcgaaacaggaactcgccaaggaactgagcgccaaaaccgaacgtatccaggaactcgaacgtcagcttgaggaatcccgagccgcgctgtccgtgcagaaggctccgcgtccacccatgccggacagcgagatggatatcagcgaatacgagacgcggcaacggttcatcgaccttgatttgcggctcgccggatgggatgttgattccgaggctgaggtcgtcaaagaacgcaaggtcaccggtatggaagaccatgaggggcaggtcggctatgtcgactactacctcaaaggcagagacggcaagccgctggcgatcatcgaggcgaaacgaacctcgtatgatccgaagaaaggactggaacaatccagacagtacgcgaaatgtctggaacgcgaattcggataccgtccgctgattttcctgagcaacggatacgccacggaattcgtggatgacgagaacggtccatcccgtccggtcgggggagtgttctcgcaggatgacctgcaacgcattatgaaccggcgcagggaagccatcgatccgcggaccgttccggtgaacgagaaagtcgccggacgctactaccaaatcgaagcgatcaaagcgttctgcgataacctgtggaaaggcaagcgtcgtggactgctcgtcatggccacgggaacaggcaaaacccgcgtatccgccgcacttaccgacgtgctcatgcgcgcgcggcttgtgaaaaacgtgctgttccttgccgatcgtgtcgaactggtcaagcaggcgaaaagcgcttacggcgaatactatcccgactggtcgctatgcaatctgtgcgacaacaagcacgacgtcgacgcccgggtggtgttctccacctaccagacgatgatcggtgcaatcgacaccgaaacagcatccgacggaaagcctgcgttttctccgggacatttcgacctgatcatcgtggacgaagcacaccggtctatcttcaaaaaatacaaggatattttcgaccatttcgacgcgttggtcgtaggcttgaccgccacaccacgcgatgaagtggaccgcaacacctatgacttcttccaagcggaacatggcgtgccaacgtatctgtacgaatacaaaaccgccgtggaacgagaccactatctcgtaccgttctacaacatcgaagccaaaaccaaattcaccgacgaaggcatcacatacgatgacctatccgaagaggacaaggaacgttacgaagatgatttcggtgaggacgatggcgagggcggagtcgaagtacccgaccatatcgacgcggacgcattgaacagattcgtcatgaacgccggcacagtagacgccgtattgcaagacctcatggaacatggcatcaaaaccatgggcggagaacagataggcaaaaccatcattttcgcgcagagccaaaaacacgcgcgtttcatcgtggaacgattcggcgcactatatcccaagcttgctcgtggcggcttcatcaaggtcgtggtgcacagcgaagactactcgcacgcgatcatccaggatttcaaacgcaaaaccatacccgtcatcaccgtttcggtggacatgatggacaccggcgtggacgtgccggaagtcgtgaatctcgtgttcttcaaaaaagttcgttcgcgtatcaaattctggcagatgatcggtcgtggcacacgcctatgtgaaggactcgactgcgtggacggcatcgacggcgaatacgtggacaagaagcgtttctacattttcgactattgcggtaatttcgaattcttccgcgagcagaagaacgatgccgatgagaagccggtcacgtccctcagtgagaggatattctcacgcaaaaccgaactggtccatgcattacagtcgagcgaattcacttccgacgaaaacctcatggcatggcgtgacgaactcgtcaacgacattcacggacaagtcgcatccttggacgaatccaaggtatcagtgcgattgcggcgcgaatacgtggaaaaataccggaacattaaaacgttcgaacatttaagcgacattgacgtgcacgacctgaccggcgaagtcgcgcctcttacgcattacgacggcgaagacgagtatgcgttacgtttcgacgcgctgatgtacggccttatggtggcttccgtcagaggacggaccgccgcgagacataagacgaaaattcgtgccattgccatgaggctcaaggaacgcatgaccattcctcaagtcaaagagcgggaaacggaaatcaaactggtcgccgacaatccggattacctcgatggggcctcccttgagaaactggagcggattcgtatgacactgcgcgatctgattcgcttcattgcggactccactgccaggaaaatggtcatcacggacctgaaggaccctgtcatcgaccgatcggaaggacgggaattcgacacagccgagcattacgaagactacaagcagaagctcaaccgatacatcaacgagcacagcaacgatgaagtcctccgtaaactccactacaacgagccactttccggcaaggacttctcgaaccttgaaaacatcatgattcatgagcttggttccagagaggaataccagaaggcgttcggagacgttcctctcggactgtcggtgcgccgtatcattaaactcgaccatcaggcgacaatgaaggcgtttggcgaattcatcaacaaccattcgctcagtcccgcgcagaacgcgctgatgaacagaatcatcgactacgtcgaacagaacggatacgtccagccggaagaccttgcccgaccgccgttcgaccggccgaagcccttgttcctggtgtttggtaaggaactgatggacctgaaagtatgcatcgaacgtttgaacgccaacgccatggcgcccatcgcgtgatggcatagggcagacgtgtaacgaaagtttcatcctacgaaaacgcgtgtttcgtaatagctggtaatcgttgtaatggacgtgatgcggaacgtgcgtgagcgagtatgtgagcgtacgtgtcaggtgagccgttccagcagccagtcacgtaggatgacgacgtggttgatgtgcggatcgcgtgccgcgtacagcagggtgatgttggcgtcgtgtagcagattgcgtacgtcgtctgcgaattgcgccgcttcggggcgtgaattgagctgctctatgtagcgtgctttgaattcgtcgaacttcgccggatggggctgcggacgttttcttggagatgattatgcagccattccctggctttgacggtattgtaccggactcatccaaccgagtgattgcttgatgcgctcgtggttgtaccagcggatgtactcgtcgatcaggacgagcacctcgtcacgggtacgctcctcccagtgctcgggatagacggactccgtcttcatacgcccgaagaacccctccgcggcggcgttgtccggcgaacagcctttggcgctcatcgaccgcgtcagcccgtaatggttcatgagctccagccatccgggccaccggtaatggcacccgcggtcggaatgcaccaggggcctcgccccctccggcagcgtctccgcggccttgacgagcatcccgttggcgagctccgcgttgggactgaaaccggccgtgtacgcgacgatcttgccgtcgtggcagtcgatcatcggcgagaggtacaccttcccgtcccgggccttgatctcggtgatgtccgtgagccacttctcgttcggcgcttcggcggtgaaatcccgtttgacgaggttgccgggcgcgggagtcgtttcgccctcgtatgagctgtatctgcgtcgtttgggcacatgcgcgacgagtccgtcctcggccatgatcctgcggatcaccttctccgagacgccggtcctgagcatggccttgattctgcggtacccgtacctgcccttggacgcggcgaacgcctcggccacctccgttctgaatccggagtatttgtcaaccccgagtctggtgtggtgatagtggtagctgctcggcgcgatgccgagcaagcatatcatcgagttgagtgaatacgccggcctcagacggtcgatcagcagcgtcttctccctgttcgacaggcgccgcaggtcggcgcctgggtcttttttacgacctccaccacctccctcatcaacgcgttctccaattccaactcctcgaccctgcggcgcagcgtctccgtgtcgtcgttgccgtccccggcatcccggcttcgacacggtgcggacgcggtcttgccgttctgcgcggcgttcctgttcctggcctgcaacgcggccatgccgcccagcaccagttcgatcgccttcgttcttgtctccaaggggatgatgggtttcgccatatggccagcatacctgggatccttcgccagccagcgttccaggcactgtctggtcgggtatcccagatactccaccacctgggccgtggtcatcggcgtggtgaaatacaagtccaccgcgcgctgtcgttcctcggggctgaacatatgataatcctttcgtccggtctccaagaaaatgtccgcagccccaaacatatatccttgtcaaccataaccagcaaatgcacgtttataaccaaattgcaagcaaattaggtttgcagaaacattttggcgaggtggctcttaaaccgagtcaattcatcaatcgatttagtgagaaaacaacaagtaatcgagctattgcggacaagccccgaggcaaagccgatgtagtgcttgttgatgaagctcatctgctgttgacgcagggtgaccaaggatactcgggcaagaacatgctgcacgatttattgcgtcgtgcgaaagtggttattgcggtatttgacccgaatcagattttgcaaacttcgcagcgttggagcgaagaggatcaggacatgctctttccgcagcaagcagaaagcgacgtgcaaaaaactgctactggctatagcgggcagttggagcgatttgtgccattgaatatgtggggtgatcactatttgctaagtcgcatatgcttgcataggcaatttcgcattgctgcggatgatgcgacgattcgatggattgatgatttcgctgatggtaagagaataggtcgtattcctcaagacattggggagaaggatagaaaaacaggcgaatatgtccgcgagccatttgaaatcagagtattcgattcgccggttgaactgtttaaagccataaaggagaggccatatctaaaggcttcaggcgttgacggatgcgggctttctcgtgtggttgctacgtatgattgggagtataagggcggcaaaatcaacgattccagtcccgatggtctttggaatgttgagatgcatcgcgatgcacagggagtatggcgcatgggagcggctccgggaatgcagagaggatacgatgcgtttaatcctgatggaagagctgattatttctgtcatccatggaattacgaaatcaaggtaggggataagggtctttccctagatgctgtctgggcggaaagtccgcatacgcttaatgaagtaggatcaacgttctctattcaggggtttgatcttaattatgtaggtgtcatcattggaccgtcggttacctatcgcgaagggaaaatcgtttttaacgaaaaggcaagttgtaataaacgtgcagtgagtaagaggaacggctcaatcagctacgcgcaatccaatctgcgtaatgaactgaatgttctgctcaaacgcggtgtgcatggattgtatttattcgccgttgatcctgaactgcaggccgctctcaaagaagctgccagtaagtaattgcttgactgtacttgatgttcatctatgttcatctttgagtttatccagccgatgcgtatgcaatgttgagcgatacataaccgtccgaaaagaggccgccatgaaatacgggatgagaaaacccaactggaagaagagcctgtccgcgcgcacgaaaggccgtgccacccgcgcggtcaagaaagcgttgatccccggctacggcaagaagggcatgggatggctgcatcccaagcgcaagctgtacaacaccatctacaagaagaccacgttcagcctgttcgacctgttcaagtagtcggtaatcgggtaatcgctagaacaaatcatcatgcgacccggtccgtgtgagcacgagttgcagctcctgcttctccacacggtaaatgacgagccagtcactctcgatgtggatttcgcggtatcccctccagcttccggtcagctgatggtcgcggtattttgtgctgagcaactgtttgtcctgggccatgagcgtgtcgatggcctgtctaagcttatcgggattgtaatgctttttaagcagagccttgaaatcctttttgaattgcgttgtgcgaaaaaccgacttaagcatccaacagatccttcatcaacgcatccgtgctggtgaaggattctccgtcatgggtttccgcttggcggcgtgcctcaatgctggacggattgtccctggtgatcttgaaaggcatgccgttttcgcggattgattggcgcagaaagatgttgattgccgttgacagatccatgcccatatcggcatacagttcctttgcctctcgcttgatcgctgggtccgtgcggaaactgatcgtcgcagtgtcgctcatagtcgctcctcatcatatgcaggtgacggttacaagcaattgtaatgcgaatgtcatgctgttgtctatacacgagatcccgccatacgggagcacattccgtatggcgggatcttctatgttcgtaatatcgcgtctatgcttcgggaaagggtgatcaacgttttggaatccatgctggcaagcgttgcggtcattcctgcaatgtgaattggaagggaccatccgccacggaaccgacgcgcatgcgggcgccgaaccggccctcacacacggggacatcgcccgactgcaacgcttcattgaaacgaatccatatcagattcgcatgctcatcataggcatcatgagataccagctgcggcctgccgaccgcggaacgccgcaacgtggtgagcggctgtggaatcgacagaatctcgccgtgcatctcctgaacagacagcgacagtctgccctgcggaccatcgaaacagcgtaacgtgagcacacgatgcgccatccgtgcaagcgttccctcatcatcatcaggttccacttcaatggtcagcaccaatccgggcccgatctgcaccatgtcgaatgtcggatccggtgtgcccaactcgttcaatacgatggcgctcgcttcggtcacgcgttgcagggaaactttcataacggccaagtgtacggcagcggatcggacgaccattgcatggaaaaaacggctggacaccggtagattggggtgttatctaccggcgtccagccgtttttccacgagtcggatggcgtcagctctttgcgtcgaacttctgcgcttccggcacggaacccagcgattcctcgttgttgttccactcggtggaccagccgtccacgaacgcgctctgcaccttgtcccacttgccggtgccctgtgcgtattcgaccagcgcggaggcgatgtcgtcctgccactgctgatccggaatggtgaagctgcgcacttcggtcttgccgtcattgctgtaggctcgggcggcctcggtcagaggattgtccggctggtagtcatcggtgaacgtggtgaatggcacggagaatcccatgtccttggacaggatcttcttggcctcgttgtcggtgaccatccacttgatgaagtcgagcgtggccttcttgtccttttcggaggcgttcttgttcaccgcccagctcgcgtcatacactcctacggggccgcaatcctcctcgcccttgatgcccatgtagtaggggagcatgcccaggtcctcatcggccacgtcattgcccttgatctgcgaatacgcccacacgccgttcgggtagaacgccacctggccgagcgcgaattcggaggtcacgtcatcgtaggtcttggagctcaccatgcttgcctcggtcgggctggtcttgagctgcaggtcgaacatgtccttgtagttcttgagatacgtgcccttgatggtcttcgagaacgtggtgttcgcgtcccgatactcgtagtagagcggcagacgcgtcatatgcgcagcgaatcggtacgtgtcggaggcatccaagcccggggtggcgaacgcgccgtcgacgccgaggtcgtccttgtgctgctcgatggattccgccacctgcttcaaggtcttgtagtccttgatgtcatcggcggacttgatcaccgcataaattttggcgcaataatccttgatgatcttcttgttgtagatgatgccgtaccattcggcggcgtacggcagggtgtacgaattgccgtcgatggtgtacgagtaagccttgccggtatcgttgagcagtttgaacacgtcggtgtcctgcagcggttcgacgtacttctggtacttggcgaactggtcgaagccggcgacgttgaacatggttggtgcgttgtccttggccaattcggatttcatggtggcgtcatacgtgccggcggctccggtctggatgtccacctgcacgccggtcttcttggtgtatatgctggccagttccttgtactggtccacgacctcggccttgttgttcatgaaatacacgtggcccttgctggaatcggcgctgctgccgccgcaggccgccagcgatgttcccatggcgagcgtcgccgcgatggcgacgattcgtgtgatgttgcggttcatgatgtgctcctttgtttggttgttgaatgcgaattgcggttgatggggtccggtcagccgagcgcgatccacgcggtggtgtcctgcggcagacggccgtcgtcggtgaggggtccggagacgagcaggatatcgcctgccggcagttcggccggttccgcaccgaagttggtgacgctggcccagccgttggccctacggaaagcgatggtgccgccggtgtgcccctcggcgccgtccggcttgccgtaggaccggtcgcagtcgagccaggtcagggtcgtgtcggccgtcatccattcgtgacgcagtccgagcgccttgcggtataggttgagcatggagccggagtccgtgtcctccctgtctacggcgtagtcggcgaaccattgcggttgcggaagatgcggcttctcgcacggatcgcccgcctggctcgcgtccacgccggcgccttcatgcttggtggcgggggagaagccgaaggtcggcgtcccggccttccaaggcagcgggacgcggcagccgtcgcggcccttttcgatctggtctcggacgcggttgaacgcggtcggatcctccaactcgtcccacgggatgtcggcgacctctggcaggccgagctcctcaccctggtagatataagcggaacctggtagcgcgagctccatcaggatggccgcacgcgcacgcttcgtgccgagctcgcgattctcatggtaagaggtaccgttgcgcagcagccaatccttggcaagttggtggtgggctgcagccggcacctgcggcagcccatagcggctgacgtggcgggggatgtcgtggttgctcattacccatgtggaggtggagccggagcgttccgcagcggcgatgccttcttcgatggcgaggtgcatgtcgttgcgaatccagtctttcttggcgaattcgaagttgaacacttggccgagttcttcgggcgaggcataccggtattgatgctccggaggtacccaggcttcggcgacggcgaatgccggcggatcatactcgttgaacaccttgcgccattcgcgatagatgtcgtgcacttcgttcctgtcatacagcggatgcgtgccgtcggcgtaatgcatctcgtctccgatgattttgaaatcatcgagatcgtcacggtcgagatccttagccaggccgtgcgccacatccacgcggaagccgtccgctccatggtcgagccagaagtgcaaggtcttgatgaaatcggcgcgcacgtccggattcttccaattccaatcgggctgttcgacggtaaacatgtgcagataccattgtccgtcgggcactcgagtccaagcggatccaccgaagctggcaatccagttggtgggtggctcgtcgccgttcggtcctttgccgtcacggaaaatataacggtctcgttccggtgagccggggcctgcggcaagcgcggccttgaaccattcatgctggttggacgagtggttcggtacgatgtcgacgactattttgatgcctgccgcatgtgcggttttggtgagatggtcgaagtcgtccatggtgccgagtttcgggtcgacgttgcggtagtcgtccacatcgtatccgccgtctgccagttgagacggatagaacgggctgagccagatggcgtccacgccgagtctttttagatatgggatttgttgtgcgactcctgcgatgtctccgaggcccgacccggttgtgtctttgaacgaacgcgggtagacctgatagacgaccgcctgcttccaccagagtgatggatcgtcagcgatgtgccgctcgttggcttcgttgctcattgggttgtcttccttcattggatgcattgtgattttgttatggctttttatggaagcgttttcactagttcattctggtgagaacgctctgttttgacgattggaatcacttcgttctcgtcttcgtattgcttaaaatgatagcgctttcattctgtgaatgcaataattgttttgttatggcgtgtctgcttgtgaaatcaacgattctgctaatatgaaagcgctggataaacaatgggaaactggagtggatatggcacgagccaccatcgccgaagtagcggaactggcgggagtatctcaggcgacggtttcgcgggcattgcgaggtgctggcaaggtcgctccgaaaacgcgtgccaaagttgaggcagctgcggaccggttgggctttaccttatctaaaagcgcatcgtctttggcgtccgggaaaaccatgcgggttgtcctgctgttttccggcaaactcaacgaatggttcaacgccaacgtgttgcagggcgtgtgcgaagtgttggaaccggaaggctacgacgtgtcgcccacatttgtcacaggcagacaggagacggagcgttacttcgcacaattgcctaaaaatcgcaatgctgacgcgatcatcatttcgtcgttccaactcgacgaatccgcacgtgagaaactgcgtgtcaccgatatgccgacggtcggtgtgaacattccagccgaatcgttctgcgacgcagccatcggtgttgacaactacgatggcatgtccaaggcggtgcgtctgctcaaatcgcttggacaccagcgcatcgctttcgtcgttgattacattcccgacgacatggtctacagcaccagccagcgtatggaagcgttcttggaagcggctgaacaaaacggttacgacgatgagtatgcctacgtcataaccgcggacgagcatgatgcgccattgtcgaaagcggaccttgctgcgcaactggtggcgaaattactgtcattgccacacatgccaaccgccatctgtgccgaaaccgatcaagtggcaatcgcagtcatcaaggaactcggcaagcaacaattgcatgttcctgaagatatctccgtcatagggttcgatgatgccgacatcgcacaggcggcgaatctgaccaccgttcgacagaatccgctggaaatgggacgcaacgccgcccgtaagacgttgtcccttctgcgtggacagacgccagacgcatcctatgaatcgcaggaggccacgctgatgttgcgtgacaccaccagacgcgtggcgaccgaccgttcgtgacggttcttccgtattctccgaacggaatgaacgcaatatggaaggatatgggcccatgtagcctatgcgccctatgatgcgttgaaggaaaccggtcttcggaaaaccgagacggtggtcgaaccatacgaagacatcgaaagacattcggcagggcatgggcaaaatcaacgaaaacagcgcaaagtcaacgaaaacgaagaatgtgacgcccgcggtcacgccatggggcaagaaccgtgtgaagaacaccgaaacaggcaagcacgtactcatcatgccgggcatcggctacaccgtggacaggccgctgctgtactggtcggcgcaggcgctcgcggccaacggctggttcgtggaccgtctcgacctgaaactgacggaaagcgtcgaattcccggaaatgatcgcctgcatggaacgcgtggtcgacgaatggcgcaaggcggcgctcgaacatgctgccgaatcgggtgaggagccgcagttgctggtcgtcaccaaatcgctctccacactctcatatccgcattccgcaaagctaggattgcgcgtggtgctgctcaccccggtactcaatccgccgccattcgacaagcacaagtcggtcattcccgcgccgctgccgggtgcggtcggcagtccgatgccgttgatctgcgccggcgacgccgacccgtatttcgatgatgccaaggcgcatctgctcaccgaccatgtgcgcacgtacgctggtgccgaccattccatcgaagtgccggacgattggcagacgtcgctcgactacctgaaacaggtcacgcaagccatcgtcgactacgccggctgaaaagaacgggacggaatatgcgcatcgtattgcagaaggtcagcgaaggaaccgtcgacgtggtcgacgaggtgagtggggaagtcgatgccacgttcgaaccacagcatataggcattggctatgtgctgcttgtcggagtggaagacacggacggagcgaaacaaatcgactggctcgcccgcaaaatcgccaacctgcgcgtcttcgaagacgagaacggcaaaatgaaccgttccatccacgacgcggacggcagcgtgctgtccatctcccaattcacgctatacgcggacgtgcgcaaaggcaaccgtccaagcttcgtgaaagccggagcgcccgcgcacgccgaacagatatggaacggattcaacgacgccctgcgcgcgcaaggactcgaagtaaaagaaggacgattcggctcccacatgcgcgtgcggctcgccaacgacggtccggtcaccatcatccttgacaccgacgaactcggcgtctgacccaaaacccaacgtgaaaccctatatccgacgattgccatagggtaaaacgcatgggaatatggaacgaccgcaaactgatcgtcaactgcctgccgttgaccgaatccgaacgtgcgcaattcatacgtgccgcgaaagacataccacaggaattcgtcggcgattcgacccaacggggaagcatgagctggactgccgcagtaccggaggaactcaaagccaaagccaccgcggtcatcggcaacatcgcgcccgaggaatgcgcgcaatgccccaaactcgaatggcttcaaacttggagtgccggcgtcgacaaataccagcggcctggcgtgctccaccccggctccatgctcaccaacgccaccggcgcctacggacaaagcgtgtccgaacacatgttcgccatgatgtggtccatcatgaaaaacctgcacatctacgcggcaagcaacccgaacgccatgtggcaggacgcgggccgcgccatcagccccaacggaaaaacggcgctcatcatcggaaccggcgacatcggatcacacttcgcacgactctgcaaaaacgtcggaatgacaaccatcggcattcgccgtaatctcgccgtcgaagcgccgggcatcgatcatatggtcggtttcgattccctcgacgacgtcctgcaatacgccgatgtgatcgccatgtgcgtaccatccaccccgacaacgcgccacctgctcgatgcgaaacgcatcagcaaactccaaaacgacgccatcatcatcaacgcgggccgcggcgacgccatcaacagtcaggcgctcgccgaagcgctcgcggacggcgcaatccgaggcgcgggcatcgacgtgaccgaaccggaaccgctgccggaggaatcgccattgtggagcgagccgcgttgcctggtcacgccacacgtggcgggcggcaaccatttggagtccaccgagcgccgcgtcatcgccatcgcattgggcaatgtacgctgctacgccaacgggcagcctctcaacaacctcatgcccctcaaaggctgacggtcgcgcgcgggggagacccgtatgatggcagtcgggaaggagggaaagggtatgacattgaacaaatggcgtcgtgcgacggaatggttcatgatggcattggcattggtgttcctgttcgcgtattcgtgggaagtgctggcgagaacgcatatcgtattgtgcgaaacggtgatcaacatcatctggatggcgttcatcgtcgactacgtcgtttcgatcctgctggcgaaggacaagaaagcctggttcaaagagaatctgctgatgctggtgtccatcgccttgcccatcttcagaccattgaggctgctgcgattggtggcggtgctcaacgtgctcaaccgtaccggtggcatggcggtgcgtgggcgcatcacactgtacacatgctgcagcgtgacactgctgatgtatatcggcgcccttgccgaattggatgtggaacgtggggttccaggcgcttccatcaccgatttcggcgaggcgatatggtggtcgttcgtgaccgtcaccacagtcggctatggcgatttgtctccggtgacatggcagggaagaagcatcgccatcgggctgatgataaccggcgtggccctgatcggcatcgtcaccgcgacactggcctcatggatagtcgatcgtgtccgtgacgaaaccgacaagcgcgcggacgaggcggaatcggaaacggaacagttgcgccacaatgtgcgggaactgacggacaccgtcaaccagctgcgtgacgacatcgcgcggctgcgcagaccatagcggttctcatgactgcactgcggaaaatgcggaaagaggctgaggcataggaaaagcggagacgctgtattggatttattcgcaggcgactccgtcatggtcgcggtccagttgtgaacggtagcccggctggccctggtagataggcgcggcgccagcggctcgtgccgcggtgcagttctggtagtagacgtcctgctgtggcgctggttggggcgcgggagccggagccggagcgggttcgggcgcaggtgcctgtgtcgtttgttgagtctgctgggcctgctcagctgactgttcggtttgcgtctgttcggtttgcgtctgttcggtttgcgtctgttcggtctgctcggactcggtggtcttctcggctgtggaatccttgacccccgtgtagtcgggcacggtttgcgtcgggcaggaggacagcaccttggccatggcttccttttcggcctgcgtgacccacagtgagtatttgtgcttcacgccgatctgacgcgccacgtattcgcaacggaaccccttgttggacggcagccacgtggccgcatcgccatcggacttcttctggttggcacgcccctgcacggccagcagattgtacggatcgttcgccaatgcggtgcggcgctcctcgctgagcttctgcgcgcccttctgccacgcatcgctcaacgccaccacatggtcgatctgcaccgcggtggaagtcttcttgcccttcttgaacttgatgtccttgccagtgtatggatcatgcagttttccggacttcaccacgcaattgtgcgtacgccacttgtgcctcacgccggtcagatcgcggttgaggatatcattgcgggtgtcgcagccgttgtggtccacgtcggcccacgccttgccgaattgagtgcgcttgtacccggttttcggcgcgcggcccttgacctccaacgaatccaatacctccgtggcggacgtgccggccccggtgccatccgtcggctcgtccgcatacgccgaaccgaccggcagtccgatggccagactcgcagccagcaatccggacaaaacaaccatcatcgaaccatgacgacgcatgatacgctcctcaccctaaaaacccctcaagtagtacaagaatatccccggaacgaattcgaatcgcttatttacggcagatttttcggcatgccgaaaccagtatttcgcatccgtcaagacgtatggcaagaatcggccgtatgaccaacagcatcacagcaatcaaaccggaacgtctcgcacaatacgccaaagacttcaacgccgaccgggccaaccttgtggccgccaacgccgcggtgtcctcgggcgtgctcgaagccgccaccgactacaaaggccagcgcgcgctgccacgcgacttctccatcgaactgaaacagggttccatcaccaaccagcgccgatccggccgctgctggatgttcgcatccctcaacaccctgcgttacgagctcatgcaccagtggggactcgacgatttcgaattctccgaaacctacctgttcttctgggatgcgatggaaaaatccaacacgtatctcgaaaacgtgttcgccacgctcgacgagccgaccgacagccgcctgttccaggagatcaactacgggccggccgatgacggcggttggtggcagatgttcgccgcccttgtagacaagtatggtctcgtgccgaagagcgcctacccggaatccgccaattccaaggactccgacgcgttcaaacaatacctcaacagcaggctgcgccagttcgccgccgacctgcgcgaacgttacgcagccggcgccacggtcgatgaactgcgcgcggtcaaggacgacgacatgtccaccgtgtaccgcatgtgcgccatctcgttgggcgagccgccggagaagttcgacttcctggcccgcgtgagcgacgatgacaagaaggacgataagaaaagcggcgaagacgaggccgacaagccgaaaaccggcaaggacgagcgcagacagatccgcgaaaccggcatcacgccgatggaattctacaagaagtacgtgccggtggacgtcgacgatctggtgacgttgtgcaacgtgccgatggcgtcccgtccgttcaacaagcgttaccgcatccgctacaccgccaatgtggccgaagcgggggatatggaattcgtcaacgtgccgctcgacgtgttcaaaaaggccgcggtcgaccagattagcgccggacacccgatctggttcgcctgcgactgcacccagttctcgctgcgtgcggccggctatttcgactgcgacagcgtgcgcgtggaccagctgttcggcaccgatttcgacttcgacaaggcgcacggcctcgaatacggcgacagtccaagcaaccatgccatgaccctcaccggcgtgaaccttgacgagcaaggcaagccgaaccgctggaaagtggagaacagctggggcaaagacaacggcgaagacggctactacgtggcctccgacaagtggttcgaccgctatgtgaccgaaatcatcatccgcaaggaatacctcgacgacgccacccgagcactgctcgaaaccgagccggtggaactcgacccatggcagccgctgaccaaacgctgccgctgacgcaacacgggcgataacatgccgcggtccggatcgggccgcggcttttgctgttccatcgcgctggtatggttgcatgagaacaaacgtacgaacgatgggggttcaggtggcggacactctggcatggctttccgacgagctgcgcagcgaatgcagccagccggtactgcagcgcgcccgcggcatcgccaaccaatggcgttccaaaatggaggacctgcattgcctgaacgacaccgcatccaaccgcatcaccctgtatgccaccatacggggcaccacctcaccctccagccgttacgaagtgcaagccacgcttgatttcgccgacgagctgtttctggcacgctactgctcctgcccggcattcagcggttcgcagcgcggctacggttcctaccggaccttcgactaccacaacagtccgaaataccgcagcttcgacgatgacgacgactacgattacgtcgacgactacgacgatttcggctccggcagcacgtacggccacgtcaacgatgatgacgactcggcttcctccaccagccgccggtacaccggcatgtgcaagcacgtagccgccatgctgctgctgttcctgcaacagccggaacgattccggggattccacgccgcagccgcaacaccccgggccctcgccgactacatgcgctccctcgatgcgaaaagcaacaacgccggcgagaacgcccaactcgacgtgctgaaacgaatcatcaacgcgaaaagccgattgatcgaggaacaacgtggcgcctccggacagggagccgccaaaccgaaacgcaaatcaagcgcgccggtcgacgtcaaaccgggaagcgtgtacctcgagcccacgctgatcaacggccatgacgccctgcgcctgtccctgcgcatcggatgcggcgacgtcgactatgcgctcaaaaacatctcaagattcgtggccgacatgcggacgggaacatacgagtcatatggcaaaaaactcgcgttcacccacactccggacatgctcgaccccttctcgctgaagctataccgcttcctacagcaggtgattgcatccagaacggcggcccaactgcaaaacggatactattacggcgaagcggtacgcatcgaccgtgaactcgtcctcaccgattgggaggcatgcgacctgctcgacctgttccacgccgtgacacaggacgaatacaaggaacacgagtcgaaggcccgcggtttcctgcgcacgtcggacggtgacgggctgagacgattgcttatcgaagatttccaacgcaccaagaaatccgggccaagccgcatccacatggccaacgaaggaggcgaaccgttcggccttgacattgtcgaaggcgaccccaccttcacgttcaaggcgtcctacgtgcatgagggcaccgcgtcgggcgtgcgcatcacatcgaaccaaagcatctccgatgtcatcaacggacgcaacggcttctacattttcagccgcgaacgtcccgacgattccacggagacggacaggataggcatcgacgggctcttccgctgcaccgataaactgcgcccggcattacaggtgctgcctgacctgtgttccgacgatccggacggcgtgttcatcgccgaaaacgactggcccatgttcgcccgaaccatcgtgccgaaactcaccgaagcgggcatcggattcgacattccgcaggaagtgaccgaagcggtgggaaccgaatgccggatcgaattctatctggaccgcgatttgtacggcatcacctgcgaagcggtggcgaaatacggcgacttcaccttccaactggtgcccaccgccaaagaactgcgcggcgtgatcaaccccgattcacgttcaagagcctcgcaggtcaaacgcgacctgtcacgagaatcgttcgccgtgcaggtggtacgccagctgtgccctacatggagctccatcgacgtggcacgcgtcaaagaagaggacgagcaggctatcctgctcatgctcaccgacggcgtgcagatcctcaaatcggtgggccaggtcttctccacggcggcattcgatggcatgatgcagcccaacccgccatcggtgaaggtcggcttgtccatcgactcgaacctcgttgaaatctcaccgatcgccgacgaggtgccgatgaacgaagtcggcgcgctgcttgactcctaccgcagaaaacgccgctaccatcggctcaaaaacggcacgttcgtggatttgaaggaagccgacctgcatgagctcgaccaagtgtccacggacctcgacctgagtgaaaaacagctcgactccggcatcatcaaaatccccggataccaagcgttcctgctggacgcgcaggtcgatgacgaggacaagagcgcctcgttcgtggactatgtcaacgatgtgaagatcgtcgatccgaaacgttatgaggtgcccgaacggctcaaaaccgtgctccgcccatatcaggtggagggcttccaatggctgtccaccctgtgggacaagggcttcggcggcatcctcgccgacgagatgggcctcggcaaatccgtgcagctgctctcgctcatcgaagcgcgcaaaggaaacggtccgtcactcatcgtctgcccggcatcgctcgtctacaactgggccgcggaatgcgagaaattcgcgggcgatctgacggtggaggtcatcgccggtacgaaagcgcagcgacgcaaggccatcgcgacggtggccgcgcaatcgcaggagaacgacggtgctacgacgaatggcgccacgacgtacgacggcaccgacgtggtgatcacctcctacgatctgctgcgtcgcgacgtggacgattacgcagcctgccatttcgcgctgatggcgctcgacgaggcgcaatacatcaaaaaccacgccacaaaggtagccaaatcggtcaaacaggtcacggccgaccatcgcttcgctctgaccggcacgccaatcgaaaaccggttgagcgaactgtggagcattttcgacttcctcatgcccggactgctcggcacctatacgaaattccgcgaaaaatacgagcagccgatcatggctcccggtccggaacattccgtcatggccgacaaactgcaggcattggtgggactgttcatcaaacgccgtctgaaaaaagacgtgctcaccgacctgcccgacaaattcgagaacgtgctcaccgtcaaactggaaggagagcagcgcaaactgtacgccgcacacgaacagcggctacgcgccacgctcaccaaggcgtcggacgccgacttcaacaccaagaagatccgcatcctcgccgaattcaccttgctgcgcgaaatctgctgcgatccaagactcgtatacgccgacgcgaagaacgcctccgccaaactcgacgccatcgtcgaactcgtggccacatgcatggacgaaggcaaaaaggtcctcgtgttctcgcaattcacctcgttcctcgaactcatcggtaccagactcgccgaacaaggcgtggaatactacaccatcaccggcgagacgccgaagaaacgccgtgtggaactggtcgacgaattcaacggcaatgacgtgcccgtattcctcatctcgctcaaagccggcaacacgggcctgaacctcgtgggcgcatccgtggtggtgcacgccgacccatggtggaacgccgccgcgcagaaccaggcaaccgaccgcgcgcaccgtatcggccaaacccaggacgtgaacgtataccagatcgtggccaaagacaccatcgaggaacgcatcctgaaactgcaggaaaagaaaaacgagctggcgcgccaattcaccgacggcaccgcatccggcggcgtcggcacgctcagcaaggacgatctgctcggcctgctgtcataacatgcccgctgtcgcggcgtgcgcaggctgcgttccgaatcgcaagacgaaaacggaacgcaggttgcgcatatcgcatggcgggcgtatatatggacaagcaagtttcagggaaggtgaaaatccttactggcggtaacggcacgaccggcattcataacggccccataccgaagcccgcgacccgcgaaagcggctgatccggtgagaatccggggccaacggttacagtccggatggaagaaacggagctcaacatgagtgtatcctctcctagcaatacctccaataccgcagctgatcaggccgcagacaaaccgatgacccgtccggacaacgcgcactccacaggcgtcgccgactccggccgctggtccaccaaacgcatcgccatgtacgcgctgttcgtggcgctgtccatggccgtcagcttcatcgaattcccgatcatcccaggcgtgcaatggctcaaatacgacccatccggcatcgtctgcctcgtcgcgggcttcgcgttcggcccggccgcagccgtcatcgtcagcgtgctcggcttcgtgccgcacctgttcaccaacccatggggcaccctgatggccgtgcttgtggcattggccctgtccgtgccggcatcgctcatctacaaaaagaacaagacgcgcaagggcgcgctgatcggcatcatcgtcggcgctgtcgtggcgctcgccgtcgccatcgtcggcaacatcatcgtcacgccgttctacgcgcacatgaccaccgcgcaggtcgtggcgcttatcgtgccggcgctcctgccgttcaacgcgttgaagttcaccatccacggcgtggtcacgttcctgatctacaagccgatctccaacctgctgaaccgttgagcttcgtttgtttcccattgaaatgaacatggagggaccgtacaggacggtggtgccggccggcagggtcagcttgtcgcccttctggtaggtcttgcccttgccgtcggcctgggtgttccagccctggaaggtgtagttggcgttggcgaacttgttcgcggcgatggcctgctcgctgccggcgggcgcggttaccgcgtccttgcccatatcgccggtcgcggtctcggcattcttgtcgtattggagtctggcgacctggacggggatgacgggcttgggcagggtgcttgtgccggtcgcgccagtgtttgggctggtgtgggtgacggtgttggttccggtgttggaataccagccgtgcttgccagcggacaggctgccggtgcccgggtctcccgtgtcggggccgggctgtccggcgacggcctgctggaggaccttgtcagtgggtttgacggggatcgtgaccgtgacggtctgggagcccttcagctggttcagcagtctcacgctgatgcggttgttcgcgtacgtgtactcgtagtccttgccctcaacgagggtcgtcgccttgccgccgtccgtgctcacgcccacgctcaggccgggacggcccttcgtatcggtggagaccggtttgacgttgccgctcagctggtcggtcagggtcacgcccttggcgaaaccgccggtcatcagctcattttcgacgttggattccaggtcctcggagacctggtcgccggtggaggagaattcggtcttcgccttcgcgccgaacacgtccttgctcagatgctccagcttcgacaggtcctggccgtcgcgctgcaaaccgatcgatgtgaagttctgaatgtggtcgccgtacgaggcggcgaactccctcgcgcgggacagcgcgcgggaataggcttcttcttcttctttgtagccatccgcgccagcccatgtgttggggtgtccgtcgctgaagaagaacacgtccgtgggcagctgctcatgcgccatcacgttcgacgcaccgtcgaacgcggcctcccagttcgtgccatactcggagccatagaagacgccgttatgagtagtagtagtagtagagacgggcaccatgatcctgtccaggtccgccgggttggtgctgtgcgtcaccatgttctcgtacccgtcgtaccagaccgaattctcctcccccgcgccgccggcgaacaggaccacgctcacctgcacctggcccgtcgccatcagacgcctgcccagggaacgcacagcgttcgcgatctcgtcatactcagcctggcccaccgaaccggtgcgatccagaacgaacagggcatgttccctgttcttcgcgtagtcacggcccgtggccgacaggttcacgtcgaacacgttcggcttgtcagtcgcggtcaccgtcttcgatgccgtcaggccgggctcgtcggtgtcggcggccaacgcggtgccggcgacgacgccgccggtcaacagggtcgccatggcggccgccgtcgcggccatccggctcaaccatttcctctgcttcataggaattcctttcaagcgcccggatcccttccgggcatacaactcccatgaaacacgcttccgacacaccccggtttggacatcggcggaaacccgaggacaggaccctccaatcggtgtcccagtccgcaagcatcagtttggacatagaaaaatccccgtaccggagaagccattacggggatcagaaagaaaacgaaagaatcagccgattggatagaaatacttcccgtcacaattcggatcgacggttaatacgtcgacggtattcgcgctcctcaatctcgaggatcacgcccgtgcgcgagagacaggacctctcccccggctccgacgcagcgttcttttcgttcatctcattcctcgtttccgtctttccatatcgtgcggtcgcgctcccattcccagtcgtgccgctcatcctgataccgcttccatttctcatgctcggcgttctgccttctctcgatggcctctcgttccatggcgcggcgttcgagcatgctcggacgcacaatcagccactcgcacagtgcgccgaccagggcgcagccgaccatgactgccacggcgtcccacttcacgcccttgttgttgatgagatcggcgatctggaacatcgcgagtatcacgaacagtatgcccgcgatcttcagcacgatctttgccaggaaacgtatcggatgcgacaggaactccagaaccacgctcaggaccatcaacacgatgaacgccgtcaacacgattccgactacagtcagcggattgctcatgtccatagccaaccccctttaatatctcttctctggatcgattttacgcggtcgcgccgtgtgcatagcatttgcattcaacgatggacatgacgccgtcccggccccgcagcaggatgtcgtatccaccgtccctggaggcaggagtcatctcggtcgtgtatccgagcgaacggaacatgtccgcgcagaaaccctcgaaaccagccggatggtcggcgaaagcggcgatgatgccatcgatattcgcggcacgccgccgctgtctgacccggaaacgtgaatccccgtggcggggatcgtcacggggatcgatgggtcaggacaggtacgagtccagagcgtcctccaatacctcctggatgcgcatgtcgtgcgcggcggcccaggtcttgagccggcgtcgggtcgaggcgcgaaggctcacgctggtcttcacccagccctccccggattccggtttttcggtatctaccggttccggtatcgcggtattcggtttttcggtatctaccggttccggtatcgcggtatccgtccggtcgctgttgagcagcatggtcaggtcgcgtggacggggcgtcaggttcatgttcctcacaggtcctcctccttgtccttgagctgtcgcatggtctgcttgagttcgccggacaggtcgcggtattcgtgcaggcgggacccgcgggggcgggtggatttcgcgttgaggatgtcctggcgtttcgggatcagcgtttcgaagcacgcgatgcccgcggcgtcgatccaggccagggcgtcgcgcagggcggtcgtgtgcgcctcggtgcggcacaggaggatcgcggcggagacgccgcgctgatcacacaggttcttcacgccggccgcctggtcgagatcgatgcggctggggctcgacgggatgaccacgaggtcggcgttgttcaccgattcgtccagcgcgcgcccgtacggggcggagtcgatcagcacccagtcgacggggtcgtcgagcctgtcgttgatcccgcgcaggtgcgtgatgtcggccggcgcggcggacatcacgtcgaacggcagcgggtcgtccagctcggcggccctgtaccaccagtccttcgcgtcgccctgcacgtccgcgtcggcgacgagcacatgctgctcgccccgggactggtccacgagggcgcaggccaggaacacggcgctggtggtcttcatgctgccgcccttgccggtcgccaacgcgatcaccatcggctcgcggttcttcttgtcgttcatcggtttctccttatttcggtatgtcggtatccggtttttggtattccggttagttggtttttcggtatttcggtttatgccgcgtcccacgcggatcgcgacgggaagcggtcagaagaggctgccctggaccaggcccttcggcacgggttcggtcggaaggaacagcggatcgtcggtcgcgtattcgcggcgcgagcgttggcggcgtttggcccgtcgccagtagtcgcggccatcacggcgcatgcgttcggcccagtccggatgttcggccagccagtcacggacccgactccgtgggatccggtgcaggccgccgtcggcgatgtggaggtcgcgggcgatcagtcgggcgagggtccagcggctcgcatagtcgagcccgccgtacacggccttgtccttccagccgttgacgagagcgcggctgatgcagtcgaggcgcatggggcacgcggcacacagcacgcggcccttgccgcgcatccgttcgtcgaccaggtcccggccatcgtcgtcggtcgtcgtgttccacatgcgatccgccatggccgggtcggccgcggcgatcctcgcgcaggccggcatcatgtcccgcccgttcatggccgccgtccttgcgtcatcggcgtcttgcgggcctggaggcgtcctatggcggtttcgccgggattgcgggcggcccatgcccgggcgtattggatcagcagaccgacggccttgggatggccgaggcgcttgttgcgccagtagacggcgtgcagctgccagatcaggtccgcgtgcccgtcgagctgcgggttggcgaggaggaattcgttgaaacccgcctcggaacagtcgatgcgcgtggtcatgccgtcgcctcccctccggccgtcgcgtcctggccgtccaattcggccagcgtctccacggcccagtcgggcagccatggcgcagcatccggctccgtggactcggccggcggaaccgtctgcgcgtgtgtgtcgccgtctgtgcggccggctgcgaggatcatgtcgtcgttgagttcgtcccagtgtctggcgagggcccggccggtgcggatgcgtttgggccaccaatcgccgttcatggcgaagccgatcgcgtcgaccatcacgagggtgggccattgcgctccctggtcgacgagcctgcggtacaggccgatgatggccttgcggtcggctttggtcggtgagggcgtggccaggccgagcatcgagcgctgctcgccgagcgaggcgaggacccgcccggccgcttcggcgatctcggtgtcgtcctcgtcagattgttcggttttctttttttcggcggcggccgccccgcttgcggggagatgccccgtaggggcagaggggaaggagggtttactaggagggtttacctggagggttttatccttatatatacagccctgcgagatttgcagtgctggaggtgcggcatttgcagtgctgggggtgcagctctcgcagtgctggccctgcgggatttgcagtgccgtttccgaatcgttttccagccctgcgagatttgcagtgctgggtatcggcttggttccaacgttttccggcagcacgtcctcggattcgccgttctcgaacacggttccggcctccgggtccacggtcttgcccatggtcgcgggatcccgttccgcggtgtgcgtctccccgatccacttgagggtcgacgggtcggattccaccgcgaggtcccacacaatctggcagtactggggcaggcggttccgtccgcccttgccgagacgcgcgtaccgttggtctccacggcggatgaacccgcgctcctggagcgtcttcaacgcggtgcgcacggtccgttcggacagttcggtgactgcgacgatggtcgcgatcttcggataggcggcggtgccgtcgtcgtccgcacggtccgccaaatagacgagcacggccttcgcggacgcgttgccgacatggcatctgaacgcccatgacaatgcgatgttgctcatgcgtccacccccattccctggaggacggcggccacatggccgagacgccgctcgagcgcgttgatgcgctcctcctgcgcgaggaccacgcccatcggggcgaggccacgggaggagacgccatggcgccgcgcggccggggacgccggcccgccggacttcccgtccccttccggggcgaggtcgcgccagcgcgcgacgcaccgttcgatcctcttgtatccgatgacctccggaccgagtcccgccttgcggaacatcgccaccggggattcgccgcgacggtagccctcggcgacgcggcgcttgaactcatccgtgtacctgatgcggtcgttcgtcacggacttgacggccggcaggcccgacacgtattccacgacatgctcatccatcatcattccgtctcactcccaccggcgtcccgcgtgcgattccgggcggccatccgttcggccatctcgtccccgagacgggccgccctgcacagggccagcgtcatcagccatgagaacgcgacgaacacgatcaatacgattgcaagccagttcacgcgagtctcccttccatggacgggtgcgccatcatcgacgccaggcgacgggaatcggtggaaaccggactattatggcgggcgaatgccgccacgaccgggaaagtccagaccggcgcgtggaaatcccggttacactcgggaaacacagagcaagacatgcggaatgctttagtaaagtcgttcatgtgtgatcactactccaagacaatgcattgggcggccacggaccgggatccggcaagatacgggatccgcggccgctcggaatattggttgcaccgcccgtccccgacgttccagcatcgggaacgggcgttttttcttttagttgcagagaaagagagaaaatcgaatgggatcagaccatcgcaccacctcccccgccgtcgacgggccacgcgccgccgcaacggatggcgaggcaaaggcaatcaagagcctgctcatcagggacatcaaagacttcgatcaaagcgtcccagcagtcgtcagacacgacgatggaacgatcaggcctacgtacataggcgtatggggacaggaccgtctgataggcgcggccctcatccagccagccctttgcgtagccgagacgctcatataccgcaccgggacgagcggggtccatgccgcacagatacgagaggctttcgccgagcatgcagccatcatcgaagggatcgcggtcgtcaggaagcatcggcgcgaaggcatcggatcgcagatcaaggcgttctgcgactcctgggcggcagaccacggcgctgaactgatactcagcatccccaccaacgagggcgcgcgcctgctcaacgagaaagccggatacacggtcgtaccgcccgacggatatctcaccatcaaggtatttgacgctcagggacagcctcttcacattccctacgccgaccagcggacccaggacagaggcactagcatgtgggcgtacaagctcgtagggcaacgcgcacagcacttcgagattggcgttctcgccgcctcctgaagttccgaagaccataccgtcgatgaatgttcccgacgggtcgcgggagaagacgagtcttccggcttcgtcgctcatgccgttctcccctcggtcagcagcaggttcgcgaccacccgttcgcgggcggagagctgtgcatcgacctcccggaaggcatgcgtgtaggcatgcgtggggtggagccaggtgtcggccagtccgcgggtctcgccgcggcgcagggcacgcacggcgcaggccgggcagagctccaaaatctccgtgtcgcccgggacgcagtagttgcgccagccgttacgggcgaaataagcgtcgcgggcggccgaatcgtagtcgtcccagaacgtgccccagaccactgtgtggcatccatcgcacacagtgacgcaatcccaccggctgtccggccattcggactgttcgtagattccaccagccatcacgcaacctcctcatcattgagattcctctggaaaccgagaacaaaatctgatgaaaggcctttttcctgcttaagaaaggcaaggtcacttcgattccagtcaaggtgaccattttccttctggctgagggtagatggagacattcccatttcagcggcaagatctttctgcaagatgtcatgatcttgcctccactgctttaccggagatgcatccatttcaaggcctccaatttcttttttccaaacgaatttctgttttctaaatatagtcataccttagaacaactttttggaaaatgcaaatttgcatgttacgattcagatatccaaattgttgaggagacgacaatgacgcaaaaaaatgaccgacgcaatcgcgcagagcagatggcttcgataatcagacagaatttgaaacgagccatcacccggcaaggagtttcacaacaagaagttgcacgtaaagctggcatgaatccagcatcgttttcccaaatgttaaacggcaacaaacgcttactgtttgaggatatgtacgcagtctgcgatgtattgggcttaaatattgcagatttgatggatgccacctcactccaaaatgagatgcagcaaaaagtagaggctttgcttaagcaagcgaatcagctgacggatcaagccaataatttgaaacaacaagctgtgacgctccagcatgctgacgctcttggcaaccaagcaaaaggtgctttggtaggtgtcggctcccccaggttccttgtcagtcccttcaaccccgacgccccgatcgagggcggaatctcgggtgctgctaaaggcgccttggctggtttcgtgccatccgtggtcccgtcaggctcgagttccccgtccatgccctcaaagcatgacgggattggggttcccgtccggtctcaagcccatgagacactaggaaccatgactacagttatcatgcgcacctccgaaggtgacatcaaaatcaacctgttcgacgacgaaaccccggaaaccgtggccaatttcctcggccttgccaccggcgagaaggaatggatcgatccgatgaccggccagccttcccatgagccgttctacaacggtctaaccttccaccgcatcatcaaggatttcatgattcagggtggctgcccgctgggcaacggcaccggcggcccgggctacgacttcgacgatgaaattgttcctgatctgaagttcgaccacccgtacctgctggccatggcgaacgccggcctgcgtcgtggcatggacggcaagatccacggcaccaacggttcccagttcttcatcaccaccgtgccgaccccgtggctcgacggccaccacaccatcttcggcgaggttgcggatgacgattccaaggcagtggtcgacaagctcgaagccgtgaacaccgatcgcatggaccgtccgaccgagccggtcggcatcgtgtccgtgaaagtgctcaagtaagcgtttcccgcacagccgtacaatatagggaagcccctcgattgaggggctttcttcattttatttatagaggcgtttgcttgcaatcaccggcttatgtgattcgtcaacatcacattttgcgcagtcgcggctccgcggaatccttcgcgccggtgatgcggtacacgtcgaacacgccttcgattttacgcacggcggcgagcagagtgttcagatgctgcggatcggccatttcgaagctgaattggctggtggccacgcggtcggtgccggtggaaatcgagccggagataatgttcacgccgtggtcggacagcacgcgtgtcacatcgctcagcagatgcggacggtcaagcgcctcgacctggatcttgaccatgaacacgcccttggtgctggtccactgcacatccaccacacgttcgggctggcgtttctccagttcgagcatgttctggcagtccacgcgatgcacggacacgccttggttgcgggtgatgaagccgatgatcttgtctccaggaaccggcatgcagcatcgggccagtttgacccagatgtcccccacgcccttgacggagatacccaacgagctggtggtcttcttggtacgctccacctgcttgagcggcaacgcctcctgctcgacttcctcatccacctcgtcgctgcccgcgtcacggaccagatgcgagatgacgttctgcgtggagatctggccatcaccaatcgccacgaacacggcttccgcgttggcaaggttcaactcgtcggcgacgcccaccaatgcttccggagtcagcagcgtggtgattggcaggttgcgcttgcgcatggcgcgcgtcagctcgtcacggccttcctcgacggcttcggtacggcgttccttgctgaaccattgacgaatcttgttgcgtgccttcgggctcttggcgaagctcagccaatcacgcgacggacctgcggattcggacttggatgtcaatatttcaacggtatcgccattctcgagcttggtatcaagcggcaccaatcgtccgttcacgcgcgcacccatggtacggtgaccgacttcggtgtgcaccgcataagcgaaatcaatcggagtggcttcggcgggaagcgagacgatcttgcctttcggcgtgaacacgtagacctctgccgcgcccaaatcctctttgagggagccaaggaattcgtcggaatccggcgtttcgctcgtccagtcggcaagttgctgaatccatttgaggttgtcggcctcgctcagctcctggttttcgccacgcttgcggtcggacttgtcaggcgagctcaacgcgcgtccggcttggccgttctccttgtacttccaatgcgcagcgatgccgaattccgcgcggcggtgcatgtcccacgtgcggatctgaatctccaccggcttgccgccgggaccgaccaccgtggtgtgcaggctctggtacatgttgagcttcggcatggcgatatagtctttgaaacggccgggaacagggttccaccgcgcatgcacggcacccaacgccgcatagcagtcctgaatcgtgtcgacgatgatacgcacgcccaccaaatcataaatgttggcgaaatcgtgcccgcgcacgatcatcttctggtaaatggagaagtagtccttcggacggcccgtcacataggctttgatgtgctgttcgtcgagatcctcattgatttcggcgagaatctgcttcaggtacacgtcgcgttgtccggcgcgacgggccaccaataccacaatctcgttgtagatcttcggatacagaaccttgaagctgagttcttccaactcggttttgatggcgttcatgccaagacggttggcgagcggcgcatacacatccagcgtttcacgtgcctttttctgcgcattcgactgcttgacgtaacgccatgtacgggcgttgtgcacacggtcggcgagcttgaccaccagcacgcgcacgtcgcggctcatcgccaccaccattttgcggatggtctcggcctgggcggaatcgccgtattccattttggaaagcttcgtgacgccgtccaccaggccggtcaccgtgtcgccgaattcggcgcggcattcgtcgagcgtgtagtcggtgtcctccactgtgtcgtgcagaaggcccgctgccacaaccagcggccccatgccaagatcggcgaggatctgcgccactgcaagcggatggatgatgtacggctcgccggatttacgccgttgcgacgaatgctggttgacggcgcgccggtaggctctcgcgagaatgctcatgtcctcgtcgggatggtggtattcgcacatcttgaggattggttcaagcgggtcaagcggattcgtgctgatctcgcagcccaacattctggccgaacgaacctcatgatccatgtcgctcatttcgctcctcctcgcttggaatgtaccctatagtacccgcgcatcaccatatgacggatgtatccggccgcgtgttgcacggccggatacatcctcggtctttgtgtattgcagtcccgtcaggacgcaacgccggttgatccgaagccacgttccgcgcggtcggatccgggcagggtctgcgcctcgatgaattttgcctcgacgtagcgttggatgaccagctgtgcgatgcggtcgcccggatggaacgtcacggcgcgttccggatcgaggttgatcaacggcaccttgatttcgccacggtacccagcgtcgatggttcccggcgcgttaagcaccgtgacgccctgcttgacggcgagtcccgaacgcggatgcaccagcgccacatagccggcaggcaatgcgattgccactcccgtgggcaccagcgcccgctggaacggcttcaacgtcacttcttcggtggtgcgcagatcggcaccggcatctccggcatgggcgtaatgcagctgagccggctgcccgggatccagcgactttaccagaacctcgacgttttccggctcgttgtatgcctcgtcgaacgccatcaggccgcacactccttgcataccggctgtccgtcgtcggtagtgtaggcaagctggctgcgatgcttcaccaggaagcattcggagcagatgaactcgtcgccctgcatcggaatgacggtcaccgaagcgtcctcattgctcaaatcggcgcccggcagctcgtagtcttcggcaatggcgttctcgtcatcgtccatatcgttggaattgttctgagaacccttgctcaaagcctggagcgactcctcgtcctcgtctttgttgcgcggggaatcataatcctgtgccatcgagattcctttcgtcatctatggtgcttatgcgccatagaatacatgacttttcccccgctaggatacacgaattgaaatactcgtaaaatccgacacgtggggcacaatagaattaatagaaaaatctaagggaaagtggtgtgttgtgcctgagaatgcgctcgaagatgcacggttcgatcatgtgagtgaaaccggtgagctcgtctttgtttcaggtgccggcaaattcgccgtcaaggtcgatgaagcgcttgaaagagccattttggaggcaaaacagattcgcaccgaaacccaagaggagcgtcagcagcaagcgccttccacgctgccgatctcccaaatccaatccttgattcgagccggagccaatccgacccgcgtggcggagcgatattcgttgagcgaagcgcttgttcggcgtttctcggcggcggtggaaaccgaaaagcaatatgcgatcgaacagttcctggcggttcccgcgccgaaggaaagccgtgtgcgcacgctttccgaactgatcgaacgcactttcgccgcagcccacgtacggttggaggatgtgcggtggaaggccaccagacgcggtttggaaccgtggaagattaccgcggagttcgattccgcaggtcatgccgcccgtgcggaatggtcttggaacatgcatgacaacgcggtcaactgtctgaacgcaacggcacgcaagctcatcggcgagcaagacacgcctacggaaggacacgccgagaagcaggtcgaccagaattttctcgcatcattgaatttgccgggcgattccgcacgttccgcacgtatcgaacagacggtgtccgcttggaatgctccggaaccggttgcaccacaagccacgaatatcaagaccaccgttgagactcagtcatcggcgaccgttccgctgccgaaccgtccggaaatcgcgacgacgcagtcccccgccccttcaacgacggaacctgcccaaaactcgcaaaacacgcaatccgccggcgagcagcagtccgataagtccaagacggcatcatccgatcctcatagtcagagcaccaccaaatcgaagcgccgtgcaggacgctccgcagtgccgagttgggatgaaattctgttcggtgactgattaacgttccctaacatcccacggcaacatccgttcagacgttcggatcattcgatcaagccacgtcaatcaggcatggaatatcagattccatgtaggtcagcgacccgtgcacgctgggcagatgcatcgccttctccgcctgtgtgcgggaatcgacaatggtggtagagcccgcagcggagacgaccacatcgccgatcatcgacttgacgcgttcatcgactggtccgtagacgccttcctcgattgcctgccggcgggtgcgcacctgggcgcgctcccccagcacgtcacgccaacgagcggcgatgtcctccggattctcgccatcctcgccataaagcatgacacagcgtggttcgccgccgacattcgcgacgccccacatcagctggggttcggacgctatgtcgatgcaggcttccgggtcggcggttatcatgccatgatccgccacgatgacgatcagcgtgttcttcggcacacttcgacgcagcaaagacaactgggcgtcgatacgctcatatgtgccgatccacttgtcggagtcccagccgtaattgtgtccgatcttgtccgcgtcgcgcaggtacacgtatgtcagtccgggcgtgttcgccgctttcgccgcggtcatgatacgtcggcgtggatcgtcattggagatgtagtcgctgccacgtaacgccgcctgagtcaacgcggagaacgcgaatttcagcagtcccgaactggtgacgcgaacgtcctgttccgccaatcgttcgaatatggtcggctgctgttgcagtttcagcggtgcgggcgcgtttttgaaagagatgagctggcagatttcgccattgtcgggattgagctgcgtatatcccgtcatgccggttaatccggggcatgtgccggtgccgaacgtggacattgcggccacggtggtgctgggcatgcatgtggcgattggccgctggttaacgccatccgccatcagcgaccgtagatagggtgaatgccccaatctcatattgatgttccaatatccgagaccgtccaccaggaccacgactgccgaacgcgcgtccggcaggccaagtgcctcttggagtcgtttcggatcggcatggatggccgttggaatcggatgcccgatggcgctggaaatggcgggaagtaccgaggataggtggagagcaccgccgcggccgccctcatccggcagttcgtcgccatatcgtgccggactggtcatggctagcagctggtcgatttcgggcacttcaacactcatggttcccattcaagcaccgcggcagtaccagctggtaatattgctaggttgattaccataacctttccgtgaggagaaccaccgcatggtgtcgcaccgcaaaccggcaaaaccagcctttgacccgcgtacggtcaaggagaacatcgtcgaaacgccgttgaacgaggaaatgagcaagtcgttcctcgaatacgcgtattcggtgatttacgcccgagcgctgcctgatgccagggacggtctcaagccggtgcaacgacgcatcatctatcagatgggtcagatgagcctcaatccggaccggccgtatatgaagtcggcgcgtgtggttggcgaagtgatgggcaagctccatccgcatggcgattccgcgatttacgaggcgatggtacgtttggcgcagccgttcgcgatgcggctgccattggtggacggtcacggcaatttcggttctctcgatgatggtcctgctgcttctcgttataccgaggctcgtatgacgccggccgcgttgggcatgaatgccgatatcgccgaaaataccgtcgatttcacgccgaattacgataacaagcttcaggagccgactgtgctgcctgccgcgattccgaacctgctggtcaatggtggttccggcattgccgtcggcatggccacgaatatggccacgcacaatcttggcgaggtggtggctgcggccaagcatcttatgcgccatcccgacgcgacgttagaggagttgatgcgctacgtgccgggtccggattggccgggcggcggcgtgattgtgggccgcaagggcatccgcgaggcgtacgagacgggtcgtggcgcgttgaccacgcgttccgtgacgcatatcgaaaacgtgacggctcgcaaaaaggccatcgtcgtgacggaactgccgttcatggtgggtccggaacgtgtgttggaacgtatttccgaaggtgtgaagaaccgtaagctggacggcatttccggtgccatcgatttgactgaccggcataacggcacgcgcctcgtcatcgaaatcaaaaccgggttcgatccgaacgcggtgttggcgcagctgttcaagcacacgccgttgcaggacaatttcaccatcaacaatgtggcgttggtcaatggccgtccgcacaccatgggattgaaggaaatgcttcaggtgtgggtggaccatcgtcgtgtggtgatccgccgacgcagtgaattccgcaggaagaaggcgcttgagcggctgcacttggtggagggcttgctgctcgccatggtggacatcgatgaagtcattcaggtgattcgctcttctgatgatgccgaggccgcgaaaacaaagcttatcgccgtattcgatctggacgagattcaggcacagtacattcttgacttgcggctgcgccgtctgaccaagatgagtcgtatcgagcttgaggcggaacgcgacgatctgaagcggcgtatcgaagagcttgaacgcattcttgcttccgatgaggcgcttgacggcgtggtcattgacgaaatggatgacgccgtggccaaatacggcactccccggcgcacggtgctgctggatgaggatgaggaaggcaatttgacgcctgttgtggcgcatggcgatgatggcgtctctgcaaacgcgatggctgccgcgcgcgccgccgcgaccgtatcctccgcagcagccgatgtcgccgcagccgcaaaggccgcaaagaaggccggcgatgagaatgccaccgcatcggctctgcagattgatgacgagccgtgcgcggtgatgctgtccgccacgggcctgatcgcacgcacttccgaggatgcggtggaacgttgggagaatcgttcggcttccgacggacgtgccaaggatgatcagatcgtttcgatgttccgcacgtccacacgttcctcatacggcttggttacttcagcgggtcgtctggtgctggcccatgtggtcgaattgccgaaggtttccgcggatgggccgctcagtgtcacgggtggtgtgaaggccgaggaactgctgggcatgacggagaacaccgatccgatccgcggcgaacgggtgattgctgcgattgatatgccttccacggatgacggcggtcagcttgttcctttggcgttgggcacccgcaacggcgtggtcaagcgttggaaccgtgaatctccgaccacaatggattcgtggagcgtcatcgatttgaaggatgatgacgaagtgcttgccgctgccgaagcccgtgatgaggatcgtctggtgtttgtgtccaccgattcctcgttgttgacgttcgaagcgaagaatgtgcgtccgcagggccgtaccgctggcggcatggcgggcattcgtctggctgaggggtgttcggtggccgcgttcgcggtggtgcctgatggcaaggtgacatggaattacgaagaaggcgagaatggactgttctctgcttccggagccgtggtgttgacggttgccggcgattccgaagcgttgcctggcactgaaaacggtgccgcgaaggtcacgccgttggagatgtatccgacgaagggccgtggtacgggtggcgtgcgttcgcagcgattcctcaaggggcaggatacgttgattctcgcgttcgtgggcgcgtatccgttgcatgcttccacgcaaagtggcgctcctgtggaattgccgaagcctgatatgcgacgcgatggttccggtacggatctgtcggcgccgattgcggtggtcggctgattcgacgaaatcgattggcggggctctggactggttcttcttccggttcagggccttcccgttttgcgcacttgggccgccaggttgaatgagcaggctgggtgaaagtgcctccggcttggttcagccatatagcttcatgccttgtgggctgtccacgaacccggcagcatgcagcaaacgtctgtattcgttgcgttccttcaatgattcaccgttcatttcggcgaagctgacgctgcccttggactgatgctgcaatgcataggcaagttccgtacatgccggctgcaatattcgctcgtcatcggtgaagctgacgattctgtggcttttcggcacggcaaacagcaccggcatgccgtggtcgagcacgatgaccgattccgctctgcgcgccggtttcatatggtgttgttcgggccatgtgatcgcggagcctgtcaggttggccgggtcggtcacgtcaagcgccacgcaggattggctgcgcgcctcgtcgtcgccgcgcaaggcgtccactgtgtcacgtccggcgaattgggccgctccgaatcctttgacgaacatgcctctgaccagattgccgtgttcctccatacgtttgagtactgggtatagtccggagaatccgcctgcgacctgctccttgtcgattagcggagcggcgatcacgccatatcggtcgagcagcgattcgatcaatgcgatgtcgtattcctcgatgccggctgttggtttgccggcggtatcgtccgcttgatccggtatcgccattggactggtccgggacgagtcgaccgcggaccataatccaccgagcgtcgccggtgtcgaggcgtggatccgtacgcgtctgcgtgcggcagtgcgtggcgcgcgcactgaaaccgtgccttgagtcaaggcccgaacgggagcgaatgaactgttcgtcactttgccttgccataccaaggaccacaaggcttcctcgaactggctttcgccccatgcgggaaggatgatttcccctgtttcaggattcacgttgacttccgcatgttcctgccagatgactttggcggctgtggaaagctgccgcgcatggaaggctcccccattcgataatgcggcaagtatcgtctccggcacggtcatggttccggcactataggcattgttctgcgattgttcgccgggtttcaccagcagccgtgaatcagctggatggaatgcgatgccgccggcttccttggcgttggaaccattgattttggagccgacccataccacgtctccggatgcgagcagttcgtccaacatactcggttggtagtcgcgaacgcgtgcggggaagaccgaggattcccaaacggaggcgttgaggtatatgccttcaagctgttcaatcacacgcatcagcccgtcgacgccttcatatcgggcgccacccacaggtccgacaccttgtctgtccaacaggaacgcctgatagacggccggttccaccggcttgatggctttgcgtgccttggcaagcgaaagcgcgcggatacgccgaaacacgtctttgtggagccattgctggggcgtttgccgaggtgaccgttccgatgctgaatcatcggaaccattggcgtccgctccggccgcatcatcgacgaaatggcctttcagcagttcgcctttggcatgtaattcatccaacatgcgtacgccttggacagcgtccaatcccagttcggcgatcatctgatccgcggtgaatgggccatgcgttttgacatatcgcgccacacggccggcaatgtcggtctcgtccaaatcgttccagaacgtccgtccggcaagctccttcccaacctgcgcgatgacgtcggcatccaacagcgaagccatgtccgtggctcccagaagacgttccagcacttccgggtccatggacagcagttgcgtactgcgttcggcttgcggcacgtcgtattggtacatgaccgcgcccacgtatccgaacagcatgttttccgcgaacggcgacggcgtttccgtgacggtctcgctcaaagagatgacgccggagcgtaatccggacatcacatgtttcagcgcgggcagatcgtacacgtcctgtaggcattcgcgtgcggtttccaacagcaacgggaagttcttccgagttcgggcggcgttgagcagttgcgccgcgcgcagccgctgctgccataaggggacgcgtctgccggggttggcgcgtggcaggaacagcgatcgcgccgcgcattctcggaatcgtgcggcatacagcacgctttcgccgacttgtgttccgatgatgcgttgcagctcttccgtgtcgaacagcagcagctcgcggatcggcaggttgccgtcgccgtccgggaggcggatgatgatgccgtcgtcggccgcgtatacctgcccatcgaacccgtatcgttgtttgatacgtgtggtgatggccatggcccatggttcgtgcacgcgtctgccgtatggcgagtggacgatcacacgccaatcgccttcttcatcctggcagcgttcgacgaccagctcacggtcgttgggaatcgttcccgtggcggcgcgctgttcggcaagcaggtcggcaagattgccgatggcgttgtcatccaatccgtcacgacgtagacgtgcgattgttgtcgtgtcgaatcggctggtcttgtctcctgcgatgccgtccgagacttccgcgcgtaatccttgcgccatatcgcgtatgaatcggccttgggaccgtccgaatgccgcgtcccgcccgtcgccttcgccatgccagaacggcagtcgggcggtacgtcctggagcaggaaccaccaccacacggtcccgggtgatttcctggatctgccaggtcgatgtgccgagggtgatgacgtctccgacccgggattcgtacaccatttcctcatccagctcccccactttgcgtgggcccggtccggagccttcttcgggaagcaccacggtgtaggttcctcggtcgggtatggtgcctccgctggtcacggccagtcgttgagcgccagggcgcgcggagatgagacccgcctcttcgttgtattgcagtggtggccggaaggcggagaaatcctcgccgttgtaggcgccggtcatcatgcccatcacagcatcgaacatggttctgtcgagatcttcgaatggcgcggccttgcgcacggtcacgtaccagtcgtctggtttcagatcatccatcgccgcggcggcgacggtttgctgggcaagcacgtccaaggggttgcatggaatggtcagtgtttcgatgtctccggagcgcatgcattcgatgcttgcggccgtgccgatgatttgctctcgtgtaatcgggtagaacagcgcatgcgagactcccccgaccttgtggtcggcgcgccccacccgctgcaatcccgaggacacggacaatggcggtgcgatctggatgaccagatccaccgaccccatgtcgatgccgagttcaaggctcgacgtggcgaccacgcaacgcaattggccgcgtttgagctgctcctcgatctgtttgcgccggtctttggaaacggaaccatgatgcgccatggcgatcgcgtcggcgtccgcatgcgaggagaccagcatggtggtggagccgaccacggaatcgtagtgtttggcgaagccttcacggccttccggggagcccagatccggatacggctgggtggaatcactggctgtggactccggctgggatgcgttgtccgacacactcaaggccgttcggccaagcctacggtcggacagcgcatcccaccctgcgtccgctttgacggcggtttcagacccagttttccgggatgtgcgcaattgcgcatacaggtcgttgagccgtgcggtgagtttttccgcaaggccacgggagttgacgaacacgagggtggtgtggtgtttcagcacttcgtcaagcacgctgcgttcgatggccggccataccgaacctccggtcgaaacccgtgaggtatgttcgtctcccccgcccgaagtcagtcctttacgttccgccaatgcctccatggcagggctcaccccggaaatatgcgtggtatggcggttcggaagtttcacggcgcctgcccgccgcccggcgtcgtcggagacgggatcgcgcatggccgaaagcggttccaccactttcagatccatgtcggggtgcgattcgggtctgatgacgcgtaccggccgcgtgccgccaaggaaacgtgcggcttcggccggcggttccacagtggcggaaagcccgatgcgttggacagaccggccggcaaggctttccaatcgttccaagctcagcgccaggtgcgcgccacgtttggagcccgcgatggcgtgcacttcatccacgataacggtatcaacggcggaaagtatccgtcgcgccttggaagtgagcagcaggaacagcgattctggcgtggttacgagggtatccggcggatggctgacgattctgcgccgttcctgcggcgtggtgtcgccgcttcgcatgcccacgctgactttcggcgatggcaatcccatcgcctcgcactgtccggcgatgccggccaatggcgcttggaggttcttggccacatccacgcccagagccttcaatggcgaaatatacaggaccttgacgccgcggacgggtttacgtttcttggcattgcaatcggattcagccgtgccgtccccaccgccggacgtccgcaataagtcatcgccctccttcgtcatcagacggtcgattgcggaaaggaaggcgcacaatgtcttgccggagccggtgggcgccaccaccaacacgttctcgccggagcggatggccggccatgccaaacgttgcgcctccgtcggagcattgaacgcatgcttgaaccaggcattggtagcctccgagaacaagtccatgcattcgtacatacgttcgattatggcatcgccttcagacatcatccacaaccggcagaaaccccgtcattcgtcgtcgacccattcgagcacaccgcccggctgacacattcgagcgtctcacatatggcgtcgtcaggcggccgcacggtcgccgcacttgcggcgcaaagtctcatgcatggcgaccatcagcgccaggaacaccaccagataggacgggaacaggttgaccgaaacatgctgcgcgatcagcccgaacagcggcggcatgcacatcgaccccacataggcgaatgccatctgcatgccgacgatggcctgggacttgtccttgccgaaataggtcggcgtggagtggatgacgcatggatagatcggcgcgcatcccaggccgatgaccatcagtcccgcgatggtgccgatattgtgcggcaacggcaggagcatgatgacgatgccggtcagcaccaacgcctggccaagacgaatcatggccggatcgttcagtttcatggtcaggaaaccgctggcgagacgtccgacggtgatgccgatgcaaaacaggcttccccacatggccgccgtggtcttgtcgatgcccttgccaagcgccatatagctgctggcccacaacatggcggtcgattcgagcgcgcaatagcagaagaacatgacgaggatctcgcgtgcgccacgaatcgcgagcacgccacggataccgagcggcttacgcggtccgtcaccctcagttgtctcttcggtgtcttgtgcggtgcgtgtcttccacagtggcaggctgaaaaccagtaccgcggtaagcgctatctgcaggatggagatgtaccggtatccccacgaccagccttgacccgcgcccaatgcatacgccatgatgtacgggccaagcagcgtgcccaatccccacatggcgtgcagccagctcatgtgacggctttcatagtggatcgcgacatagttgttcaacgcggcgtcgacgccgcctgctcccaatccataaggaatcgcgaacaacagcagcatccagtaattcggcgcgatcgagaaaccgaacaaagcgaacgccgtcaatgccacggataccacagtgaccttgcccgcgccgaatcgcaaagtcattcgatcggacagcaacgcggacacaatggtgcccgccgaaatggtcatggaaatgccaccctcccaggaaacaggcgcattcaaatcggtgcccatcgtcggccaggcggccccgagcacggcatccggcaagcccagactgatgaaagccacataaatcacggcaagcagcagattagccatgaatcagctcctttgatggttccatggacgcgatggtccgaattcgtcatacagtttacccgcagttacctaccaaacggtaactagcgatttgcggtaccgattcaacgtctgattccggtcgaagcatgattcggtcttgttttcggtcctgttccaagaagcgagcaggcgttggttccggcaaaaaatgcggaaggcgggtttcgacggaacggaacctacctcccatgcaatcaagatcaggtgtcgatcttggaacggtcgaaatcgtcggcgttctccacgatgaacgccttgcgcggcggcacgtcatcacccatgagcaggctgaagatgtggctggcctgttcggcgtcctccatgcggatacggcgcagcatacgggtgcgcggatccatggtggtatcggccagctggtcggcgtccatctcacccaaacccttgtaacgctggatgtcctcgttgtagccgatgtgctttttatcaagctcggcgagtttgcctgccaactcatcatcggaatacgtgtagatgtactcgcccttatgcgtacccgtcaacgcgatacgatgcagcggcggcacggcggcatacacatgaccgtattcgataagcggccgcatgtaccggtagaacagcgtcagcagcaggatgcggatgtgcgcgccgtcgacatcggcatcggtcatcatgatgatcttgttgtatcgggcctgttcgatgtcgaagcttgcgccggaacctgcgccgaccacctggatgatggctgcgcattccttgttggacagcatctgcgcgagcgatgccttctgcacgttgaggattttgcctcgaatcggcagcaacgcttggaaaccggaattacgggcggccttggctgtgcccaatgcggaatcaccctcgacgatgaacagttcggctacatcgtcattgccgggctggcagtcggacagtttcggcggcatggacgcggattcaagcgcgttcttacggcgtgtgacttccttggtcttgcgcgcctgcacgcgggcatgcatttcgccgacgattttctccagcacgcggccggactgttccttgtaaccgcgtttggagccggtaatcatctcaccgaactgcttatcggtcattctggagacgatcggcttgacttgcgcggtgccgagcacgtccttggtctggccttggaactgcggttcggcgatgcggacggtgacgacggccaccagaccggcgagaatgtcgtcacgttccaccttcatatgggaatccttgagattcaccttgagtttgcgcgcgttgtcctcgatggccttgcgcacctgcttggtgatgccttggaggaagccgtccacgtgcatgccgccgccgggcgtctccaccacgttgacgaagctgcgcatggtggtgtcgtagccgttggtccatcgcatggcgatatcgactgcgcaatcacgcgtcaccttctgcgcatgcagttcaccatcgtctccgaccgcctgcgtttcttcaacatacgtgtcctcgccggcgatgcgccaaatatcggagaccgcttcgcctttggacaggaagtcgacgaaatccttcacgcctccggtatggcagaattcttcgacgcgcgcatgcggatatttcggctgcacgggttgggaaacggtttcctgcgattgcgtggcagcatcgttttcttgcgattcggctgattcatcagcttcggctgaatcctcctgcagtatgtcggcagaggttccgatatcatccgtttcagcggacgtgttctcttccgtcacctgttcgatgacattgtcatcgacttccagcatttcgtcaatggactcgtcgccggtttcgggaatgttctcgtcgatgacggtgattttcagccctggcaccaggaaactggtctgccgtacacggtcgatgagctggtcatagctgaattcagcggtgtcgttgaaaatctccggatccgcccaatagcggatgcgggtacccgtggtcttcggactgactttgccgatgatctcaagttcggtgggacgattcttgcgcgtcttcttgaatggcgaatcgggagacgggtgttccggatcaacgtcggaatacactccggggtggccctgatggaaagccatgtggtgggttttgccgtcacgatccacttccacgtcgagacgggagctcaatgcgttcacaacggatgagccgacaccatgcagaccgccggaagcgccatacgaggaattgccgaatttggcgccggcatgcagcttggtcagcaccacttccacgccggtgagcttggttttcggctccacgtccaccggaatgcctcggccattgtccgccacttcaacggaaccatcgtcatgcaaggtcacgatgatgtggttgcaggctcccgcaagagcctcatcgacggcattgtcgatgatctcccacaggcagtgcatcaggccctggctgtcggtcgtgccgatgtacatgcccggacgtttgcgcaccgcatccaagccttcgagcacggtaagactctcagcaccgtaattatccttagccatgttccctttcaattgtcgccttacaagacatgaagtcgagaaaccctgcgttcatgccggtttctcgacttcatttactcgcgtctgattactatcactggtccaggaagtcgcgcagcgtctgcgaacgggacggatggcgcagcttggacatggtcttcgattcgatttggcggatacgttcgcgcgtcacgccatacacacgtccgatatcatccagcgtcttcggctggccgtcctccaaaccgtagcgcatcttgatgacgccagcttcacgcggagacagcgtttcaagcacctgcttgaactgctcctgcaacagcgagaaggcgacggcatcggacggtgcgatggcgtcggtgtcttcgatcagatcaccgaactcggaatcgccatcctcgcccagcggcgtgtgcagggaaatcggctcacgcccgtacttctgcacttcctgcaccttctcgaccggcatgtcgagctcacgggccagttcgtccggtgtaggttcgcggccgaggtcctgaagcatctggcgctgcacgcgggacagcttgttgatgacttccaccatatgcacaggcacacgaatggtgcgggcctgatcagccatggcacgggtgatggcctggcgaatccaccatgtggcgtacgtggagaacttgaagcccttcttccagtcgaacttctctacggcacgaatcagaccaagattgccttcctgaatcaaatcgaggaacagcatgccacggcccgtatagcgcttggcaagagagaccacgagtcgaaggttggcttccagcagatggtccttggcgcgcttgccgtcgttcgcggcccacttcagttcacgccggcgcttgaaatccatcttgtcggattccgtgtccagcagatgttgggcgtacagaccggcctcgatgcgttcggacaggtcgacttcctgttcggcgttcagcaggttcactcggccgatctgcttcaggtaatccttgaccggatctgcggtggcgccggctgcgatcacacgacgcttcggattgccggacggcgtcagattgtcgtcgtcatcatcgtcacgcaccacgaaagcgcctttttccttgggctcttccggctttttgcgcttgtcttcgtcatcgtcttccagttcggaatcgtcatcctcgtcgatattgtcctcgtcgaggtcgtcaccctccccttcgtcgtccacgtcatcaaggtcatcgtcgaaatcatcaagatcggcatcctcgacgggatcgtcttcaggagcgtcctgctcgatcaggttctcttcttcttccgctttcttgcttttcttggcggcggaggtcttcttcgcggccgtcttgcgcgacgtcttcgtagcggtctttgaggactcgctcttcttggcagcaggcttgcgcgtggaggccttttttccggaggtggtcttttcggtcagatcagtctgttccgtatttaccgtcgtttccttggtggccaaacttatcctcctattgatcccgccggaagcgtataccatatggacccacttctggcaagggcaaatcgtcaactatgtgagttaaccatcttgcgaggacgattattcccgcgtgttgagctcaccatgcgcaagtaccgcttcctttcggcgtgttgctctatgtctcttcggcccatgccggtccgatatgacgatgcgccgcggagcagatgatcgccgcgagcgaacaattctcatccaacgcgagcgcacgcatcgcgcacagcatggcgcgctcatcgcccatccaccacagcacataactgatgatggccaatggctgcacatgataccgttcggggaccatcccgatgatgtcgaacatcatgttgacgccgttgtcgcaacgtttcgtgtcgggttttcttgatgcgtcacggaacgatccgttgagggattcctccagatgacgcgtgttgccgggaagtgtcggattggccatgaatcccatgagaaagtcacgtgacgaacgtcgttcatccacgatgatggagaccagcagcgcgtcacgcaccgccatggtctgctgcatggcgatggcaagtgctcccgcaccgtttctggacagtctgcattctggcgatgaatcgtcacctcccgacgattcatcggccagctcatccatccattccgagaatggctcctgcaggaaatcgcgtatgctctccgccatgcccagcgatttgcaatcctccaccaattggtcttcaagccgttccatctcggcttcgcatatcggcatgggctcgtcgatcgtcttcatgtctcgtcctccttggcgtatcggagcggtcgcttgatgcaggccgctttgttggaactatgcatcatccggcaatgcaatgaggcgtttcggcacccctgtggtcggagaacgtgaagctcggcgtgtcacgaaacgtccggcaccgtctcacccgctgcaatcattatgttttcctcttgtcgaatgtgtgtggataaccttgacccatgactagctcttccgatttggaacagattgaaacgcgcacgctctcgctggtaagggatttttcgttcctgcatgcggacgatccggtggcgaattcctgcaaagccgtcgctgatgcggtggcgcagcaggcggtcacgtcaagtgagggcggcaaacgtctgcgggcattgctgacgttggatgcgttccgtgcgttcgcgccgcaggatgtggcggaacgtgatatggatgcggtgttggatctggcatgcgcgatcgaagtgtttcagaccggcgcgttggtgcatgacgacatcatcgacgattccgatctgcgccgtggcaagccgtccgctcatcgtgcgcttgccacggatacccatagtgatgccatcggccatggtttgggcatcatgttgggtgatatgctggccaccgcgagcgtggatatcgccaataaagcggcttgccggcttggctccggatcttccgtggtgtcggccttcctgaatatgcaccgtgaagtggaaatcggccaagtactcgatttggccgtggaactcaatacgttagacgatcctgaagagctggcgtcggcctctttgaatgtcttccgttggaagaccgccagttataccactatcgcacctttggaattcggtatgcttgccgccggcctcgcccctgcggacgcgcgcaggctcgcactggcgattggattgcctcttggtttggcgttccagctcgcggatgatcttctggacgtcatcgggtcgagccgcaataccggcaaaccggtgggcggtgatatccgtgaaggcaaacgcacggtgttgctggccgatgcgattgaggctgccggcgatgtcgaacgacgtgaactcatcgacatgtgggaagccgaatcacgtgacgaggcacatgttaggcgtgccatcgcattgttcgagtccactggtgccatcgcacgttccaaggaacggatcgccggtctgtggctcgagtcgaaggccgccatcgagacgcttgaactatcgcaggatcgcaaagacatgcttaccgaagcatgcgcacgtttcgtaccgattgtgcgggaacagggctgatgccgccgcactgtgaaagacccgtgttcatcgcatcttccgcaaaccattccttgtagactacaagtgaacacatctttgtcgcgaaacgttttttgaagaaggaatcgtaccgattagccatgagtgaagcccagcatgcccccgaaggccaggtcatcgaaggccggtaccgagtcgtcagcagaatcgccgatggcggcatggccacggtgtatcaagctgttgacgagcgtctgggacgtaccgtcgccattaagatcatgcacacgcagctggcacagggcccacaacgcgaccagttcgtggaacgtttccatcgcgaggcccgttccgcagcagcaatagccaatccccatatcgtgcaggtgtatgacaccggtgagttcgatggactggattttcttgtcatggagtacgtgcatggcgtgaacctgcggtacgaaatgaaccagcaagtcacgttcagcgttcgtgagacgctacgcatagtcggtgagacgttggacggcttggcttcggcgcatcgcgcaggcgtggtgcaccgcgatatcaaaccggagaatattctgctcaatgaccgaggacatgtgcagatcaccgatttcggcctagccaaggcggtgtcgcaggccacgctgtcctccaccggcatgctgctgggcacggccgcctatctggcgccagaaatgattcagcacaatcaggcaacgccgcagggagacctgtattccgtaggcatcatggcttgggagatgctggccggcaaggtgccgttcaccgcggacaatccggtgacgctggtgttcaagcacgtgcatgaggatgtgccggatatcacgaccgcttgtccgggcatcaatgcaggcgtggccgcattcctcgcccgtcttacggcgcgcgcggtcgaggaccgtccccaggatgcgtccgtggcattcgacgaattgcagcagttgcaatcgaacctcaccatcgacgactggcaataccgtctgtcagccgtttccccggccgcaaacgatgccgccgacaccatgcccggcgatggcacccggcggatgccgctaccgcccgctcccccagcaccgcctgtgcgtcagaacgacgatcgtacacgacagttcaatccggaaaacccgaacaaaaccaccgtcatgccggcgcagcaggcagatccggaggcaaccacccgcttggctttggaaaagaacgacgtccccgccaacaacgttccagcttccccctcgaacggtccggtcagtggtggacagccgaaacgcagtggcaagcgtgcacctgtcatcatcgccgtcgtagcaaccatcgtgcttgcctgcgcaggcggtggaggctatgcctggtggtatttccgaggaccgggcagctactggaccatgcctcagccggcagatctcacatgttccgattcggagccctgccgtatttccaacatcaaatggaacgcctatgaggaactgctgaaattctccaacatcgagtacgaagagaccgaggcgttcagtgattccgtcgaggctggcaatgtcatctccaccgacccggagaatgtcggttcgcatgtgagcaaacgtcatcatcagaaggtcaaggtggtagtgtccaagggtattaagcagggcactgttcccacagacattctcgatgccaccagtgcgaacggcaaggatccgatcaacgcgttgaagcgtgccggtttcgacaacatcgaacagactccggccaatgatgacgcgtattccatggacgtacctcagggcgcgttgcttgatttaagcgtggatcccggcgcgactctgccccataacgcgaagattaccgtcacgctgtcccaaggaccgaaaccggttaccatgccggacgtcgtgggcaaatcgaaggatgaggcgcagcagacgcttgatgcgctcaagctcaccgtcaactggaccgagcaattcgatgacaagattccgcaaggacaggtgatttccgcttccgcgaagaccggagacgagttgcactggggcgatagcgtcaatgcggtggtgtcgaagggaccggaaaccgtaacgctgccgaattatgtcggacagaaagccgccgctgccaaagccgcattggagaagctgggattcagtgtgaagatcagctcgcaactgacacttgactccagtcaagacaagaaggtcgcttcgcaggatccggtaggaggcaccgaggtgcgactgcgtcaggaggatggcacgccgaataccgtcaccttgaaaatgtattcgtcgctgttcgactgattatcctgattacaaaatagaaatcaggggtgtctgttccgaaaacattcttcggaacagacgcccctgattggtttggaatgaacctcgctgaaaacttatgccttcttggcagcggattcagcttgtgcctgcgcttcggcctcctgctgggctttgagctcggccttgaccttctgcgcgtattcgtcgacgtattcctgtccgctcatcttctggatctcacgggtcacgcggtcggtaagcgaacgcaaatcatcgtgggtaatctggtcggcggatttcttctcgacttcaatcggcttgccgtaaatcaccttggacttgcctttgttcggaatgacctgtcctggcttctgcagttcacgcgaaccgatgatggcggccggaataatggggcaaccggtttcgaatgccagacgcgccgcgccggtgtgtcctttgtaaagacgtccatcggggctgcgagtaccttcgatgtgaatgccgaacagatgtccgtcctcgatgatctcacgggcgtggttcagtgcgccaagtgatttggaaccgccggaacggtccacggggaacacgccgactgacgtgaaccaccatttcttgaatttgcctttgatgcctttgccttcgaaatattcggccttgcccatgaaatgaatcatgcgcgggcaggtcaacggcagcaacgcatcgtcgatgacggcaagatggttggctgcgatgatggcgccaccttcgtgcggaatgttctcaagtccttgcgcggtcggtcccaaacggtggatggcgattggtcccaagccttttacgaaaaaccaatagagcattcttcacgatcctcccggcggattggcctccgcccgattagagtataagtatgactgacctcaacaatagcaatgacgatgaagaacgcccaaatgacgcgtcgcatggtggcggctctccaatggacgacttggatgcggcttgggccgagtttgcggattcgcatgctgacgatttgaaggccgtggaacgttcgcgtagtgcgaaacgtttcgagaagcatgcgcaacgtcgggaaaaagaggctttgctgtccatcgatgacttggatcagggcacgttcaccaatgatgcgccggcgaatggtcgtgggccgcgcgatttcactggttcgagctggcttgacacggatcgggtcatggaccgttacggtgacgacttcgtgccgccgaatcctgaaatcggccatgtgaaactgtcaaaactggtgttctggatattgctggtggccggcgtcatcggcattatcgcttccgtgttcgttccggcgttggcttcgattcttggttcgattttcggtttgtgtgcgctggtcggcgccgctggcctcatcgtgcagcataaagggcatcgtgaaacgcgtaccgacgaattcgatgatggagcacgcgtctgacgattctttggcgacaaactgaatacatccatctatgtgaaggccccggcggttattgaactgcgccccgtttgttggacgttgttaattgggatacagggtcagaccgcgagggacatgctccggaactcctccggggtgcgtccctcgagtcgtatctggcgtcgtctggtgttccaatgcacgatgtacgagtcgaactctcggccgcggtagaactcgtccttcaagtggccgaagacctgctcggtcgccgcgttgtccaggcagttgcccttgcggctcatggactggcggatgccgaggcgtccgagctcgtccctccaccattggtgctggtactgccatcccatatctcccgtaccatcggctccacgtccggcctggacacgtgcgccgggcgcgacaggtggtggtagtacgtggatttcggcagcccggctatcctcaggaggtggtcgagccggtgtccccgccctgcgagcagtcggacgacggcgcttcgctcgcgccgcgtgacttggacgcccgcagggcccggagttttccaggtacgcgaccttcgccttcaggtacgcgacctgttcggcgagctcctgctcgcgcgtcggttcgggcttcggcctgagcgcctccggaccggtagtcgcggcaccagcgctccagggacgcgatgctcgcgatcccgtgcctggccatggcctccgtcttggtcagaccgttctcgacgtggtcgcgcgccgcggcgaccttcgtctcccagtcgtagcgtctgctgccgccgcctcccatgaccgcctcctcgccgttggacctgtacagcccgatccagtttctcgcggtatacaccggtatggcaagccttctgacgagcgtgtccttgccggctccggacttgatgagctccagcgcctcgtgccggaacccgtcgtcgtaacgtctccttcgattctcacgcatacgaaagaaccgcacctccgatcatcgaatctgaatttcttcagtccaacaatcggggtgcggttcatatttacgccggggccttcacatacacatacgttgtcagcgttttcaggctttcttcgcagcttgggcggtggcgatccacttgtcaagcagcgccgtggccttgccggagtcgacggtctgctccgcgatggcgtaggcggctttgaaccggtcagccaagcttgcgtcgcccggcaccaaatgaccgtcggcgacgattgcggaagcggcgttcagcagcgcggtggtacggaacgacacatccttgcctgcgaagaagtctcgtgccagctgcgcgttgagcgtcggttcgccacccttcagatctgcgatggtgactttggcgaggccgagttcgacggtcggatcgaatttgttttcggtaaccttgccgtccttgaattcccaaatggagaccggaccggtcggtgccatctcgtcaaggccctcatgggaagtgtagaccatgccgatctggccgttcgccgcatatacggcggccatgatcgggctcatcttgcgattagcgcagccgacggccatatgcttcgggcttgccgggttggtcagcggaccaagcacgttgaacacgcatggcacgccgagcgcggcgcgaatcggaccgacaaaacgcatggcggggtggaaggtgcgtgcgaaagcgaatgcgatgccgcattcgttgccgacttcgctcacttgttccggagtcaaatccatgggcaggccgagcgcttcgaagcagtcagcagtgccgcacttggatgaggccgcacgattgccgtgcttgacgacttttacgcctgcggccgcggctacgacagcccccatggatgacaggttcacggtggaggctccgtcgccaccggtgccgacgatgtcggtggtttcaccgtcgatgtacagcggaatggcatgggacaccatggccttcgccgcgccacgcacttcgtcgggggtcagccccaactgctgctgggtggcgagtaccgcgccaacggccgccggatcggcattgccgttcatgaggtcatcgacgaaccactcggattcctcggcgctcaagtggtcccctccaaccagcttggtgaggatcgacttccatgtgatttcggccatgatgccctccttggcgatgtcgcacgcctttattgttgttccgatgccgccaattgtaacgattggacgtttccccacgtccgcacgtccatatcacgaaacggcccatcgaagattcttcaaaaaagaaaacctcccccgattacgatcgggggaggttatgtcatgagcaagtcagcgactcagcgaatcactgctcgttctggccgtggcacatcttgtacttacgaccagaaccgcatgggcactgggcgttcttgccggttcccgggaaagtgcggccatccgcccacggagagtggagttcctcgctcttcggacgcttgttggccgggaccttgccttcggcgtggctgatcggctgcatgccgacgatgcccttctcgttcttctgctcgtcagccagttcatcgatggtggtcttttcggcctcgtcatcggtctccggctctgcaggagcggattcgccggtcgcggcggcttcgccgtccagacccattacggcctcggcggcgttcacggcctcatcctcatcggattcggtctcctcgtcctcggtcatggccacgcgttcgatgtccacgtggaacagcagctggatggtttcctccttgatggcttcgatcatggagttgtacatctggtagccttcacgctggtattcgaccagcgggtcgcgctggcccataccgcgcaggccgatgccgtccttgaggtagtccatctcgtagaggtgttcacgccacttgcggtcgagcacggcgagcaccacgcggcgctcgagctggcgcaggccttcactgccgagcttgtcttcgaaatcggagtactggtccttggcgtcggagacgatgagctccttcagggcctcaacggccttgtcgcccttgagcttgtcgacggcgtccttggccgcttcctgctccacggcgatcggatacacggaggagatggccttgaacagaccgtcccaatcccaatcggccggcttgtcggaaccgttgttggcgcccttgatgtagctcagcacggtgtcgtcgatgaacttgaggatgtcctcgtggatatccgcgcccttcagcacagcctgacgctccgcataaatgacggtgcgctgcttgttcatcacgtcatcgtatttcagcacgttcttacggatttcgaagttacgcgattcgacggccttctgtgcggtgcgcacgcccttggaaacgctcttggcttcgatcggctcgccttccggcatgcccttggccatgacacgcgccaccagctgggtgttgaacagacgcatcagatcatcttcgagggacaggtagaaacgggattcacccggatctccctgacggccggaacggccgcgcagctggttgtcgatacggcgggattcgtggcgctcggtgccgagcacgtacagaccgccgagcttgacgacttcctcatgctcgtccttgacctggtccttgatttcggccaaagtgcccggccaacgcttctcgtactcgtccggagtgtcatccggagaatagccttcggacttgagcttcgcatcggcgaggaactcgacgttgccgccgagcatgatatcggtaccacggcctgccatgttggtggccacggtgacggcgcccttacggcctgcgacggccacaacggcggcttccttgtcatgctgcttcgcgttcagcacctggtgaggaatcttggccacgtcaagcagagaggacacgacttcggaggattccacggatgcggtacccagcaggaccggctggcccttcttgtggcgcttggccacatcacggacgatggcggcgagcttttccttcttggtacggaagatcagatcgtccttatcctcgcggatcatcggcttgttggtcggaatcggcagcacgcccagcttgtaggtgcccatgaattcggcggcttcggtctctgcggtaccggtcatgcctgccagcttgtcgtacatgcggaagtagttctgcagggtgatggtggcgaaggtctggttttcggctttgacctccacgccttccttggcttcgatggcttggtgcagaccctcgttgtaacggcggcccggcaggatacgtccggtgtgctcgtcgacgatgagcacttcgccgccggtcacgacgtagtcgcggtcacgcaggaacagttccttggccttgatggcgttgttcagatagccgatcaatgcggtgttgttcggttcgtacaggttgtcgatgccgagatagtcctcgaccttggtgatgcccggatcaaggatgccgacgactttcttcttttcgtcgacctcatagtcctcgtcacggttgagcttcagaaccaggcgcgcgaactggcggtaccagcgggtcacgtcgccctcggccggaccggagatgatcaacggggtacgagcctcatcgataagaatggagtcgacctcatcgacgatggcgtagtggtggccacgctgtacgagatcggacttctcccacgccatgttgtcgcgcaggtaatcgaagccgaattcgttgttggtgccgtaggtgatgtcggcgttgtactgcttgcgacgctccggcggcttctggttggtgatgatgcagccggtgctcatgccgaggaagcggtagacacggcccatcagctcggcctggtagctggccagatagtcgttgacggtgacgacgtggacgccctgaccgtcgagtgcgttcaggtaggccggcagcgtggccacaagggtcttgccttcaccggtcttcatttcggcgatgttgccccagtgcagagcggcgccgcccatgagctgcacgtcgaagtggcgcaggcccaaggttcgcttggaagcttcacgcacggtggcgaaggcttccggcatgagcttgtcaagggactcgccgttttcgatacgctgcttgaacttggcggtctggcccttgagctcctcgtcgtcaagcgccgcgatctcgtcctccaaggcgttcgtcgctttggccacgttctcaagcttcttgatctgtcggccttcacccatgcgtagggctttgtcaacgatatctaccacaatcactccctttgtgtatggtgactttcctcgattgaggatagtcgctttctcgcgatttccgaaaagctccgtccattttacgtaagttttgacgtatcttgtttttcgcataagaaaagaggcccgcatgtatgacatgcgagcctcttatcgttcagttttcagccattagccattacttcttggccacattctccggagtgtcgatttcgaagacgccgtagctccaaccgtgacggtggtaaacgacggatggacgaccggtttccttgttgacgaacaggaagaagtcgtgaccgatcagctccatctcgtacagggcctcgtcaatggtcatcggctcggcgatgtgcagcttgcggcggatgacgattggggtgtcgccgacctggacctcgacggattcgccagggccgagatcagcggaaacggcgtcggccgggctattgttcggcgcttccggctccggctcctcgacgacgaccggctcgaccgggcccagatcgaccgggaccggatcggtgtagccacgacgatggtccttgcggcggtcgcgggtacggcgcagacgaagcgtcagcttgtcgagagccagatcgagcgcgctgaattcgtcggcgctggaggcttcggcacgcaccacggtacgacctgcgatgacggtgatctcaacgcgcttggcggtgtcggcctgacgcggattgccctcgtgggacagcacaatctggacacgctgcgcatccggggcgatagcggtcacacgattcatcttgctttcgacaacgtcacggaacctctgcttgatctgcgtatgacgtccggtaacgacgatttccatgtggacctccctagactcaagcggtgttaaccgctatatacggaccaaccagctgcatcgctgcttggtagtcatcattgtatccataagattggtgatttgctggaaaactccccgagaaaacaaaagtttttttacgctttgctttcgacgattctcttgctatagttgtgcatttgagacctcttgatggccgcgaccgattttgtcggttgaggaacttccgggctccatagagcacgatggcggataacgtccgcccagggcgacctgagagatagcgcagcagagaatagaccgccttaccggtttcggccggtgggtaagggtgaaacggcggtgtaagagaccaccgggccgctggtgacagttggccgcatggcaagcctcatcgggagcaaggccaagcagaaggcgttcgaggactgctcgtccgaagccttcgggtaggctgctagagcctgacggcaacgccaggtcgagatggatggccatccgtgccgttggcacgacagaacccggggtataagaggtctcactctccactctttatgttttgaggatttctttacaccagcctctttatgaaactgacgtcacgcccttggtcagcggtcgccgtcaatcaaacagttcctgtgcgatttggcgcagaatctcaggattatggccttttctgccgcccgcgctccagaagcggcgcctacgtacatcgcgttccagaccggcggtttttctcgcggttctacggcctaattcccatgcggcttcagtaaacacgccgtaggattccgcctcatcacaaacctgttgggccagcctacggtcgacgcctttccgtataagctcagcgaccgcgcccctacatcccataagacgggtcgcacagtagcgcaccgcggattgcgcgtaggcttcatcgtcaatcagttgaacccttgtcagtctttcaatgacgtcgtcaaccacttcagaggtatagcccttaccaatcaggcgctcacgcagtgcgccggaaggtcgaggcgcagcgtccagcaatcgcaatgcggcttccctgcatgcgtcaagatcatttggatcctttgcggcagtagaatcgccgttcccgacacgcccagcgtgtcgcgcgtgtcgtggcgttttcgtcgcatttgcgcttccagcgaacaaactggaacggtcaggtttcgttcgacggttccacctctgaacgttcgtgcgttctggatcctctgaagaaagggcaaggcccccagtatcggccgacgccggctgaaggccctgttccttaaggaaacgttcggcgctgatcatatgtcaggctttggcggcttttgaagttttggacgtcttaccatcacccggcgtgcccgcggcgtcctccgccccatcgtcctcggcgaactggtcggtaggtttgatcagaccgaatgccgccttgaccttgttctcgatttcctctgtgagttccggattgtccttgaggaactgacgcacgttttcgcgtccttgccccagctggtcgccctcataggtgaaccacgagccagactttttgacgacgttggcctgcaacgccatatcaagcacggaaccttccttggagatgccctcgccgtacagcacatcgaattcggcggtcttgaacggcggagccatcttgttcttaacaaccttgaccttggtacggttgccgacagcctcatcaccgttcttaatggtctggatacggcggatgtccatacgtacggacgcgtagaacttcaatgccttgccgccggtggtggtctccggattaccgaagaacacgccaattttctcacgcaactggttgatgaagatggcggtggtaccggcttgcgccagcgcaccggtcatcttacgcaacgcctgactcatcaggcgcgcctgcagaccgacatggctgtctcccatctcgccttcgatttccgctttcggcaccaaggccgcgacggaatcgatgacaatcacgtcaagcgcgccggaacgaatcagcatgtcggcgatttccaatgcctgctcgccattgtccggctgagagacgatcaacgaatcggtgtcgacgcccagcttacgggcatagaccggatcgagcgcatgctcggcatcgatgaatgcggccacaccgccggccttctgggcattggccaccacatgcagcgccaatgtggtcttaccagaggattccggtccgtaaatctccacaatacggcctttaggcaggccgccgatgcctaatgccatatccaaagccaaggatccggtcggaatgacctcgacatcctgttccgggcggtcgccaagtctcatggccgatcccttgccgaagcttttctcgacctgcgcgagcgctgtgtcgagcgcggcctgacggcgcggatcgattccattcgcggacttgttctgtgcggcgttctttgccgcgctcgtctgtgccatgactactccttgttgttgaccgagacgaatgaatggattcaccgtaaaaccgcatcatccatctgcgcaagttcaatcggccattgtggtcgaagaacatgcatttcgacacgccgaagaccgctttcccttgaaattccagcattctgaaacttcgcggcgagccgttgacgacctgcccaatccgtgcttctgtggataactataccccattatccgaacatctgttcgaaatcggtgttttgcgatagccgaactccgcctaacgcaccggcattggtggcgcgttatggtcctttccccaacgtttggagtcaggaatgttcatctggtcgcacagaacgttccataccacgcggggctcctcccccatttcaagcgcttcgacggctgtcagaccgttcaatcgatcaagcacttggtcgcgtgcgagcgcgcggccatagctacggccgagtacctcttcaagcaactgccaaaattcacgttcctgcacgcgcccaagtgtacacagcaagcgcaaccaaaaagaaaacgcccgacggaacaagccgccgggcgttagacgtccaacaggaatcagattgcgacggaatcgagataatcggcgaccatgcgcagcatctgcgccgtggagacgcccaacgattgcgcaatcgagctcagcagctcggagctggcctctttttggccacgctccacttcggagaggtagcccaacgacactccggccttttcgctcacctcacgcaacgttttgtggtcatgggtgcgcagatcgcgcagtacatggccgatggcctcgcgaagcgatacctctctgggttcgtcggtggtttccgtggctgccgacatggatcgtgcggaaacgcgttccgcgtcttcctcccgccatatgcgggtcaatgcggcctggcgctcgtctttggcctttttggccgcgcgggcacgcagcacctgctgctgggcgaacatcaccgcgcggcgctgggctggggtgagttccctgacgcgggcgttgccgctttgcaccgtgggaaccatcgccttgagttccatctgttccttggtgagtgtcatcgtgtccatgccgccagcccctttcgcttttcatacgtacgtccactatggtcaacacccatattcgtggattattcctgtgaaagtgctgaaagagtcctcagtttttccagaatacattgcacggtttcgtgccgcacggctttccgatcacccttcagacgcagctcataagcagctgtttgacgcgcacgaatgccattgaagccacagggcagggagcagccgatgtacaccaggccggcaggtttgtcaccatccggtcctggccctgcaacaccggtagtggccaagccgatgacacagtctccatcctcggtctgtcggtatagttgcgcggttcccgcagccatctgccgcgccacttcggggtggaccgccccttctcgggccagcaggtcggcattcacgccgagaatcttcgctttggcgcgaatgtcgtaggtcaccgccgagccgaggaacactttcgatgcgcctggtatgcgtacgaaggcgtcggcgagtagacctcccgtcagtgattcggcggcggcgattttgaaatggttggcttcgcaatagcgtaaaacggctgcggccagctcatcgcattgcgattggctggccgcggtcgacgaattttcggattcgctcatcgggatttacttggtttccttttcggattttgcggtcttcttacgtccgccgaacgtgttgacgaggtattcgccgcccgaatacaggcatagaatcaacgccaggtaaatcagggcgtacgtgatcgtgtaataaacggtcatccacagcggagtggtgttcatgccatcagcgaggctccacatcggcagcatgagcatggcaaggccgatgcactggcacagggtcttgtacttgccggcttgggatgcggcgatgaccttgccgccggtgtcgatgacgaagaaacgcatgatggtgatgccgatctcacggatgaggaacagcgcggtcacgacccagccgagcactgcgttgccgaattcgttgaagatggcggcgacgatcagcgtgccgcaggtgagcagcttatctgcgattgggtccatgagcttgcccagttcggtgacctgattatatttgcgggccatccaaccgtcgagcttatcggtgcaggcggcgatgatgaagataatcgccgccacccagcgcatagtcgtgtttttggtaccccatgcgcctgccatgacgtacaacgccaggaagatgacgaccaggacgatacgagagaaagtgacgatgttcggcggggcgttccacccgtcaagcagggacgatttgcgttcttcttgcttttccataccattcacgttaccccgataccactacttggcgcaatgcgtgcggttgtcgcgttccatcatcgcgtgtccgcagcgtcggccggctgggtagaacctgcggtaagcgatgaggtttcgcccttgatgaaggcgagcacctgcggcagatcctgcggttggacgagcacttcgcgagctttggagccttcggacggaccgaccacaccacgcgattcaagcagatccatgagtcggccggctttggcgaatccgacacgcagtttgcgctgcagcatggaggttgagccgaactgcgtgctgaccaccagttccgccgcctgcaacagcacgtccatgtcgttgccgatgtcctcatccggctcgatggccttcttttcggcctccttggccatctcctcgatatcctcgcgataatgcggcttgcgctgggttcgcacgaactccaccgcgcgacggatttcggactcgtcgacccatgcgccctgcacgcggatcggcttggcctggcccatcggcaggaacaacgcgtcaccttggccgatcagcgtttccgcaccggtggcgtcgaggatgactcgcgaatcggtggcggatgaggtggcaaaagcaagtcgggacgggatgttggccttgatcaagcccgtgaccacgtcaacggacgggcgctgcgtggcgagcaccagatgcacgccggcggctcgcgcgagctgcgtgatgcgctggatggagctctccacgtcgttcttggccaccatcataaggtcggccatttcatcgacgaccacgaggatatacgggtatggtgcgaccttgcgtttggagcctgcgggcgcatgcaccttgccagcgcgcacggcagcgttgaagtccttgatgtggcggaatccgaagaattcgaggtcgctgtatcgtgcgtccatctccttgaccacccattccaaagcctgtgcggccttcttcggatcggtgatgatcggggtgagcaaatgtggaatgcccgcataggcggacagttcgactcgtttaggatcgaccatgatcatgcggacctggtcaggcgtggcgcgcatgatcacggaggtgagcatggagttgatgaagctcgacttgccggagccggtggcgccagccaccaacaggtggggcatcttggtcaggtcggcggtcacgaaatggccttccacatccttgccgacgccggtgagcatcggattcggatcgttccgggccttgtcggagcgcagcacgtcgcccagcaccacggtttcgcggtcggagttcgggatttcgatgccgatggcggatttgccttcaatcaccgacaggatgcgcacgtcggagctggccaccgcgtaggcgatgttcttctgcaggttggtgaccttctcgaccttgacgccagggccaagctccacctcatacatggtgacggatggtccgcgcaggaagccgatgaccttcgcatcgacgttgaactgttggaaggtaccggtcagcgcgcggatcacacgatcgttctccggagtgtgcgcggcgtgcggcgcgcccttcttcagaatgttgaggtcaggcagatgatacggtccctcgggaatgtcatccgccgcttccccgtcaacggcagcagccggcatatcgtcaaggacctcgccggtcgcggcatccaccatgacttccttgccgttggaggtgccgtcctcgtcgatgacggcccatgggtcgtttggagcgacgccaaccggcttgatttcgctggacggcaccggctcggcgacgctgggcatggtgccgctcgcggtgccgatcggcgcggacgagaaggagcgtccgcgaccgttctgtggcatggccgtggtgccggacggcgcagcggcggaataatcatctgaatcataatcatcggcacgataatcgtccgaagaaatgctgcgtggcgaatcgacctgttggtacggctcgtcgacgatggtttccgcggtctgtccgtgccgttcggcggcattaagaaacgcttcgtcgccggcgtaatggtcaaggtcgccatcatcgacgttcttgctcttatgggatgcgaagcgttgcttcatacgcgtaaggaagcccggcctatcgtcgttttctccatccgcatcggtgccgtcgtgggcgggaacgccttcggcgaaggcgagtgtcgtgcccccaacgcggacttcgttcggaaactgttcggcctcatcgtcaatgtcatcacggtttttaggcgttccaacaaacttggccgccagagccttcgccttgtccggtatctgcgtgacccgggtatgggtaatcaacagcaacgaaaacaggatgacgactacgaaaatcgcaatggaaaagcctttggaaagcccccacgccaacggacagccaagcacatagccaagcaggccgcctgcccgctgcagcaaagacatatcgaacttctgggagtcggaggcaatcgccgcgtcaagaatagagcagacggaccagaggatcatgaaccatccgagggccatatggaggttctcatccttgttttgcgtcttgcgcatcagactgaacaccacaagcgccaggaataccggcagaatcacgctggtcaatccgaacagtccggaggccatggcatgtaggacctgtccgaaagcgccctggacacggaaccattcggatgcgcagaacagcaccgcgagaatggccatgatgaaacatgcgatgtcgcggcgatatttacgcagtatgccggcgatcggcgaggaatcgacctcgtccatgactttggtatcgccggaacgcgatttgcctgcggaacccttgccgcctgatttcgggttggaagatgctgttcgtgccataacaggactcgattttacccatgggcaccgccatggcacgacgacatccgatacttatcgaaagtttttgccgttcacgccgtcaggcgcttcggctagacgatatcgccaagatgatgctgcgtgtacgcatccgcctgcgcgtcgatcgcgtcgtaatcgccggcgtcggcatgctcgatgatggccatggcattgcccagcagcgcggggttgagagcctgcagccagtggatacgcggatcgcggccaaaccatcccatctgtttgcgtgccagacgcttcgtcttctgcgcgatgctcatgaacgtgtcatttaaatcgcacaggccatccaaatagtcgacaacctgctggtatccaagagccttgcctgcggtgatgccaagccggggacggatacgctccacttcctcgacgaaaccgttctccagcatctgcttggtacggatgtcgatgcggcggtcaagttcctcacgcggcaaatcaaggccgatctgcacggtgggaatcacataccggtaatgcggcaggctcgccgaatacggccggcccgtcacttcgatgacctcaagcgcgcggatggtgcgtcgaggattgtgcggatccatgcgggccgcggcttcaggatcctttgtcttgagctcgtcgaacagcgcaccggcgccttcgaccttttcacgttcctcgaggcgtttgcgcacctctgggtcagtgccaggaaaggaaatgtcgtcgatggcggcacgggcgtacagaccggaaccgcccacgaggatagggcgcactcccctggcctgcagttcggcgattttggcgcgggcgatctcctggaaacgtgccacggacatggcgtcgtccggttcgatgatgtcaatcaggtggtgcctgacctcggcctgttcctcaggactcgccttggcggtgccgatatccatgcccttgtacatctggtaggcatcggcgttgacgatttccgcctgctcgcccttggcctccaacgccttggcaatggcgatgccaagtcccgtcttgccggacgcagtgggaccgacgatggacacgaccttacgggtttcgggcttgctttcagtggcggacggcataggtttgccccgcttccggattcggatcggcgatgagattgtggcgtcccgcatgggtgacggtggcggtcacgaaatcacccacctgcggcatcgactcgccttccggcacgccgacatgcaccagcacgccggtcttctcacgtccggtaacacgatgggtggcggcatccttcttgccggatgcgccggtgaccatcacctcgacgtcacggccttcgaaagtcttgagattctcttcggtgatacgttcctgcagcgccacaagacgttcgaacctgtcctgcaccacgtcatgcggaacctgctccatctcagccgccggcgtgccgggacgcggcgagtagatgaacgtgaacgcggaagcgaatcgcgcctcctccaccacgcgcagggtttcctggaagtcctcctccgtttcgccggggaagccgacgatgatgtcggtggagatctgcgcgtccggcatggcctcgcgaatcttgcgcagaatgtcgaggaacttggcggaacggtaggagcggcgcatcgcacgaagaatcctgtcggaacccgactgcaacgggaaatgcagctggtgcatgacgttcggcgtctcggccattgctgcgatcacgtcgtcggtgaaggccgcaggatgcggcgaggtgaatcgtacgcgttccaaaccgtcaatctcgccgcacgcgcgcagcagcttggagaaggcaaaccggtcgccgatgccgtagccgaaggagttcacattctggcccagcaacgtgacttccttggcgccttcgtccacgcattggcggatttcggcgaggatgtctccgggacggcggtcatgttccttgccgcgcgtggtcggcacgatgcagaaggtgcaggtgttgttgcagcctacggagatggccacccagctcgacaccttcgacgcacggtcagttggcagttggcttgggaagtagttgagttcctcctgcaccttcacctgcgcgtggccttcgatgcgggcctggtcgagcagctgaggcagggatccgatgttcttggtaccgaacacggcgtcgacccacggggcttttttcgcgatcttctcacggtcgagctgcgccatgcagccgccgaccgcgatctgcaggttcgggcgttccctcttcaattcggcccacagtccgatggtgccgtacatgcgttcggcggcgttttcgcgcaccgcgcaggtgttcatgacgatcaggtcgatgtcatggttgagatactgttcctcggtggcgggcacgtagccgtcggcctcaagcacgccggcgatgcgttcggaatcatgcacattcatctggcatccgagcgtatgcacgtagaacacgcccttgccgcgcgtgggggtatcgttcgccgccggttcggccagtttcgaggcgcgctccgccttggtcatcatgtcttcgttcataacgcaccatgctatcggcagggcggcacaggcgtttcggaacgcgggaacgccccgttctcggcgcaatcgcagggcattgaccctcttcgatacacagcatacgttcagttttgcggaaagcgaggcggtacactgttcttccgtgatacttgacaggcaaaatcgaattaacaccaccgaattgcagatgcgtctgaagaacgtcgacgtcggcgagggatccctttcccccgaacagatcaccgagttcatcgaccagatgcaggtgtatgagggtgcgatgtacgagatcagcaccaaattggagattcttgactcggaattccaggtgcgcttctcccataatccaattcaccatatggaacgccgtctcaaatcgcttaactcgatcctcggcaagctgcagcgccgcaacctgccgttgaccgtcgacgccatcaaggacaacctgttcgacgtggcgggcgtacgcgtgatctgcaactaccgcgacgacgtgtattccgtggcgaattatctgtccgcgcaaagcgacatccaagtgctgcgtgtcaaggattacatcaagaacccgaagcagaacggttaccgttcgctgcatgtcatctacgcggtgccggtgttcctgtcatccggaccgcactacacgccggtagaggttcagctacgcaccatcgccatggattattgggcaagcctggagcatgcgctgcggtataagacggatctgccggacgcgaagcttgccgagcattcgcagacgctgttggattgcgcgcgcagcctgcagaacatcgagacgcagatgcagaacatccatcgcgacatcaacagcgccccgcgtgtgggtgaggcgccgcaggcggactgatgttttcggaaaatggcgattgacggacaaatcattgcctgtcaatcgccatttttcgacgatatcgaacgttattcgcgcttacgcagcaatcgtggtattttcaccggaacctgtgcgagcacggtgccgatgaaaatcagcgcgcagccgatgtaggctcgtgtggtcatgacttcgccgagcagcaacgcgccgcccaccgcggagaagaacgattcgagcgacatgatcacggccgcgcgcgacggcggcaccagctgctgtccgaccacctgcaacgtgtatgccacgccggccgagccgatgccggcgtacacgatgggaaaccagctttgcatggcgccggcccagtcgatggagccttcgcatagggagccgatccagctcagcagcgcggtggtggaaatttgtccgaaggacagcagaatcggatccatcttctgtccgaacgtgtcgatgacgagaatatggcctgcgaatagaaccgcagtggacaacagcaccacgtcggcaagggtgatcgagccgaatccgtcggtgatgcacagcagatagaagccgaccacggcgatggcaacgctgacgatgacgttcatggtcacgcggcggcgcagaataaggaaggcgagcagcggcgtcatgacgatgtagagcgccgtgatgaagccggaacggcctgcggaaccggaatagaggatgccgtattgttggacggtgctggcggtgaacaatacgatgccgcagatgacgctgacgaccacgggattgcccaggcatttcggcatggccacggttataccgttgccaagcgtgacggttggacactcattcgattcacggcgtcggcgttcctgttcggcgatgcctcgacggcggaaccacagcaacggtattaatgacagcgcgcccaatgtgaatcgcgtggccccgaagaacagggggctcatggaggccatgccctgcacttgggatacgaatgcgaagccccagatcatggccgtcagaacaaggcaggccatgccgccaatctctttcctctgcatgagccactaccctatggcacgtttttcgccgacagaaaagcctgaccatattctggtcaggctttgtttgagggttcagcgcagaggacgtcgcgggatttttcagtcgcgaccgccgaagagctggagaatatacaggaacatgttgatgaagtccagatacaggttcagcgcgcagatgatggagaccttcttgaccatgtcctcaccctggcctgcgtactgggcgaacagcgcgcgagtagcctgggcgtcgtagacggtcatgccggcgaacagcacgaggccgatggcggagataaccatcagcatggtctgtccgggagcgaagatcataagcaatacttcggcgacgatcagcacgatgaggccgaccagcagaatcggaccggctttgagcatgttgaccttggtggtcatgcccagcatggtgagcgcgaagaagaagccggcgcacaacgccagggagatgccgatggtgccaagatcatacgccatgaaaatggtgcttagcgagaagcccatgatcgcggcatacacgtagaacatgacacgtgcggtgctcggcttgatcttttcaatgcgggcgccaagatagatggcgatcacgatttcgacgacgaacggcgcccaagcgccaatgacgccaagcgactggatgagcgcgatgtaggcaccggtggcttgggtgaggatggccacagccgcggtgacgagcaggccgatggtcatctcaccgtaggcacgggtgacggaagcatgttcggcacgctcataggagtatgtcgcctgagccggaatggtggccgccggagcgccctgcgcatacatgttctgcggcgcgtactggtattggttctgaccgtacggattctggctgtactgcccgtacgaattctggttcggattgtattggttctgcccatacggctggccgttgaatccattggcgttgttgccttggggctgctgaccgaatgtcataatcgctccttaactcgattacgcatcacagtacggtacttttctgactatttcatgagagcccacgtcttacggtgccgagctgaaactaccggcaccgtatatccaatgcgcaatcagaccgtgaacttgtgcaccactttcgcgctatcgttcaggtcgaacaaatcagtgacgtcgaccgtcacttcggaatcgtctttcaaggtatatccaatcgtcacggttccggtggctccgggctggacttcggcgaaatcagaattggaatcgtatccggcagggttctcgctgtaaatggcggtgtcgagagcttgcccattttggaacacttgcgggctggcgaggactgcaaacgaattgtttttatccgtgttgttggtccattcgaatgtgaccaacaccgtgggctgattgttatagtcgttgttgctacgtaccgcggagacgattttcacatgcatggtcttcaaatcgccttccatatcctgatcgcccttcggctgattttttgcggagccttttgcggatgattgtgagcttgacacgccggtggcctcgtctatggccttgcttgctgcggactgcatggccagagtaatgacgatggccaacaccgacagcaccgcagcgacaatcgccaatgccttgccgcgttttttaccgcggaacgtgccgaccaatgccacaatcgcaagaatcacgccaatgaaaccgaaaatcgcagcaatgttgttgataatcggaatgaagctcagcacgaagccaagcgcgccgaacaccacgccgacaatgccgcacacagtcagtcccttctcttcctgatagaccggctgcagcgggggttggggttggatgggctgctgcggggcgatgtaaccactcatgatcgttccttcttctcgaatcggttgagacactttcgagggtacggaattccgcgctggaccggtattggacgaaaggtcattcccgtctgcactttggggcgtgcgaaacgcacggaagaacaatggcgtctttcggggacgggcccaataatggtaggtatgagcgagacgacgaattccccgacccccatcgaagtgccggtacgtaccagaggctggcaaagcatggtgatggtggtctgcgcgggcttcatgtgcttggcgcagaccgcgttcgccgcgcaacggttcggccaggattccgccgtatacgtatggatggtgttctgcatgctggtggcgttcgccatcgggtttctgctgctcgcccgttcccgttatccgcgtgccacattcgtcgccgcgtgtgtggtcgtgctggttttcccatacgatcccattctcgctttgatggcgttgaccgcgctattggcccgccgtaatgacatgaagaccacggttcgcgcgatcgtggcgggcggtttcgtcacgcttgccgcgcaggtacgcgacgcgttgcggccgccggaggcatccatctggcatatggtgttcgccaaaccggataccggcagccaatatggcaccgacctaatcatgcttgccgatgaccgcaccatcgtcatcaccgcgatagtggctgcattgttggagctggccatcgcgactttggcggggttgcatatccgttctcgcgccttggcatcgctggccacggccaaggcggacgcggcggacgcgcaggtggcgcagctcaagaccacgatcgacagtcagcagctggccgacgcgatcgctgccgaagcgcatgacacgcttgcccattcgctttccctgctggcgttgaatgcgagcgcgctgcaagccgagtcgaagaagctcgcggccgaagcgggaagtctggacgccggccaactggccgggcaggccagccgaatcgcggacaaaaccgaggagattcgcaaacaggcggcaggagcgttggacgaggcgcacagtgtcatcgacatgctgcgtcatccggagcaggcgaaggcgcaactggcgccgtccgatgagacgtcgttgacccgtgaatcgttggatgcgcttctcggagacgcacgtgccgccggcatgcggctcaacacatggattgacatccaacaattgggccagctcaacagggaaaccggcaaaatcgcctatcgagtccttcaggagggactgaccaacgcgagccgccatgcgccgggatccccggtatcgttggaactcaccgccaatcccaccgcaggcgtgcacgcgcatgtgtccaatccaactaatccgtccgttccggcagcatcggcggatgccacgcgtcccgccatggattccaaaaacgctttccgtaccggtgccggattgccgggattggccgagcgcgtccggcaggccggaggaacatgtcgattcggttttgacgcacgacacgcgttccatgttgatgtgcagctaccatgggttgagtgagcagcgaagagaacagcgatgacaggccgataacggttggcgtgattgatgacgatccgatgatttgccaggccatgcggctgattctcgaagattattccaccggcaggctcaatgtcgttttcacctgcaccgatggcggtcaagcggtcgacgaggccggcaggcatcatccggatgtggtgttgatggatatagccatgcccggcatggacggcatcgaggcgacacgaagactgcgcgcacttccgcagccgccgcatgtgctgatactgacgtccttgagtccgagcgggaccgtggagcgggccgtcgaggcaggcgccgagggttttgtctccaaaaccgatgcaccggaggacatcatccgccgcatcaccgatgtgtgcgacggtctgccgcaattcaatccatccagccaacggcagctcatcaacgatctgaacatgcagcaaccgcaatcgcgccgggacgaggctcgcgccatgctcgacgctctgcctgagcgggaacgcgaggcggtggttctcgcagccgacgggtacaccaatgccgaaatcgcggaacgaatgttcatttcggaacgtaccgtcaaggcgcacatctcatccgcgggagacagattatgcatgggccgggtacagatggcgcgtttggttgaacgtgcggatctgccggaccaattatgaggcgaaggattctacggcagtggagactccgttacgtccatgaaacgccggtgcaccccctcccataaactagaaaacagtatgccgcacctgcggtgcaaacgttatcaatgagggatggcggtcgatatggcgatcagcgcgacggaaaaacccctgggcaaagtgttcacttccgattaccaactcaccatcccttcgttccaacgcgcgtacacgtggcaggcggagaacatcgaacagctcgtcaacgaccttcaggacgcctgcgccgacccggacacgccttacttcctcggctcgctcatcctcgtcaaggacggccccacccaataccaggtcatcgacggccaacagcgcctcatctccctgtcaatcatcgtctccgtgctgcgcggactggaagacgaccccgacctcatcgacagcctcaacgacctcattttggaaccaggcgacaaactccgcggcatcaaagccgagccacggctcaccctgcgagaacgcgacaccgacttcttccgcatgtacgtgcaggaaggcaatttggaaggcctgttcgatctgagggacaacgacatcgcctcgcacgcgcaacgcaacatcgccgtcaacacccgccgcacattcgacctgctcgccgccatggacgccaaagaccgccgccgattcgcctcatacctggtcaacggcgtcaccctcgtcatcgtcaccaccgacgacctcaccggcgcgcaccgcatcttcgacgtgatgaacatgcgcggcgtgccactgaccgcatccgacgtgttcaaagcgaaaaccatcgcggaaatatcccccgccgcgcgtaacgcctacgccacacgatgggacgacatcatggacccgctcggcgatgactcgcacacgctcgaagagttcttctccgacctgcacctgatcgtctcgcacaaggccgtctgcacacagctgcttgaggaattccgcaaagacgtgctcaaaccatacgtgaagaaacagaacgtcatctccttcatcgacgatctgctcgccccttatgccaacgcgtggctcatcctcaaccgtccgaccgacgccaacctgccagacgacatcgtggccatgctcgtctcactcgccgactaccagaccaccgactggaaacctgtggccatgtgggcgctcgtcaactccatccgcaacctcggcagcgccaacgcacaagtgttctccacacccggaaatatcggaaacgaaaccacgaacgcgcacgacgaacgcctccaattacacgacatcgacagactccacgacgttctcgccgcactcgaacgcgtcaccggcgtcgacaacctcaaccggcaaagcccactcgcccgacgcacacgcgccgcaagcgccatccgagacctcaacaaaggccacaccctccaacagatccgcggattcctcatcaccgacgaggaccgacgttccgcactcgcgcatctacgtggcgagttgcagaccagtcccgccatgaagaaacttctgctcatccgcgccaacgagcagaagaccggctaccgcatcacccgaccgcgcagtctcaaagcgttgccgatcatgcccgaacaggtcagcgcgaaatccgatttcgctgcttggccggagtcggtgcgtgaccattgggcaaaccgcatcggcaatttggtgcttagtcaggccaatgaaacccaagtcgcgccactcgccacgtatgcgcagcgacgcgaccgcatgctgttgtcggcaagctccagacgttttccgctgacagccgaactcgccaatatcgccgaatgcacgccgcagacgctgcaataccggcaggatgagatggttcggctcatcgccgaccattggaatattcgttacgatgccgacgatacggatttgtcgacgttgaacgaggagacgctcaatgtgaaagctacggtctcctcccccacgtccaaacgcgtcagcattgcccaagtgctggaagccggactgcttatcgccggagagaccttggtatgggagcgtccccgcaagggcgaacgttgggtagcgaccgtcacttccgaaggcaagctacgcatggatgacggcagggagtatgccacgcctactgccgcggcgcgtgccgttggcggctcatcagcgggtcttaccgtgtggaaacgcacgtcgaatggccagaaactgagtgacgtttggaaggcgtatcgtctgcgcaagcactgaggacgccgaacgaccagatggtcagtctcaaccagccggattcaatcaaccggattcagccggtcaatgccaagccagccattcgacggcgagtttggtgcgattggagatgttggttttggcaagtatgtcgctgatgcggttgcggaccgtgccttcgctgagaaacagccgtgacgcgatctcacgattgtccaatccctcggccacaagttccagcacgtccaattcgcgttcggtaaggccggcgaaacgttcggatggtccgctggaatcggggttccgagatccttgaactaccggcgcatcatcatgcgacacaacgcgatcgactgatgaggattcgtctgatgtcgtggattgcggactgacccgcagcttgctcaacacttcggcgcccatgaccacttgtccggccatgacggcttgcaccgcgggtatgacggacgaaacgtcctgtttgatcaagtagcctttcgtgcctatttccaacgctttggcgatgtatgactcgtcggcgaatgtggtgaggataaggattcgcgcgttcggatgcgcgtcaagaatcgcctccgacgcttgcaatccgtccattcccggcatctgcacgtcgaccagcaacacatcgggggcatccatctcatattgggtcaccgcatccgtgccggtgttggcggtccatgccacatcggcggtgccggtggcttcgagaatcgtggataatgacgagcagacgattggatcatcgtctgcgatcgcgacatgcattaatgcgctcctttctccggttgcgtcgtttccgagccactcgccggcttggggatggatacgaacacgcgccaaccctcgtgatacggcccgcaaatcgcggagcctcccaacgcacgagcccgttcctcaatgtccgaaatgccgatgcctgtggaatcgttcggtcgaatgaactgcatggcgacggcttcagcagacgatcttctcacggttccatcatcctgcacgcacagctgccacaatgcggggaaatcgcgcagggtgattgaaacgttccttgcctgactgtgtttgaccgtattgttcaacgcctcgcgaatcgcagtggcgaagcagcgggacacggccgccggcgctgaatcgatgccgttgaccagcctcacccgcaaggggccggcgccgtccatgctgtgcgcggccgtctcaatctgcgaagcgaaatccgtaccttcgtctttcaaatcatgcacggctttgcgcaccaaagtcatagcctcgctcaccgtgtcatgaatttcacagaaacgttgggccgattgttcctgtccggcaacctgggccaccacgtgcgccgcctcggtctgcatgatggctcgggtcagcatgtggccgacattgtcatggatctcacgtgcgatgcgtgtgcgttcggcaagcgtcgccgtgcgtacggccaacgcacgatcctcgtcgttttcggcgatctgcgagcgcaggcggcgaatctggtcgcggcgggaatcctgcaatcgccgcacttcgcgggcgaggttcgcgcagcgcgtgcaaagcagaccggcaacgaatcccagaaccgtttggagcaccatcaatatgatgatggacaagtcggatggaacgtgcgagccaatcgaacggaaaatcactatcgtcatgggaagaagccacagccatcgcggcaccaacgcttgcaagaagcggctgccatcgacaccagcggacgatgatgccgcgttgaatgctgcgatgggaagcatcagataccacgccggcaccaggcatgcgccgcagtcaagcatgacaatcaacgccatcgcaagccacgaacccgacgcgtattcccccaccgcggcacaacacaccgccacaagcgcgccgcacatcaggtcgaggccgacgtctccggatgcgtatacgcccatgatcatgcccgtggccaggaacacggcttggaacagcaaccgtttcatgccgcctcccgtccgccgattcgtgtctgattggttcgcttgcttccagagtaatgcacatggcgcatggcacagccggcggcatcaacgaaggtgacatttgtcatgttcgaaagtgacatcattccggcaattgtgactacgcgcaccatgtcgggggcatccggcggcacgacaatggaatcagaggcatggagcacgagaaaggagctcgtcatgggtggacgcatgaatgacgctgccgatgcggtcagcgcggtcaaggtctcgaaactggtgaaacgttacggagacatgctggcgctcgactatttcgatctcgacgtgcatcagggggaaatcttcggcctgctggggcctaacggctcaggcaagaccacggcgatcaactgcatacttgcgttgctcacgttcgatgagggcactgtgcgcgtgttcggcgagccgatcagccctaccagctatgcgttgaagcggcgtatcggcattgtgccgcagaacgtggccgtgttcaacgaattgaccgttgaggagaacatcgattatttctgctcgctgtatgtttccgacaaggcaaaacgtcgcatgctcgtggacgaggcgttggatttcgtgggattgcgcgattaccgtacctatcgtccggcgaaactgtccggcggtctgctgcgtcgtcttaatatcgcctgcggcatcgcccacaagccggatctgatctttttcgacgagccgaccgtggccgtcgatccacaaagccgcaatgcgattctcgaaggtatccaacgacttaaccgcgaaggcgcgacggtgatctacaccagccattacatggaggaggtcgagcagatctgcgaccgcatcctcatcatggatcatggccggcatctggctcttggcaccgcggaggaacttaaggcgatgatcagcaccggcgaacgcatcagcatcgaaaccgatgatctgggagggcgctcagattcggccgatacgacgcttgcgcgattgcgcgcattgccgttcgtgaccaacgccgactatgacggccatgagctgacggtgaactgccgccagggcgatcacaatctcatcgacgtactgcagctgttggagcacgagggcacgaatatcgggcatctctccagtcgccagccgacgctcaatgatgtgttcctggaactgaccggcaccgcgttacgcgactgacttggcttgcaaggcttgtggcaaatcgaaaggcatgtgacatcatgtggcagacgttactgatcaatctcaaactgcatttgcgggagaaaacgcaactgttctggctgttcgccttccccatcatcctggccaccatgttcaacggcatgttcggcaacatcgcggaaagtttcgaattgcacacacttgacgtggccgtggtcgaggacaacgcgtggaagacgtcctatggggcgcagacgctgatcgaaggcatttcatccgaatcgtctgcattatcggacaatcacgtgaaagtgagtgccgatggcaagaatggaacgggactcatcaacacgaccaaggtggaatcgattgcgcaggcggaacagctgctggccgacggcaccgcgcaaggcatgctgcgaatcgatgacggcagattgcgattctccgtctcacagtcgacgcaatcgtccgcgtccgatgtgatggcgtcgagcagcggcttggatatttcgctgacggtgctgggcaacatcgtggacctgtacaaccgcaacaccgatgtggtggtggacattgcgaagcacaaccccgaagctctgatgaatggcaaggtgaccggcagcatcggttcggcgaatggctatacaaaggaaatccagctgacgaattttaaaccgagcggtacggcacgatattactatgcactgctgggattggccgcgttgatggccatgagcttcgccatcaacgtagtgacgatgacgcaggcgaacctttccgctttgggcgtccgccgttccgtttcgccgcttccgaaatcgcagcaactgctggctggattcctgtccagttggctgtgttcgttcctgagtctgaccgtggccatgctgtatatccggttcgtctgtcatatttcgttgggcggacgtgaatgggctggtgtgggagcatgtctcatggcttcgttcgcggcgagcgcattcggcacgttgcttggcgcgctgccgaagattccaaccggcgccaagcaggggctgtgcacggcgatcgcctgcacgttgtcattgttctccggactgtacggttcgttcgccatgcagttgagcgacttgatcgcccagcgcacaccggtgctgagtctgctcaatccggcgcagcagatcacgaacctgttctacgacatcctctattacgacaatttcaaaccgttcttcaccaccgccggcatccttgccgcgatgagcctggtctgccttgctgcggcgaccgttctgttgaggaggcaacgctatgaatacctgtaagacggcgctgagaattctcaaatcacgcaagatgtacctggtcatctatttggggttcatcggcatcatgatgttcgccatcagctggcagatcatgcatggctcgatgacgggtggcgatgaggtgttccatcccgatacggcacgtgtggcggtgatcgaccgcgatggcgatgccgatggtatttcatccgcgctgcgttcctatcttgcgttggatggcgagatggtggaccttgccgacgattccgaagcgttgcagcaagccgtcgcttcgaactatgttgatttgatcgcaattgtgccgcacggcttcgcttcggattatcagaaatatctggatggttcgtcaaatgaccaaccgactgtcgaaaccgttgtcagctacacttccggagcaggctccctttcgcagctggaagtcaacgaattcctgtcattgacacgcaccgcgtacttgggtcaagccgggaagcaacagtcgatggaaacggccatgcggacggcgttggataccgcgaaagcagatgccaagacgtcgaaaatagcggtggtgcaatcgccatccgcagatactgataataccaagccggcggcatccgcattcgccggcaccatcaaaacgggactctatccgttgctgctggtcatgccgatctgcacgttcctggtgattggcaccttcaatgacagtgagattcgtcgccgcctgtattcgtcgccgacgcgtctggtgtcgttgcagatgcaggagatgctcacctgcgccaccttcggcttggtggtgtgcgtgggttacacggcggcgacattggtcttgatggtggccgcaggagtgccgttcgacgggattacatccacgaatgtggctttgacgttcgtgtcgctgctggcgtacacgttgatggcaatcgcctgcggtttccttctggggtcggttggtttctcggaaatggcggtcaatgcgttcgccaacgtattcggtctgctgtgcatgttcacgtcgggtatggcattccccatcgatatgatgcccgaaccgatgatcatgatcggcaagctgctgccgggatggtggctgtgcgtgtccatcgacaacgtgttcgggcttggcacggcggccgcaaccggtgtggattatggttcttgggcatcgtcggtcggcttggtggcattgtttgcagtggcgttcatctgccttggtctggcattggggcgtatccgtcgcacacgcccgtccttggcctcccccaccaccacgcagttggccaagtaaatccccgagtgttccgttccatcggccgagtcccgatggaacggaacatccgcctttgccgtaggctctcaatcaaatcggatggaaccggacgaaatcggactaggctgaaagcatgatcgaccacattacacttcatgtttcgaacgcggaacgcagcatcgcattctatacgaaagctctgtctccgctcggatacattcccaaagcccatcacgaaccgaccatcggtttcggcgtggatgacggcacgccccgttcggatttctacatctccccgatggacgatccggcgcaacagccgattcccacgcatatcgccttccgcgcaacgaacgaacaagcggtacgcgacttttatgaagccgcgatcacggcaggcggaatggataacggcagacccggaccacgtgcctaccattccgggtattacgcggccttcgtgctcgaccccgacggcaataacatcgaagctgtcacagactggtcgcacacaagccaatcatgaaatcggccgccgaatcgcaaaaagtcatcgggtgacattgcgcagccaacggtacttgcggtagtgcaacaacgcgggaaccattttgatgcattcgtcggtgttgagcagcgcatacaccaccaacacgggcagtttgaacacgaacgcggccaacagcccgaccggcaccacaatcagccacatgacgatggcatcgcacatgagaccgaacttcgcatcgccgccggctggaaaaataccggcgatcgtcagattcgtcatgcatccgcatgccgcgtaatatgcgcagacgaacagcatgaccgacaggtaccgtgtggcttcgggcgtaaggttcgcccattgcaaagccagcggacgcgccgcgacaatcaacagtcccgtcgcggtaccgaccacggccaccagcacgcacatcctgtcgcccatcgccttcgcctgtcggaaatctccacgtcccagcagattgccgaccaaaatgccgccggcattgcccagaccaagggacaggcacaccagcagatccttgacgatattggcgatggaattggcggcgacggcgtccgcacccaaatgtcccatgatcacggtgtacatggtgaaaccacatccccacaccaattcattgccaagcaccggcaggctgtatttccagaaatccttctgcaacggcccatcgggatgcagcacatggccaagtcgcaggtgggggccacgacgggtcgccacgaccgaccatgccagctcaatcgcacgcgaaatcaccgtggatatagccgcgccgaaaatgccaagcgcgggaatgccgaggctgccgataccgtaaatcagcgccgcgttcaacacgacgtgcacgatcacgccaaccgtgctgaccgtcatgcccatcaccgcggaaccggtgttcttcatcagacacaggtacatctgggacaggccgatgaacaagtacgacaatgacgaaatccgcagatatcgcgcgccgagcatgatcagcgtgccgtcattggtcatgatggacatcaactgttccggcacgagcagtgccgccaggaagaacgccgtcgacagcattccggcatacagcatgacgaatcccagcacgcattccaccgcgtcacggttgccggcaccccaatactgcgccacgagaatgctcatgcccagggtcagggccgcagtgaacaggctgaacaggaactggaactgcgtggcgagcgagacggcggccaactcgttttgccctacctccgacaacatcagcgtgtcggcgcaggacgacaacgacagcatgagctgttggaaagcgataggcaaagccaatttgaatacatggccgaggaattcccggtccggcatgatggtgcgcacgatagtctccattggaatacaagcccgtttcagacgacgggcaaacgaaaacgtcgggatatgtaggccgaccagccttatcccgacgttgggccgaatattgggcgaggttttacagcgaatccttccatgcgcggtattcggcggccttgccctcccagtattcacggtccgcatcagtgatcttgcgaatcacatggcacgggttgcccacggccaccgaatgggatgggatatccttggtcaccacggagcctgcaccgatcaccacatcatcgccgatggtaacgcccggacagaccaccacgctgccgccgaaccacacgtcattgccgatggtgatcggacgggcgccttccggaccggaagcgcgtacggccgcatcgattggatggtatggcgtgtacaggccgacgcgcgggccgaagaagacacggtcgccgatggtgattctcgccacgtcgaggaagatgcagtccatattggcatagaagttgtcgccgatatacgtgttgcagccgtaatcgcagttgaatggcggttcaaggaacgcgcctttgccgagtgaaccgaacagttcgcggaacagcctgtcacgttcctcgaacgcgtcgtatgcggacgtgttgatggcgtgcaccaagcggcgtttacgcatgttcgcttcacgctgcatatcaccgcaaatatacaattcgccggaaagcatgcgttcccactcgttcgtaggcaccgccgcattatccacggcaacggccgcaccttcattctccgccattgaaagctccttgtgaatctgtttgtcaatcgtttgacgtcctttgacaccattcaacaccaccaacatcgacggcagcactcgcaatgttgtagaatcatccttgttctttgcattatctaccgtttattagagtagtcatgaacactgccgatgaagacgcacagatggaacgggacgaatgggcctcccgtgaggtgatgcccatcaccaattggggtcgccgacccgatggttcggagatagtgcagtatgacgcgccgatgttcttctccttcaccgagcattcgctgctccaccagtacccccatatgcgtgcggaatgccattggcatgtcgaccttgaactcacctacatcatccatgggcatatgtggtatttcgtcaacggagaaacagtccggctcgatgaggggcaggcgattttcgtcaactcacgtcagctgcattacggtttcaccaaggacggttccgattgcgaattctcctgcacgttgctcaatccggctaaaatgtgcgcctcattcgaagtgtacgaccgtttcatcgcgccgttgatggcggagaacacgatgccatatgccgtcatcaccgacgacacggcccccggtcggcggctgcttgccaccatccgacagcttcatgcggcgaaattcggtccgctggagcggtcagagcggtcagccgaaccgttgcccgccgacgatatgacgctaaccgacgataccgaggcgttgacggtgctcagctgtttctatgcggtcgtccgcgacatactggcgatcgccggcagtcattgcgcgacttccacagcgccgcacccccgcatcgtgacgctacgcaagatgatcgattacgtgcagagatattacgtgcgtccgatcaccttgaagcaaatcgcatcggccggatcggtgggacgcaccacttgcgcatcgatattccgcgaatcgctcaaccagtcgccgatcgaattcgtcaacgacgtgcgcgtgcgcgccgcagccaacctgctggtaacgagctcgctgcctatcgccacggtcgccaaacagaccggtttctcatccgccagtttcttctcccgcaccttccaccggttcatgggcgtcacccccatcacgtaccgaaccacgcataccaagcggaaatccgaggaataaaaacaatcggctgcatgccccacgccgtcacgcataaggacacgcagccgattgcgtcacatcaagccggaaaggacacgttcacttcctcttcagtccgcgggcgatggaggcgttgcgcacctcgaccgtgccgtcggtggcgaagacgcccaacgactcgcccggacgctcgtacatgcgcacgttcaacgccaccccatccacgtgcaacgtgccgatggtgtcgtcgacgacgagacggatgtggtacgtatgccccgcctcgaggccgatgggccgttccaggccgatgttcatgacgtggattggtcctgctcgtcgtcgccgccgcgcgggaccgccacgccgcagtcatggtagtcgacgaagtccttggtggtggcgaggtcccagccgaacggctcgccgaacggttcagggttgcggttgtccctctggtggaacaggaagaactcgtcgcccttgccgaacggcatgcaatcaccgaaccacgtgccggggaactggtagtaaagcttcattggccttgcctttccttgtgtggcgcctttggaaggcagtcacccatgaccgtcatcgcaatgacgctatttcgcttcgtattgcttcgtttaagcgcttaaatgatttaaacgcttaaacgagatatagcattgaaaaacggaatgtcaaacgattgacgtgtctacaacgtccgcactgaatcccgaggcactgccgggcattggacatgaaccggcttgaaccgttcggagactatctccgattcgtcattgtcggctccgcaacgacgcaacagggtacgcacgcccatcacgccgagatcgtactgaggaaggccaacagtggtcaaagcgggatgcatgtgggccgaaatcacttcctggttgtcgaaaccgaccacggaaatatcgtccggcatgcgtttccccgattcccgcaacgcgtcgtacaggccgagcgcggtgcggtcgttatggcagaacactccggtcgcacccgtcgccaacacctgtgctgccgctccgtaaccgccttcctgatcggcggtcacggacagcaccagcgaagggtcgaaatcgacgtcgaaccgcgcaagcgcggccttgtatcccgcaagacggccaaccgaagcgggtgacggcgcggcatcgttgacgaatgcgatacgccggtgtccggcttccaacaacagccgtgtggcggtggcgccaccctgcacttcgtccggcaccaccgcggggaaccgtccgcactcgtcatagcagttgaccagcacggacggcattctgccaagctcgtccggcggagtgattgaaccgtgtacccatttcgagtagatgatgccctcgacctggtgttcgaacatgaacgagaaggttctgcgttccacgtcttttctgccgtcggtatccaccaccagcagaattttcccattaacgccaggcttcatcctgcgcgccttggatcacctggccggcgaaaggcgatgtggccactccgtcactgatgaagccgatgatgtcggagcagcctcgggccaatccgcgggcgaacgcgttgtgatggtagccgagttcgtcagcggccctgcgcaccttgcggcgtgtggattccgtgatctgcacgtcccggttgtcgttcaccgcccatgaggcggttgcgatggagacaccagccgcttcggccacgtcccgcaatgtcactttcgccatgcccgcgtatcagccccgtccgacgcctagcgcatcaggttgcgcaggacgtactggagaatacctccgttgcggtagtagtccgcttcgcctggcgtatcgatgcgaacgacggcatcgaattcggtcgtggaaccgtccgcgtgggtggcggtgacgtggaccgtcttcggggtgacgcccttgttgagttcctcgacaccggagatgtcgtaggtttcggtgccgttcaggccgaggctctcatacgattcgccttcggggaactgcaatggcagcacgcccatgccgatgaggttggaacggtggatgcgttcgaagctttcggtgatgacggctttgacgcccagcatgacggtgcccttggcggcccagtcacgggaggagccggtaccgtattccttgcctgcgagcacgacgagcggcacatcatggtcgatatagtcgcgagacgcttcgaagatcgtggtcggcttcttgtcgaggaagtcgtaggtgtagccaccaggggtgatttcctcgccgacggaggcgagcaactggttgcgcaggcggatgttgccaaacgtgccgcggaccatgacctcatggttgcctcgacgggaaccgtaggagttgaagttcttcggttcgacgccacggtcggtcaggtatttgcctgccgggctggaggccttgaacgcgcctgccggggagatgtggtcggtggtcacggagtcgccgagcagcgcgagcacgcgggcgccgtggatgtccttgaccggatccggggtggccttcatgccgtcgaagaaggtctgcttgcgcacgtaggtggagttctcatcccatgcgaacagttcgccttccggcacgtcaaggcccttccaacggcggtcgccttcgaacacggaggcgtaatccttgaggaacatctcgcggctgacggtgccatccaccactgcggcgacttcctcattggaaggccagatgtccttcaggtacacgtcgttgccgtcctggtccttgccgagcggctgggtttcgaaatcgaaatccatggtgccggcgagcgcgtaggcgatgacgagcggcggggacgcgaggtagttcatcttgacgtccgggctgatgcggccttcgaagttacggttgccggacagcacggaggtgacggtcaaatcgttggcgttgatggcctcggagatttccggcagcagcgggccggagttgccgatgcaggtggcgcagccgaagccgaccagctggtagccgagcgcgtcgagatcatcctgcaggccggcggccttcagatagtcggcgacgacctgggagcccggggcgagagacgtcttgacccacggcttgggcttgagtcccttggcatgcgcgttgcgggcgatcaggccggcggcgatcatgacggacgggttggaggtgttggtgcacgacgtgatggacgcgatcgccacgtcgccgttcttgatatcgaagtcgccacggaattcagtggataccgcgatcggatcctgcacggtcttgtcggtttcgtacgccggcagcgtggcttcgaacttctctttcgattcggacagcctgatgcggtcctgcggacgcttcggtcccgcgatggaaggcacgacggtgccgaggtcgagttccagatattcggagtactgcggttcgacgtagtccggatcggtggtgtcgccccacagcttgttggctttcgcgtaggcttcgacgagagcgatctgttcttcggaacgaccggtcagacgcagatagtcgagggtgacgccgtcgattgggaagatgccgcaggtggagccgaattccggtcccatgttgccgatggtggcgcggttagccagcggcacggaagcgatgccttcaccgtagaattccacgaatttgccgaccacaccgtgctggcggagcatgtcggtgatggtgaggaccacgtcggtggcggtgacgccttccggaatggatccggtgagcttgaagccgacgacgcgcggcacgagcatggagatcggctggccgagcatggcggcttcggcttcgatgccgccgacgccccagccgagcacgcccagaccgttgacggtggtggtgtgcgagtcggtgcccacgcaggagtcgaggtaggcgaggtcgcgaccgcgctcccctgccttggtcatgacgactttggcgaggtattcgatgttgacttggtggatgatgccggttcccggcggcaccacgcggaagttgcggaaggcctgctggccccaacgcaggaactggtagcgttcgccgttgcgctggtattcgatgtccatgttctgttcgaccgcgtcggccacgccgtacttgtcgatctgcacggaatggtcgatgaccatgtcggactggacctgcgggttgatgacctccggatttccgccaagctccttgacggcgtcacgcatggtggcgaggtcgacgatgcacggcacgccggtgaagtcctgcatgaccacgcgggacggggtgaactggatctcgtggctcggctgtgcggccggatcccaatccaacagggccttgacatgatcatccgtgatgttggcgccatcgatgttgcgcaccaggttctcaacgagaaccttcaacgaatacgggagatgatcgatgcccggcaaatccgcgatgcggtaaaagtcgtaatccttgccgcccaccttcagggtgtcgagctggtcgtcgcgcacagacatgctacctccgagcttttgtggctggttgaaactttccagcagccgattatccgttgctaacgatacagccacgttacttcagcactggcgtgtcttcttgaaacgtgagaaaatggcgactattttcggcacgcaccacaggcacagcacgaaaatgatggcggacaccacaagcgcgatgcccgtcgccgagagcatttcgccggacggtatcacgagcgcgaagaaacgcgcgacgggcggaatgaacatgccggccacgcccgccacggcgaacgccaataccagaccgcctctccacgagttgagtggacgggccacgcgcgccagtacgaagatgcccatcatcagcaggataatcgcgttgacgccacgaagcatgcccagctgcgcggcggaatgctgtgcgtcccagcccatgaacttcggcaacagccacgaatcggcgagaatcgacagagccgtggcgatgcctcccggcaatgcgaagtgcaccacgcgcctgaggaagcccggaatgtagcggcgcgtgttcggcgcaagcgcgaggatgaacgccggcatgccgatggtgagtgcgccgatgtaggtgatatggcggggcaggtatgggaatgggatctgcgtcagcaccacgccgagcgagatcagcgcggaatatacggttttgacgaggaacaggctggccacgcgttccatgttggccatgacctggcgtccacgtgccaccacatcgggcagatgcgagaatttcgaatcgacgagcaccacctgcgccacggccttggtggcgggtgccgcgttgcccatcgcgatgcccaggtcggcctccttgatggcgagcgcgtcgttcacgccgtcgccggtcatcgccacgacatgatcgcctaggtgcagcgcctggacgatcgccttcttctggtcgggcaggacacggccgagcacgtccacgttctccagtactttcgccagttccgtgatgtcggcgggcagttcgcgcgcgtccatgaagcgtggctccgcgtctccggtgagccgtacttttcttgcgatcgcaccgacggtgacgggattgtcgccggagatgatgcggcagcgcacgccctgctcgcggaaccaggcgagtgtggcttcggcgtcgtcgcgaatgtgctcggagcataataccagcgcgacgggccgcgatgcggggtcgatggcgggatcgctttcgtaatcggcgggcgccttgccgtcatgccgtgcgatcagcagcacgcggttgccgtcgtgtgcggaatcgttgaccagtcgaagaacgtcggagtaatcgccatccaagtgggacagcacgacttccggcgcgcccatcgtccatgccgcgccgtcatcggcaatcgagctccatttgcgtgccgacgagaacggaacgcgcgccgcgacgggaccggcggagaatccctgcttgcccagtccgttgagaatcgccaatccggtgccgttcggctgtccttcgttcgacaggtcgtacaacgcctgtttcacggcatgttcgtcaacggtattggctccgatgccatccagcatgcgtatttcgttgagcatgatgccgccgtcggtgacggtgccggttttgtcgaggttcaggcagtccacgcgtgcgagggtctccacggattcgagctcctgcacgagcgtgttcttgcgtgccaaacggatggcggcgagcgcgaagttgagcgaggtgagcagtacgaggccttcggggatcatgccgaccacgccagccacggcggacaccacggcggaacgccattggccggtggagacggctacgtcccaaccgccgaccgcgtgcacctgcgaccagatgagcagcacgcacagcggcacgacgaggaaggtcatgaatttgaggatggtgttgatgcccttgttgaggtcggacacggtctttttgtagaccttcgcctgcgcggtcaaggtggcggcatagctgtgcgcgccgaccgcgttgaccttgaccaaggccatgccggagaccgcggtggatccggaatagatgtcgtcgccttcgttcttgcgcacggtgcgcgattcgccagtgagcatggattcgtcgagttccaggccccaggtgcgcacgatctgcgcgtcggcgggaacctgttcgccggagcggatccacatgaggtcgccgagcacgatttcgttgtgcggcacttcgacgtccttgccgtcgcgtcgtacgagatagtcggaggctacgaggatggaaagcttgtcgagcgttcgtttggctttcagttcggtgatgatgccgatgccggtgttgatgaggatgacgaggccgaacacggcgtctctccatgatcccgtgaccaataccatgaccatggcggcgaagatgatgccgttgaacagggtgaacacgttggctcgcacgatgtcggcgaacgaacgtgacgtggacgatttgacggcgttgacctgcccgctttccgtaagggcggcgacttccgctgcggtgagccccttttcactggtttcaggcatggtttgactttcgctcatgctgccagcataccgcttggcgatgcgcgcccgcaggcttttcccgtaaagctccggcaaaattcagggttttctcagggtgcgttcagcgccacgcatccgaaccgattcgaactcacccgaatgcgtggagcggttcactgtttgccgccgtggctgatggtggtgacgaggattgttctgtcgtgcgggtcgttgttggctatgccggctaccgcgtcggcgagcggcgtcgcatccgtcatgcggtcgttgattgtgagcgtcgccgcgaacagcgtgctgtcggtcggcgtggcgatcgggttgagcagtgccactggaatgcccgcctgtcttgcggttgtcagcgtgtcgtaccagccgtcatggttcacgccggacacgtcgattcccgaaatgacgatgatgctgaccatgcgttgcgccatatcctcgaccgcttgccgggcggtgtcctgcatgtcgaccgtgccggcgaccggcagatacaccggcctgagcccgcccgcctccatggcatccaacgccaggcgatcggtctgttcgtcttgggagccgatcatggccacgtcgagactgttgctgtccttcatgctgtgggcgaccgcatcgcctgcggactgcgtatctcccaccgcggcattgttcggcgtgcagccggccagcatggagatgccgaagacggctgcaaggagaccggctgcggcacgccgcgcgaaaccggtcatcgtgtggctttcctgaatagcgccaccgtttcgacatggtgggtggtcggatagatgtcgaatgcgcgaatatcggcaagatcgtatccgagcgaggccaatgtggcggtgtcgcgtgccagcgatgccgggtcgcaggcgatgtatacgacgcttcgcgcgccggatttggtgatctgcctgcataccttcgcacgtgcgccggcacgcggcggatcaagcaccacgatatcgggtttggccaaatcgttgcgtacgttggcaagcgtcttggccacatcgcccacacgggcgtcgacattgcctaaatggatggccctcagattgcgttgcgcgtgtttgacagcggtcttgccaccttccacgctcagcatgcgcgtgcggccggcgcttaacgtggccaacggcagcgtgaacaggccggaaccggaatacaaatcccacaggcatgcggaagtggcgccgtcaagctcgccatgcaccaaggacatcacatggccggtcaacgcgatcggcgcgtgacggtgcatctgccagaatccgccggcgtccacaccatattcgaattcacgtccgcacaccgtcaccttttcggtaagctcgcgattgcccgccgtcacctcgccatcgacgagcacggcgtagttgtcggcgatttcggcattgccgcgaggctcgggaacagacagacgaatctgcgatccgggagtgaatcccccatcccacacgtgttccttctcggccacgttaagcaacgcgcgactggccaacggcatggtgtcgatcggcacacgcacgtgggtgccgcgtctacgcatggacggtcggccgttctcgtccgcgatcatctcgatgcgggtacgccagtgcagcccatgctccgcctcatcctcgggcatgcgctcgatcggcacgtcaacgtcgacatggccgagacgtctcatctgttcggcgatggacatggatttccatttaagctgtccgggcagtgagacgtgcaccaaatcggcaccgccgacgccgccgcccatggcaagcggacccgccaacggccatacgggttcgacgcggtcctcgctggcttccagcacttccgtcacttcgccagtccaaaaacggtcctcgcgatcatgtggctcgtccaacacgacgcgtaccagctcgcccggcaacgcgaatcgcacgaacacgacgcgtccgtcgatgtggccgacgcaacggccttggtcggcatatcgttcgatgcggatggtcgattccatcagtgctgttcctccgtttcgttgttgtcgtccatcgcgtcggcgtttggttcggccaacgtcttatgccgatgcatgggggtggccacgatgaggtacgacacccagatggccaacgcccagaacggaatgcccatgagcagacgtgcagtgccgagccagccgacctggttggacaggtacaacggcacctgcaccaccagtcgtagggagaacacaccgatccacaacgcggtgatgatggtgtacgcgcggttcaatgccttgtcgccacgccaatcggcaagccatgcgcgcagatgctcggttggcagtgtccggatgaattcgatcaccaagccaagtcccggtacacgtaccatcaacgaaatggcgagcagcacgatgtagaaggcgttggtcaggaatccgaacatgtaatagttgcgcgcctcgtggctgttccatgcccagatcaggcagatgccgactgccagaaggccggagacggcgcccatgacggattggcgttggcataggcggacgatcacctgcagtacggcgagggatgcggatacgccgatggtcagatgcaggtcggaggtgatgacgaacatcaccacgaacaccacgcccggcagcatcgattcgacgacgccgcgcggaccgccgatcgcgtcgatgacggagaaatcgtcggcatcgccggcgtcggcgagcgcgccgaggccggttcttttcttggtttcggtttcagccatgcgtttgtgttttcgtggtcgtcgttcgctcagcgcacttcggagaacatcggtccacgcgacaacgtggtcttgacctcgacctgctggtcggagtcaaacggtcccttcggctggcctggaatgtccatcgtcctgcctgcctgttcggcttcggcggcttccttggcggccttgcgttcggccggggcgaccggcggatgcatcgggatgaggtcacgcggggccagcgggtcctcgccgcgttccacgacgatgttggagaaaagctggttcagcgccttggtttcggcgtggtccggatcggtggcggctttgccggagaagatgccgcgcagcatccaccgcggtccgtccacaccgacgatgcgggtgacgaccttgcgtccgcccttgaccacgaccggcagtgtcagttcggtgccgaacacgccgtcggtctccttggcgtctttgttggcctcaaccaggtcggcgcgcacgtcatcccacagtcccatggtcttcggcgcggcgaaggcttcgatctccacgctggaggatccgtaggtgatggtggtgccgagcacctgctgggtggcgcggttggccttcacgcgcagttcgatgccttggaggaacggcagatagtaggcgcccatgtcgaggtattcgtcatagtcgggcacgttctcgtcgtcgacgtcccacggaccgtgctcatcgccacggccgtcgtactcatcggatggttccggaaggatggtttcctgaattccaccggcgggcgcctcagcggtttcggagatggcctcatcggccttgtcgttctcttcggcggcggcttcagcggcttcctcgctctgacgcttcttcttgccgaatccaaacagtcccatgatgttcctcatttcattacggttgcaaccgtgactagcctagcacccatgcttaatacgggctgggaatcggagtgtgtctcccgttgcccggcattggccggatgacggccgcaaaaactcacacgtcgtaggtgatgctcagcggcgcatgatccgaccatcgcaggtcgtaggtcggagctttgtcgatgacgaatccgcgggccgtttcggcgagttcgggtgtggcgaactggtagtcgatcctccagccgacgttgttgtcgaaggcgcggccccgctggctccaccaggtgtacggtccttggatgtctccgcacagggaacgcatcacatccacgaattccaactcccccagccatttgtccacgtaggcgcgttcctcgggcaggaagccggcgtgcttctcgttggctttcgcgttcttgatgtcgagcggcgtgtgcgcgatgttgaaatcgccgcacaataccgcctgcttgccgccgtgcgccgcttcatcgcgcagttgtcccatacgtaccagcatggtgtcgaggaaacggtatttctgcttcattttctccggatcgtcggtgttgccggcgtgcacgtacacgcatacgacagtgacggtgtagccttgcggggtcttcacatccgcttcgatccaacgaccggaatcgacgtcctcggcaagtcccggcagtccgtagcgtttgtcgatgacgggcagcgcggagagcagaccgacgccggcgcgtcccttgatacggcagatctcgttcatgcgatcaagcccgctttggtcggcgatgcgtccggcggtcgcgtattcgaagccgaattcgtcgaagatggggtcgatttcgttttgcggggcgcgtacttcctgcatgcaccacacgtccggcgtgttcttcgcggcccattgctcaatgcctttgcgtttcgccgcgcggattccattcacattcgatgtcgtgattgtgatcgtcatagcgccttagcctagccggaatacaagaaaacctcccttgtgggaagggaggttttccagatggctgacgcgatcagtcgagtccgagctgcagcttgccgcccgggatggcgtccagcaggtcgcgggtgtactgcttcttcggatggtcgaagacctcgtcggtggtggcatgctccaccagcttgccgtgctgcatcaccacgacctcatcggcgatctgacgcaccaccgccagatcatgggtgatgaacaggtagctcagtcccttttccgcctgcaggtcgttgagcaggcgaagcacctggtcctgcaccagcacgtccaatgcggagacggcctcgtcgcagacgatcacatccggatcgagggccatggcgcgcgcgatggcgatgcgctgcctttggccgccggaaagctcgttcggataacggctcatcaccgattccggcaattccaccatgtcgatgagctcgcgcacacgcttggcacggctcttcttgtctccgatgccgtggatgcgcagcggctcctcgatggaccggtagatggagtacatggggtcgagcgatccgtacgggttctggaacaccggctgcacatgacgtcggaagtcaagcaactccttgcccttgaatccggagatgtctttgccatcgtaggtgacggtgccggcggtcggctcaagcagtttcagcaccatgttggccacggtggatttgccggaaccggattcgccgacgatggccaatgtggtgcccttcttgatggagaagctcacatcgtcgaccgccttgaacatctccttcttgcgcggcagtttgaattccttggtcaggtgatccaccgtgatgatggcttcgcccttcttcagggaatcctcgttcaccgcgtgctccatgaccgcggtggcgtcgccgccatgttccttgacggagatgatgcgctgcgatgccaaggacggcgcagcggcgaccaaacgcttggtgtacggatgctgcggatgctgcagcacttccagtgaaggaccggattccacgacctggcccttgtacatgaccacgatatgctgggcgcgttccgcggccagaccgagatcgtgggtgatgaacagcaccgcggttcccagggaatcggtcagcatgtgcagatggtcgaggatcttcttctgcacggtcacgtcaagcgcggaggtcggctcgtcggcgatgagcagttccggacggcaggccagaccgatggcgatcagcgcacgctgacgcatgccgccggagaattcgtgcgggaactggcgggcacgggtggcggcgtcaggcagaccggcctcggacagcagaccggcgatgcggtcgtccatggtggagccgaccacatacttcttggcgatgtaccatgcgtcatcgtccttcaccccggcttcaatcaggccatcggccacacgccagcgggtttcggatcccggaacccattcctcggcgaaccgggccatgatcttgtcaagctcgtcaccgctcttgccgatcttgacaagagcctccttggccgcggcgatcagatcaggcagttccttggaaccaaggaaggtctcatcgtcattgcccttgagctccacttcgtcaccggccagggccttggcgaattcggaacgcttttcgtggtcgatgtccatgttgttggccaccaacgcttccttgacctgggtgccgatgcgccacaccgggttcaggttgctcatcggatcctgcgggacaagacccatcttgctaccacggagcttgtcgaaatccttctgcttgaagccggagatctcctggccatcaagcttgatggagccgccgaccacatggccggttcccggaagcaggccaagcacggccatggcggaagtggatttgccggaaccggattcgccgacgatggccacccactggccgggatacacgctgaaggacgagttgcgcacggcatgcacggccttgccttcatcggtggtgaagtcgacctggaggttcttgacctccaacagcggcccgtgggcgcgctgcatggcctcgaggttgttctcggtattcatttcagtcatcgaatatcccttcacttacactcaggccgtacggctcttcggatcgagcgcgtccttgacggcgtcgcccatcatgatgaatgccagcacggtgatggccagcgcggcggacgggtagaacagcaccatcgggtcagtacgcaggatggactgcgcgttggagatgtctccgccccagctgaccgtggtggtgggcaggccgacgcccaggaagctcagcgtggcctcgagcacgatgtaggtggccagcgaggtggtgccgaccacgatgatcggagccagcgaattcggcaggatgtggcggaacaggttgcggatcggggtggatcccagagcggtggacgccgtgttgaattcaaggttcttggcttccatcacagcacctcgcgcgattcgtgccacggaggtccagccgaacagcgtcatcaccagaatgatcttccagatggagctgctcgttttgaacatctggagcaccacgatggcgccaagcagaatcggcagcgcgaggaagatatcggtcagtcggctcagcacggcgtcgacccatcctccgaagaagccggcgattgcgccgatcagcgttccgagcagcaccaccagcagtgtggcgaacacgccgacgctcagcgaggtgcgggtgccgtagaccacacgggagtatacgtcgcaaccttgcaggtcgaagccgaacggatggcctgaggaagccggctcaagggaattgtcgagcgtgcagtagttcgggttctgcttggtcaacacgctcgggaacagcgccacgaacacgatgaagatgatcagcagtccggagatgatgaacagcgggttcttacgcagggttcgccatgcgtcggcccacatgttcgaagccggtgcggattcgtccatcgagtcgacggccttcaggggcgtctcatcgagcggtgccacatagcgttcctgtcccggaagcacggtggaaggattggtctcattcatttcggtcatttcttgttccctccctcgactcacgcgtaacggattcgcggatcaagcgcggcgtacagcatgtcgaccagcagattgcaaaccacgaagatcagcatgagcagcgtcacgatggacaccaccaggttgccttctcccttgaggatgctctgataggtcaggtagccgatgccatgcacgttgaagatggtttcggagatcatcgcgccgcccatcagtgcgccaagatcctggcccagataggtgacgacggggatcatggagttgcgcagcacgtggcgcagcatgacggatttgttgtccatgcccttggcgcgcgcggtgcgcacatagtcgagggcgatgttggacgaaatctccgtacggctcagacggatgatgtacgccatcgataccgagccaagcaccatggccggcatcagcagatcaaggaatcctggattcgctccggcggtgaccggcagcagatgccacttcacaccgaggaagtactggcagaggaagccggtgacgaaggtcggcacggagatgagcagcagggagaagatcaggatgacggtatcgcaccacttgcccttcttcaggccggagatcacaccgaagatcacgccgaaaaccgcttcgaacacgaaggccatcagggcgagcttgatggtcacggggaaggcgcggccgatcacgtcgatgacaagctgtccggagaaggtcttgccgaagtcgagggtcagcgcgttcttcaggaacagcagatactggacgatgaacggcttgtccagattgtattcggcacggatctgggccgcgaccgcttcgttgaccggcttgtcgccgaacatcgccttgaccgggtcgcccggcaacgcgaacaccagggcatacaccagaagcgtcgtgccgagaaccacagggatcatctgcagaatgcgtcgcagaagatacttgcccattggtttctccttttgattactcactcgttcgccagccgtttgcggcttcgtcccctacgctcacgcgtataggacatgaggcccggggcggccggcgcttgccccgttacgtatcagtgatactgcaccacagtgctttatattgcagtttcatgaaagacagctgaaaatataccccacgcgcggacatcttctgttgatgtcgcatgtccagccgtcatggacctccgatggaagccccgtttattacgcggaaaggaaggaacggatattcgaatccgttccttccttcatgtcgatcctacgaaatcaaaatcagagaacggctcacttgccggacttggtcatgttctcgtagaccggcaggttctgccagttcatctcgaagccggagacaccggtcgaggccacaccataggcattgtcgtagtacagcggaacggccggcaggtcgttgagcagcacttcctgtgcctgctggtacagcttgttggcgtctgcgacggacttggaggcagcggccttgtcgcacagcgcatcgaactccgggttcttgtagtcgccatcgttggagccgttgccatcggcagcggcggaggcgaagttctgcaccaggtagttttcggcggacgggtaatccggctgccagccgctacggaacgcgccgttcaccttgcggtcggacacggcggtgcggaaatcgttgaaggtcgggtacgggttggtggcggccacgccggcgcccagcacgttgttgatggagttgaccacggcggtgtagatgacttcgtggccaccatcggcgttgtaggcgaaggtgaacttgtcatcggaggtccacgggctgatggcgttggccttcgcccacagttccttggccttcttctcgttgtacttcaggttgccggagcccttgagggaatcggagtagcccggggtcagcggggaggtgaagtcggcggccggggtgccggtgccgttgagcaccttcttgcagatgttctcgcggttgatggccatggagacggcctggcgacgcagggtgccttcctcggtgtcggcttcgaagtgcttcagcttggccgggatggtgaactgctggatgacggagccggccttgttgtaggcctgtacggtggagtccttctggaaggtcttggtggcggaggccgggacggactccatcacgtcgagggaaccggactggatgtcggcgtaggcggcctcatccttggtgtagaccttgaaggtcacgccgtcgttcttggcgacgcggttgcccttgtagtcggggttcttcaccagcacgatctggttgtcgtggtcccaggactggaacttgtacgggccgttgccgaccggcttctcgccgaaggccttcggatccttgaagaaggattccggcaacggagcgaatgcggtgtagccgaccttgatggcgaacacggagtcggaacggttcaggtcgacggtgaattcatggtcgttgacgaccttcaggccctcgagctgttcgtcgcccttgagcttgtctccatcctggagcttgtcgtagcccttgatggtggagaagaaggaggagccgagctgtgcgttcttggcgttggccgtgtagctccatgccttggtgaaggattcggcggtcaccggggtgccgtcggtgaacttccaaccatccttgagcttgatggtgtactgggtggcgtcatcgttggacttgatggactccgccacttcgttggaggcgttgcccttggcgtcgaaggaaatcagacgtgcgaacagcaggtcgagcggcttgccgccgccggtctcgttgcagtcgcctgggatgagcgggttctgcggttcggaattgtatgcggtgatgacgttggaacccttgtcagcggtggagtcaccgttggaagagccgcaaccgctgagcagcatgccgaatgcgcatgcggccgcagcgaaagccagagctttcttcttcatggaattcatattctccttatccattatttccagagccgtaagaccctgttcaaaaagaaggcgggcgtcaataccgtggcatcaacgtccgtcttcgttctgatggtgggttcattatcactcgattgagggacaaccgctccatatccgagggaggcccacgcaaaatagtcaaatcaaaaactcatcatctgataaaacaatccgtttttcccgcttatcgccggaacaacttatccgcatcgtgcgtatggacggacgcggacatatccgttcgctgtcagcgtactttgccaatccgcgtcacgcccgtggaaacgcctgcccgtatcgtgccttcaactgttcgatggacacgtgtgtgtaacgctgcgtggtcttcagcgaggaatgccccagcatctcctgcacctcacgcaggtccgctcccccgtcgagcatatgggtcgccgcactgtggcgcaacgcatgcggactgatgtctggcacgccggccttccgtgcccggtcgtgcaccaccttgcgcaccatacgttgaccgatccgcccgccctgcgatcccaaaaagaacgcgtcgtccgacatgtcaccgcatagtacgggacggccatgttccagccaatcgcgcaaggccttgtcggctggtgcgccgaatggcatgacacgctgcttgtcgcctttgccggtcactttcaccgtgcggttgccgaatgtcacgtcggccacgtcgagtccgaccagttccgccacacgcatgccggtggcatagagcagttccagcatggccgcgtcacgcagcgcgatcgcctgttttttcatattcggttcctgcgatcgcgcctccatgccgtcctcatcaacgcggtccatcagctgctgcgcctgcgtttcgttcaataccgccggcagcgtatcggggattttcggcgtctgcaacgaagccgccgggttggcggacgccatgtcatggtcgtacgcccatgcgaagaatccacgcacggcgacggttttgcgcgccatgctgctgcgtgcgtgatttttggacgatttggccatccacaggcgcaaatcctcgatggtcacctcattcagatccacgcaaccctgtttccgcaacgccaccaagcattcctcgacatcgctgcggtacgccctacgggtgtttgcgctcaaccctcggttggctttcagataggcgtcgaatccgtccaacgcatcatcgaaacacatgcaaaccaccttccgcttcgtctgaaatgaacagacaccacgcagacaccgtataaatgccattccgcagcgcgatcgaatgtcatctcacgcgatggcacgattccattatgtccccataccgatagactgatgacgattaggcatcctacgaacaggcggtattatgactcgtcattccattcatgacgtacagcatccgacagccgaaaaccccgatgatgggattgtggccagcgccatcgacctgaccaaggtctacggctcaaaaggcaacgaagtgatggcgttggatcatgtgaatgtggaattcaagcgcggtgaaatgaccgccatcatgggcccttccggttccggcaagtccacgctcatgcattgcatggccggactcgacgccccttcgtccggcaaggtgatggtggagggcctcgaggtctcctccatgaaccagaagcagctgacggatctgcgccgcgagcagattggcttcatcttccaatcgttcaatctggtgccgacgctgtccgccgaagaaaacatcctgctgccgttgcagatcgcgaaacgtccgatcgaccgcgaatggttcaaccaggtggtcaaggtggtcggtctcgaaaagcgtcttacccaccgtccaagccagctgtccggcggccagcagcagcgtgtggcctgcgcccgcgccatcatggcacgtccgtccgtgatcttcgccgacgagccgaccggcaacctcgactcgcgctccagccgtgaggtgcttggcttcctgcgtgattcggtacgcgactacggccagtcgatcgtcatggtcacccacgatccgcgtgcggcctccttcgcggaccgtgtgctggtgctcgccgacggcaacatcacccgcgacatgcagcatccgacgtacaacgagattcttgaggtgttcgccggcgacgacgatatcgacgacgttcctgcagccgacatggtcgcgccgtccaccgcaacggagggcgcacaggcatgattcgcataggattgcgcgacgcgcgcagccatttcggccgtttcatcatgtcgatcgtggccatcgcgctcggcgtgagtttcgtggtcggctcgttctgtttccgcgaaatgctcaacaaccaggtttcacagatgatgtccaccaatgcggaccatgacgtgtacgtgcgcggttcgcaggagaagaaaaaagattcgtcggcgatgtcgatgggatcgacgaaaagctacaacgatgtcgacgtcgatctggcgggtacgatagccaaggtcgacggtgtttcctcggcacgcgtcgtgcacatgctgtccggcgtggtgctgctcgacaagcatggcgatgcggtgaccaccatggggtctccgacgctcgccataggcatgggcaagtcgtcgccgtggcggtccgccaagttcacgaccggcacgtggccgaagaacggcgatgagatcgcccttcattccttcgccgccgaacagtcgggtctgaaggtcggcgataagacgaaaatcgtctatccggacggcgctcataaggtgaccgtcagcggcatcttcaccaccgatgccagccaggcaggcgccatcatcatcgccatcgatcccgcgacggccaaggaacaggcgaacaagcaatcggacgatccggacaagactgcgttgatcagcgtctacggcaataagaccacgccgcttgacgacaacgcgcagcagcagctggcggaccgtatcaacaaggcgctgccgagatcggcgaaggcgcatgccatcaccggtgatgaataccgtgacgaatcaaccaaatccacgcaggacgcgctcggcttcatccaaccgcttattctgattttcgcggtgatcgcattgtttgtcggctcgttcatcatcgccaacacgttctccatgatcgtgcgcgagtcgatgcgcggctatgcgctgctgcgttccatcggcgcttctcccctgcaagtgttctccacggtgatcgtgcaagctctgttgctgggcctggtaggttcgctcgcaggcatcgggctcggctggggcatggtcaaactcatcgcatccggtttggcgaatatgggtatgccattgaccggcgccaccaatccgaccgtttccgacatgctcgtcggccttgtggtcggcattgtggtgacgttgatcggtgcggccctgccggcgcgaaatgcggcgcttgccccgccgattcaggcgatgaacgaaaccgtcaatccggaaaagcccgtcctcgcacgtggcatcctcggcaccgtcatggtgctgttgggcttcctgagctggggtttcacctacgctttggccgccgcggatggtgacggcggtccgacgccgtggaaggcgctcaacagtatcgctgtcggctggccgctcggtattggcgcggcgctggccgtgatcggcgtgattgtggcaggaccggcatacgtgtccaccgcgggcgcggtgctcggctggctgccatcgaaggccttcaccgtgactgggcgtctcgcgcaacgtaacatttctcgttcgaaacgtcgcacgtccaacaccgcagccgccctgttcgtgggagtggcgattgtcagctgtctgggcgtggtggccacgtcggcgaaggcttcggtcaattcgctggtggataccgggctcaaagccgatttcgccgtatcttcggcttcggccgggcagattcccgaccaggccatcaaagacatcaaaaaggtcgatggcgtgaatcatgtggtgtcgaaccgtgtggtgcttggtgtgaaatatgacggcaaagccatcaacgggttcacgttcgccacacagccggagctgttcaccaagatcttcgccgccgaaaccaccgaaggtgatgccgctgccgcgttgaaggatggcaagctgctcgtcggcaagaccattgccgacgatcgtggatggcatgtgggtcagaaggtcaaggccacggccgagaacatcgtggtagacaaggaggccacagccaaggcgcaggccgattaccaggccaaggtgcaggcgcatgtgcaggaattgcagtcgcaggcccagcaattggccgcatccggcgactcggcaggagcgcaggccaaggcttcggaaatcgaacagtacacgaacgacgccaagaacgtcgatccgaaaacgctggtcaagacgaagaaggtcaccaccggaaagacgctgaccatcggcgcgattgtgtcgaattccgtataccgcgatttcgcgatcgtcaacgacgatttggccgagcagatcggcaacaagcagaccatgttcgtcatgcaggcgttcgtcacggacaagcggggcgccgacacggcccaagtcaagaaggccctgaagaaaacaatcaagaaatactacacaatcgtcgtgttcgatcgtgacgagtacaagtccacgatgagttcgatgatcgatcagatgctcatggtcctgtacgcgttgctggctttgtccatcatcatcgccattttcggcatcgtgaacacgctggcgttgagcgtgtcggaacgcaccaaggagattggtctgctccgtgccatcggcacgtcacgtggccaggtgcgtggcatgcttggcatcgaagcggcgatcatctccgtgttcggcacggtgttgggtttggtcgtcggcgtcgccgcgggagtggtgattcgtgcggtctacgcgtccgaaggtttggagacgctggcgattccgtggttgcagctgctcgtgttcctgctgctgtcgattgtggtcggtctggtgtccagcatctcccccgcctcccgcgcgttgaagcagccggtccttgacgccgtggcgagcgagtgagacagttggagcggaacatcgaaaggaggcagcaatgcctattcccaatgagattccagtaggagcgcgcatcgtggtgcgcaccttggaaggcgtcgatcccaccgatcatcgtatgaagttccgcgattacgtaggccacgtgcgttcgtgggacggtcagaaactggagatgacgcgcgatgcggcggcgaacggctcacgtcccgagcagcgtgtcacgattcccgccgacgaaatcgtgacgatcaagccggtgccggaacgttccatgactcggccacgtccgtagtcgcatgcctccccctaccgcgcgcaaagacaagagcgccgcaatcgcactgatttttctgcgattgcggcgcttttgcatagcgatggcgtcagtcgtcagaccacggaacgcgcctgcgcgatcgcggtacgctcgccgtcgaatcgcacgatatgctcgcctctgcgggcggattccagcagcgtgcgctgccaatcgttttcgggaatcgacagttcgaccgtcgcgcaatgttcggcgtactccggctgcctgctggcggccttgtagtcgcggaacggttggccttgggtgaagaaacggtccatttgcttcacgtcgccttccgtggggcgcacgccggtatcggccatgtcgtgcagcacgttggccaccaacgtcaatcggttggccatgttgcgtagcagggtctccacgttggccgcgtcctcctccaccatggcacgtgtgcggttcggatcggtcagcgccacgcgcgtcatgtcacgccaggacccggctgcgagcgcggccgcgatgttgcggttcgggttggccaccagctcgttgatcatggcggtggcgatgacgtgaggcatatgtgagatgagcgcggcgcaacggtcatgggtggcgtcgtcaagtacgatgagccgattgccgcaacggttcacgatcatgtcggccacggcgcggaaccggcggtattcggtgtgttcgtcgacggtgatggcccagagcgcgtcgtcatagagtgtcgggtcggatgcctcccagccggacagttcgtttccggccatcgggtgtgctccgacgtagcagccgtcaagaccaatggctttgacttggtcgcggaccatgcctttgacgctgcccacgtcggtgagcgtggttgtttccgtgtcgatcaatggtttcaatgcgccgaggatttcgggcatggccttgagcgggttgcacagtacgagcacgttcggtttggtttcggcgagtgccgccaaggtgggtttgcagatgatgccgtcggcttcagcggtggcgtaggggcggtcgttgtggttccatgcggtcacttcgcagccggcgttgacgagtcggcgtgccagtgatcctccgatgaggccgagtcctacgattgcgatgcgtggcttcaccacatcagctcccttctgacggtttcgtcgttctgccaatcgtccggcaggtggctgtcgtcgagtcgtacgccgccttgcggcagcatccatgaggtgacgggcgggttggggcgttccctgcgcgggtagacggcgagtgttttggcccagtcgccatgttctgcgatttccacgagcgcgtcgcggaaacgttcctcccaaggggcagcgtcgagggtgacgatgaagctgtatgtgccggtgcgtcctttgatgggccgtgagatgaagctggtcatgttcagtcccgcgtcacggaacacgtcgagcaggttggcgagcacgcctgggccggtgacgagcgggatgagcgtcaataccgattcgtattcgacgttagcttcggcgcgtggtttggcgagcagccgtgcgacttcggcgcgtggcgcgagcacgaggaagtcggtggcggctccttggtaatcctggatggcggtgccgatgcgggtgatgtcgtacagttcgccgcagatggcgggaccgaaggcgatttcacctgggataaggtcccggcaggccgccgcgttggatgtggccggctgtgtggagagccgatgttcggcgatgaatcgtttgcattgcgcgagaccgtgcggatgggcggtggcgatgcgcgcttcggctggatcggctccttgcgccacgtatgcgtcgaattcgacgttcacaccgacgcgtgcgaatccgacaaggtccttcgcgtcgatcagggcgtcgaggttggggaccacgtacccttcgacgttgttctcccaggccacgattccccagccgtcgccgtgctgtgcggcgtcaagaatctgcggcacatcgtccatgggcatcaggtcgaagccttgcggttcgagccgtgccaactcttgggcggcattgacggccgcctgatgggtgaaggtgccttgtggccccagatagaacagcttgcgtgcgctcattgccgcctgtgcctccttgttgcgggtcatcctaagcaccttagcgcattcgcgaggctgtggaggggtctagtccaccggttgggcggtgtcatggtccggttcagacgattcgttctggtcatattccgtggagtcatcctcagtgcgcggcggcatcgtgaaccagcttttgggcagcgccagcatgatcaatggaatcagcaccacgccgtatagccagaaatagccggcgttgttgctgaaatacggcaacgtcgccgtctcgccgaatccgacgggaatcatggcgtccccgcccggaccgtaaccggccatgacggtccagaccaccagtgacgaactgatcagatgcaatgcgaggcccgatacgccatcacgtgaacgcgccgaccatgtcgagatgatgaccagagcatatgcgatcacaagaccgtagggaatattcgccgacgcgcccatgcggtgcgccatcgtgccgatcacgccgacgacggcaccggcgagcaggtcaaccaaaaaccgcgcccataccggtagacgatgcgaccacggcagcagcctgcggtcgatgccgtcctgtgattgcgattgcggttccggctgtgtttcctgcgtgcgttgcgtcatgtcttccactatgccctacgttccttacaaaacagcaagaaaggcaagagatacgcggaaaaccgccgacatctcttgcctttcttaagcgtttagcgcactagcggaacacactaccgtgcccgcgaagcgccaaaacaatgcgaagaatcacttgttattctgagcgttgttctggcgacgctgcttggcgcgccacttgtaccaatcctcacggctcagaatgatcttgcgcacgcggatggattccggggtgacttccacgcactcgtcctcgttggcaaagtccagggactcttcgaggctcatcttgatcggcggggtcagggtttccagcacgtctgcggtggcggaacgcatgttggtcatgtgcttggccagcgtgatgttcacatccagctcgtccggcttgttgttgatgccgacgacctggccctcgtacaccggggactgcggctcgacgaagaagttgccacgtgcctgcagacgctgcatggcgtacggagtggcgatgccctgacggtcgcagaccatggagccgttctggcgggtcacgatctggccggcccacggagcgtagccagcggagatggaggaggcgatgccggtgccgcgggtggcggacagcaacgcggtgcggaaaccgatcagaccacgggagggcacggtgaactgcagacggacccagccggtgccgtggttggtcatgttgtccatgcggcccttgcggtcggcgagcagctgggtgacggcgcccatgtactcttccggcacgtcgatggtggtgttttccatcggctcgttgaccacgccgtcgatggtcttggtgaccacctgcggacggccgacggtcagctcgaagccttcacggcgcatctgctcggcaagcacggccagtgcgagttcgccacggccctgcacttcccaagcgtccggacggtcagtcggcagcaccttgatggacacgttgccgatgagctcgcgatcgaggcggtccttgatcatgcgggcggtgagcttgtggtccttgccttcggtgccggcaagcggggaatcgttgatgccgaaggtcatggagatggccgggtcgtcaacgtggataagcggcagcggacgcggatcgtccgggtcgacgatggtctcgccgatcatgatgtcgttcacgccggcgacggcgacgatgtcgccagggcctgcggattcgaccggggtgcgctccaggccctgcgtacgcagcagctcggacacgcggaagttctcgatggagccgtccacacgggacagaccgtaggtcttgcccttctcaagggtgccgttgtagatgcggaccagaccgagtcggccgaggaagtcggaggagtcgatgttggcgacgtgggcctgcagcggcgcgccttcctcgtattccggagccggaatgttcttgatgatggcctcgaacagcggctcgaggttgtcgttgtccggcaggccgccgttttccggctggttttcggaagcgtaaccggccttggcggcgcagtagatgaccggaaggtcgaagagggaatcctcatcgaggtcgatgccttcctcgatgacgtcctgggccaggccgagcagcaggtcggaggattcgccgacgacttcggagattcgggcgtccgggcggtcggtcttgttcacgcacaggatgaccggaagcttggcttcgagggccttgcgcagcacgaaacgggtctgcggcagcgggccttcggaagcgtcgacgagcagcacgacgccatcgaccatggagatgccacgttccacttcgccaccgaaatcggcgtggccaggggtgtcgatgatgttgagggtgatgccttccggatggccgtacttggcggccagcgggccggtgtactgcaccgcggtgttcttggcgaggatggtgatgcccttctcgcgttccagatcgttggaatccatcacacggtccgggacttcctcacgctcgttgaacacgtgggactgggccagcatcgcgttgaccagggtggtcttaccgtgatcgacgtgtgccacaatcgctacatttcggatatcgccgcgaaccgccatcgaaacctctcttagtgttgctgttttcttacgtaaacgttcggtacgtacatgctatcggtacttaaaaatccgtacttacacacaaaccgagccaattctagcgaagcattacgacacatgaaaaacggcggacctgtcagatcatgccgacaggcccgccgtcaatcacgcgaagaggcgcgcggaccttaatcctcaagctccttgccagtgcgttcaggcaggcacagggccgccacgcaggcgagaatgaacgccacggcgaaaacgatgaacgccacggccttgttgccaccggacaaggtcaggaaccatggcatcagcagcggcgcgatgatcgcggccacacgaccgcaagccgcggcggcaccggaggcggcgccgcgcagacgtgtcggatagatttccggagtcaccgcgtacaacacgccccaagcgccaaggttggacgcggacagcagcatgccgaagcccagcacagcggccacggaaccggcttgggagaaggcgaacgctgccacggcggacacggcgaggaacacgctcagggtcttcctgcggccccagatctccaccagccatgccgcgaggaagtagccgggcagctgtgcgatggcgatggcgagcgtgtagccgaacgacttggtcagcgagccgaactggtcggccagtagagacggcatccacgtgaacgcgccgtagtaggagaagttcacgaagaaccatgtggcccagatggctgcggtgcgcgcaagatacttcttgccgaacagctcgcgggttttgatcttcggcagcggctcgcccttcggggatgcgaccggttcgacgcctccggcctgttcgaagtagcgcacggcctgctcggcctcatcctcacgtcccttggattcgaggaatcgcacggactcagggatatgaatgcgcgtcacgatggcgtacagcagcggcaatgctccgatgagcagcgcccagcgccatccccaatcgccggtgttcggaatgacgaaatagccgatgcaggcggcgatgatccagccgattgcccagaaggattccagcagcaccgtcatacggccgcgttgtttggtcggagagaattccgagaccaatgtggaggcgaccggcagctcggcgcccaggccgaggccgatgaccagtcgagcgatcagcagagccgccagcgaccatgacaacgccataccgccattggccagaccgaaaatcaccagcgtcgcggagaagaccgtcttgcggccaacgcggtcggccacgaagccgccaagcgcggcgccgatcgccattccgacgaaaccgatggacagcacccagcttttctcggtcggcgtcagattgaaatgcggatcggccgcgatggcggccacgacgaacgacaccagaccaacgtccatcgcgtcgaacgcccatccaatacccgaagccaccaacagcttcctgtgcgccttgttgaacggcagtcggtcaagacgctcgttgcgagtcagcgagacctctcccccgacggtttgttgcgatgcggacatcaacacccctttatcattgttttcctattgtgtcgtgagctcgttcaagcccgacgatggcaggcgatcacgccgtcatcaatgcggataacgcgtcgtcatcctggaaagcaattcgagtgtcgtccgattcggatgccgttccggcttcggtccacaaatccgttcccggcttccggctgtaccggtagaccgccgccggcctgttacggccgatccgcagtttctcaccggtgtcttccaacagtccggaagcgagcattttacggcggaaattcgccaaatcgatacgctgtccggcaatcgcctcgtacacgtcatgcagttggctcaacgtgaatcgctcgcccaccaatcgagtggcgatgtcaggcgattcgattttgccgcgaagccggttcatggcgtattcgacgatggtgcgatggtcgaacgcaagttccggaagatggttgacggggaaccacttgacgttgtcccctccggcgaagtcgattcgtccatcggcctcgcccaccagggcccagtacacgatggacaccatcggcagaccgccatgcgaacgtgccggatcgccgaacgtgtaaagctgctcaagatatttcggatgcagcgacgtcgtcgattccagtgcggcatacgccgactgttccaatgaatggtcggccctcagaccgcctcccggcaacgcccattgccccaaaaaaggctgacggacgcgtttgaccagcggcatccacagggtggagcccatgccggacgaagcggcaccagcgcccacatctgactgcggaaccggtcccaaagccagaatcaccacggatacgccgacctgcggaggctgcttgcgccgttccgagacattgcccatgatcaattgatggcctcttccaatacttcgaattgcttacaggaaaggagtctaacacttatagtcaacatgactataagtgtgtcgagtcgctcataaacaccaagagcccccaacggggctcttgcaaagttcaggccacgatgtcgttggcgatcagctcgcgggccacttcacggtattccttcgccgtcttgtggttcggcgcgtagatggtgatcggcgcggccgccaccgtggaatccggcagcttgatggaacgcgaaatcacggaatggaacaccttgccttggaacgcctcgtagatacgctgcaacacctcctcgcaatgcagggtacgggtgtacatggtgaccagcacgccatacacttcaaggctcggattgatgcgcgactgcaccttctcgatggattgcatgagcagcgccacgccacgcagcgcgaagaattcggcagcgaccggaatgatcacaccgtcggccgcggtcaacgcgttcaccgtcagcaggcccaacgatggctggcagtcgatgatgatcacgtcgtactcgtccttgacctggcgcagcacaccggcaagcacctgctcacgtcccacttcggtgaccagttgcacttcggcggcggacagatcgatgttggccggcataatgtcgagattctcgaaatcggtgtggtgaatcacgctgtgcacgtccatgcgcggattgaacaacgccgtgtacacggtgtcctccaccgcgttggcgttgatgccgagacccaccgtggcggcgccttgcggatcgaagtcgacgatcagcacgcgcctgccgtattggcttagcgcgccgccgatattgatggaactggtggtcttgccgacgccacccttctggttgcacatggcgatgacccttgccggaccgtgcgtctgcagcggctccggtgcgggaaacgtctcataatcacgtccaagcaaatccgtaggcataccgtttaccttaccaacatcctcgtgtcaaaaactccactgtttccatgctagcccatcatcgccgtcagaaacggcagcaacacatgcatctcatgctatcttgcccttggatgcgaggtcagatatgtctcgatgaggttctccgggcttacatgcgtgtagatctgcgtggtggtgacgctcgcgtgacccagcagttcctgcacggtgcgcacgtcggccccgccttggatcagatgcgtggcgaaggaatggcgcaatgtgtgcggatgcaggggcttgtcgatatgcgcgcgttccccggccgcacggatgatctcccacaccgattgccttgacagtcgtttgccgcgcttgttgaggaacaacgcgcgtcgttcggtgggccctttcgccttcgactcgagctgcggccgtccgtttttgaggtatcttgcgatcgcctcacatgcgtaactgccgaccggcaccagacgttgtttggagcctttgcccatcaatctcgcaacgttcgattccaagtcgacatcgtcaagattcgcgccgcacgcttccgacacgcgggctccggtggcgtacatgaattccagcaacgccttgtcgcgcagcatcgcgggatcgtcgggcatgtccgccatgccttcggattgaggccgattctgcgagacggggatcgcgtccagcaaactggccacctcgtccacagtgagcacgtcaggcagcgtcgtcgcgcctttgggagccttgacctgtgccgcaacgtcattggataccacatgttcgttcagtgcgaagcgatggaatgcatggatgctggccagtcttcgtgccttgctgcgcgcggattctccggaatcgtcaagaaaggcgatgtatcgttccacgtcctgcgtggtcactgcattaaggtcttgaatgccttgcgtcgcaagccagccgttgtatttgcgcaggtccgagtcatatgcgcgcaccgtggctttcgcaagtcctcgttccacgtcgatgtacgcgaggaactgatcaatcaagcgttcgatatccgtcatcgtggtcctccgtttgcatcgtcatcatttgtcgtgtccgttccgtcacgttcccgtacggaacgcgttgcccgcatggaggattccaaggacgttcgttccaagtggaagccgtcattggatggaaatcaacattccggaaagtctattcaaagtatccggtatggggaacgcgatacgcaagaacccccgtccgtttgccggatcgggggttctgaagttcacaggtgaaccgtcggggaaactcaggcttccttcggagcgttcacgtcagccggaagagcggccttggcctgctcgacgatggccttgaaagcctccggatcggagacggccagctcggcgagagcgcgacgatccagctcgatgccggcaaggtgcaggccctggatgaagcggttgtaggtgatgccttcggcgcggacggcagcgttgatgcgctggatccacagcttgcggaagtcgcccttgcgagccttgcggtcgcggaagttgtaggtaaaggagtgcagcagctgctccttggccttacggtacaggcgggagcgctggccgcggtagccggaagccctctcgagaacgacgcgacgcttcttgtgggcgtttactgcgcgcttgacacgtgccatatttgattcctcagctttctattaagtctttgtttctaagctctcgctatgctcagcgaccgagcagcttcttcatgttcttgctctgggaagtggccagaacaccgtcggccttcagctcacggcgcttacgagcggacttgtgctcgaggttgtggcgcattgcggagccggcgtgcatcagcttgccggaaccggtcacgcggacgcgcttggaagcggcggaattagttttcatcttcggcattgctgccctccttgtttgttacttcgtttcggaagtcttcggtttgtcggatgccacggcggctttggctgctgccgccgcctgagcctgggcctcctgcttggccgccaaacgggcggcctggcgggcctgacgctcggcacgggactgatcgccacgacgacgctgctcggactgggtgtgaaccttcttgcccttcggcgcgagcgtcatgatgatgttgcggccttcctgcttcggagcgaattcgacggtgccgtattcctccacttcgctggcaagtcgctgcagcaactcgacgccgccaatcggtcgcgactgctcgcggccacgcagcatgatggtgaccttgaccttgtctccgccgttcaggaagcgcacaacatggcccttcttgacctcgaagtcatggtcgtcgatcttcagacggaagcgaatttccttgatttccgcggtgctctggttgcggcgcgcctcacgagctttgatcttctcgttgtacttgtacttgccgtaatcgatgagcttggcgaccggaggcttcgcgttgggcgccacctcgacgagatcgaggttcgcttcctttgccaggttcagtgcgacggaagtcgcgatgactcccacctgctcgccgttcgggccgatcagacgcacctgggagacgcgaatctcgtcgttaatgcgtggttcgtcgctgatgatgactccaatcctcatattccatgcaacggaacatcctttgattggcagttttccaaagtctcgattgttcaaggcatgccaaaacgcatcacaacgcgccgtaaacccgtaagagcggcttacatatctcaccgagacgaccggtggaaggcatctgcctgaacccgaggccctgaaaggcttccaggtggggatatcccgctttcttgatttctcaagccttgtaaataataccacaccccgggaccagcgcgtgtcgcaccggtcccggggtgttcgtcaccattcggacggcatccgctgtcaggcgatggcgatgacgtccggcttctcgccgtcgtgcacgaagtagacgtcgtaccacgtcaggaatgagtacacggtccagatcttgcggcgatcgtcggttttgccggcatagttgtcgtcgatcatcttcagcagcgcgtcctggtcgaagaactggctgacgtaatcgcgttcgaacacggaacggacgtacttgtagaacttctcctcacgcagccacttcttgatcggcaccgggaagccaagcttctcacggtcgtaccattccttgggcagatgacgtcccgccgcctggcggaacgcgtatttcgtgttctcgtcggtgatgaggtacttggtaggcacctgctcggccacgcccatgagctccttgtcgagcagcggcacacgcaattccagcgaatgcgccatggtcatcttgtcggccttgagcagaatgtcacccggcatccactgatgcatgtcaaggtactgcttcttcttcagttcgctcagacccttgccttccacacgcgcatacgtcttgtcgacgatgctttgcacgctcggcgccttgcggtattcaggcttgagcagctgttcggactgcgattcctcaaacacacgcgcctgtccgatgaagctttcctcggccggcgcaagattggcgtacagatgccatgcgcccgggaaggtcttgcccttgcagaaccgggcgatcgccttgcgcgcgccggctggcagatgcgtgagccagcgagtcaccaccttgatgggcctgaatttggtgtgcacgccgtagtcgatgtatccggcgaacaactcgtcggcgccttcgccgctcagcaccaccttcacgtctttggcggccaatgcggacaggaagtacagcggcacgcagctcggattggagtccggctcgtcgagatgccattggatgcgcgggaacgcggcgaacgcctcctcgtcggtcaacgactcggcggtgttgttcagtttgagcagttccgccagttcgccggcctgctgcgattcgttgtacgtgcctttgccgaaaccgatcgaatacgtgtgctgcggacgcgccacggcggcgacgtagctggagtcgacaccgctcgacaggaaggagccgacctccacatcggcgatctggtgcgccttgacggaatcgcacaccgtctggtcgatcgagttcaccagctcgcccagcttctgcttgccttcgcggaaatcctcgtcgtaataccggtggatgtccatcttgccatcccggtacgtgaaatagtgcccttccggcagcttgtagacgcctttgaagaaggtctcaccgatcgccggatactggaaggtcatatacggcttcaacgcctcggcgttgagctccttgacgaaatcggggtggcgcaacaggctcttgatctccgacgcgtacatgaacgtgccgttcatcttcgcatagtagaagggcttgatgccgaaatggtcgcgcgcgccgaacagctcctgcttgttcttgtcccagatcacgaaagtgaacatgccacgtacgcgctgcagcaaatccacaccccactgctcatagccgtgcagcagcacctcggtgtcgcttttggtggtgaaggtgtgtccggccgcgatcaattcctcacgcagcgtctgatagttgtagatctcgccgttgaaggtgatgaccttcgagccatcctcgttgtagatgggctgctggccgccgccgaggtcgatgatgctgagccttcgatggccgagcgccgcgtgctcgtcgatgtaatggccttcgctgtccggcccgcgatgcgcgatcatgtcggtcatacgttggaggaccgggcatttcacgtcaatgggcatatcgttgacgaaaccagcaattccgcacattatctgcaatcccttcaaaacaaactcggtgtcagtgtaccagcatccgcatgtcgaaaaaccgccgccgcgcctccgaaccgattcatgcgtgacaatctccacaggtttcagacattttaggtatgccgcatagccatgaaaatgacgattccttcctttcgtccgtcacggctacactaccgggtatggattcccacgatgcccgcacctgcgtgatcttcggcgcaggcgattattacgatgagacccctgcgattccggatgacgccttcgtcgtcgccgcggacggcggcctcgaccacgtccgagccttcggcatcgacgccgatttcgtggtcggcgacttcgattcgattaccggcggacgccccacgcaaaacgaccacaccatcgcattgccttcggaaaaggacgatcccgacctgctgtcggctttgaagatcggctggctgcgcggcgcgcgcacgttccacatatacggcgcgctcggcggacgaatcgaccatacgatttccaatatccagcttatggcgctactggccgaccgtggcgcgaccggctacctgcacggcgacggatcgatcgtcaccgcgatctgcgacggcgcgctcgatttcccggcggacgacgccgttgcgggacgcatggtctccgtgttctcccacagcgatatctcgaccggcgtaagcgaaacgggattgaaatacgagctgcaccacgccgacatgagcagcacgcgcgtcaacggactgagcaacgagttccttgccggcaggccgtcccgcatcacggtggagcatggcacgctcatcgtcacgttccccatcgaggctcccctgccgcacgtggcgcgatggcatggcttctccggagatctcggtgcattggacacggacgtatcctccgcgctggtcgagccaagcggccgttgaacgcatgcgggacatgcatgtgagcgttcactgaaaatcgcactgcattttggaacacgcgcctcggaacgttgccctaagtacaggtgacgcactacagtggacgatgttggtaaacaatggcttctgtgtgccttggcacacgcgtggcctaccctaaagggagaattacatgacagttaagattggtattaacggctttggtcgtatcggtcgtctggctttccgccgcatcttcgagctgcaggcccgtggcggccaggccggtgacatcgaggtcgctgcaatcaacgatctgaccaccccgtccatgctggcctacctgctgaagtacgacagcacccacggcaccttccgtcatgacgatggcaccccggtcgaggtcacctccaccgacgactccatcgtggtcgacggcaaggaatacaaggtctacgccgagaaggatgccaacaacatcccgtgggtcaagaacgacggtgttgagttcgtgctcgagtgcaccggcttctacacctccgctgagaagtcccaggcccacatcaacgctggcgccaagaaggtcctgatctccgctccggccaaggacgagaccaccccgaccatcgtgttcggcgtgaaccacgagaccctcaaggcttccgacgtgatcgtgtccgccggctcctgcaccaccaactccatggccgccatggtcaagctgctggacgagaactggggcatcaaggctggcttcatgaccaccatccacgcctacaccggcacccagatgatcctcgacggcccgcgcttcccgaaggctcgcaacaaccgcgccgccgccatcaacaccattcctcattccactggcgccgccaaggccatcggcaaggtcgttccgtccgtgaacggcaagctgcagggccacgcccagcgcatccaggttccggatggctccgtcaccgagctgaccaccgtcctgaacaaggaagtcaccgccgatgagatcaacgccgccttcaaggccgccttctccgacaccgacttctacggctacaacgaggatggcatcgtgtcctccgacatcatcggcgacacccacggtggcgtgttcgatccgacccagaccgatgtcaacaccgttgacggcctgaccatggctcgcaccgtctcctggtacgacaacgagtacggcttcacctgcaacatggtgcgtaccctgctgtacttcgccgagatctccgagtgaatcggcgcggagtaatccgcacggttcgtctctgaacctcagacaaaggggctttcgcttcggcggaagccccttttcgtatccgaaacgccgcaacggacacgtggaaggcttattatgggcggcatggcaaagaaaaagcatgagaagggcgccggttccacaccggccaccgtgcagttggaaaaagccggagttccgttcaaaacctacgaatacgcgcattcgaacgatcacatggatgacggttatggggttgaggccgccaccaagctcggtttcgacgagcatcaggtgttcaagacgctgatggcggacaccggctccgaacgcgtggtcggcgtggtgccggtcagcggtcatatggatttgaaagccttggctgcagccgtaggtgccaagaaggcctctatggccgatcccaaggtggcgatgcgtgaatccggttatgtggttggcggcatctcgccgttaggccagaagacacgtcataagactgtgttggatgaaagcgccctgcaattcgaccaaattctggtctccggcggcaagcgaggcctgtctgtgggcgtgaatccacaggacctgctcaaggtcttgaatgccgttgccgcaccaatcggcacgtggtaaatgaatcagctttcagccactacattttctcggctattctctatatttcgttgagatctcttctctcatacataaaattcaagactgacggtcgcataaataacgtaaccatcagtctcaattattgtactttactaaccccgaatgtttcactgcttttcaagagtgaactcgtgatcgcctccaacgtcaaaagtcatgtcattattttcaattgaaactctcacagtatctcctgtattaagttcgacatcaaaccaattatcttctggagagcccgaaacgaccttcccattctgaatattaaccaatcctgcgccaccccacacttcgccgggaacgctatctattgtaacttcatctccggttttttgatcataataaacgacattagcggacaaagtcccattcttatttatggtgaaggtataatcacatgacaatgagtagaattgcatttcttttatgttgtctccctgaccacaatcctccagcatcccttcgtatgtgccatatggattactacccaatggaaccgaacatgcggaaataagagttccaataatcaaagccaatacaacaacagaataatatttaatttttctattcattctacttcctttattcgtttattctgttataaattaatcactgtatgtcatatgtaatcgtggactcccctgttccagctgcttgtatatggcatactgtaaaacctttattgtgcgtacatcgagcctgtgctacatcagtcaaaggtgagaactctatattccaaatcgaactgccatagatacctgaatattcatcaatttgattttgcaatccaagcccttccagatatcctcgcaatcgttcaccagcagtccctgaatccaagcccggctcataaccgacgtcccacgcaatacactccagccccatcgtgactgcataatcatgagattctaaatcatagccgccatacatcctcatacgatcataatttggtcctttaaattgcagatatgcaatactgttatcgtctctatctcggtcaattttaaaatatgcatcagcgctgtttccactaaatacagaattgtattgatcagagcaatgaaatatactttcgaaattgatttctctggtcactgattgcggattatcggaggcatcattgtcttctttggaatcatctttgtccgcatcattatcctcgctcacatttgtttcatcagcaggctctattgccttgcctatttcttcattgcgcgtttttccatcgttgagcatagtctcatatttttttgcaaatataacgctaccaagaacaaggagaacaaccaccagtatgataaataatgctttctttttcatagctggctcacacctttactccatattccaagtaactgcactacttaagatagaatcaaccgtgagatcatcaatgatggtgtttagacgcactaagacaggacgacttttgtgataacgaataatcagacgaccataaaagggccgaagagatgaccactcttcacccatgtaggcagggccaggaacagatcctttaggagcaagctccctgacaatcgttttgattgttgtcaacaaccataaatcagaatttttcggcaaccgcataagacacatacccgactctcctatacgaaagcgatctatcttcgttctccacagaaaccagccatcgttaacatttgaaggagatttcatatattctttgtatgctgttgtttcttcattccggtcaacaaaacgaaccttcatcgtatccagctcatgcttggacaaatgcagaacactattcaacgcaataaatgacccgctcatattttgcgaagcctccttccggccttcccttcggctcttatgccgatgccgaaaacgatacccccccccagacaaaacgacgggctcatggttcacgatcacttaaaaaagaaaggagcctaaccaccaacggccttcaacggcaatatcctcggccccgaaccgcaataaccgaccgactccagacacggccctgaaccccaataacaccgcccattaccaaaaaaatcaaatattcatattgcagacaaaccgatgcaattcgaaactgaatttatagatggcaaatgataccttacaaaaatgtaggcacatcaatatcaactatagttgaaaaaaaagactgtacactattctcatatcttcaatggcattaatcagcattactaatctgtaaccatacgaatccatcattaaaatgcctgataagcaatctattgaaaaggccgcttacgcaattaggcagactgagccgtaaaacggacagcccagtgggctgttcgtaggcgaagcgagcggtttaccgcaagggtttcctgcgcaactccgccggcagcacgaagtgcatgttttccttgatggtttcgacggacttcataccggtgaagcccaagttttgcagagcgtcaatcacaccggacaccagttcgtccggtacggaggcacccgaggagatacctacggattccagaccctcgaaccatgccgggtcaagctcgctggcatcatccacgcgatacgctttgccgcgctcccccaagccctcctgcgccacctccatcagtcgcacggaattcgaggagttggccgatccgacaatcaccacgcaatcggactgctgggccaccagtttgaccgcagcctgacgattcgacgtggcatagcagatatcggagttcggcggcatttcaagccatgggaaacgagctttgagcgcggtgatcgtgccagcggtctcatcgacgctcaacgtggtctgcgtaagcagcaccagtttcgtgtcaggttggaaatccaacgagtcgacgtcggacgcatgctcgatcaaatgcacatgttccggcgattcctccaccacgccaacggcctcatcgtggcctttatgcccaatgtagatgatctcgtaaccttccttgacgaaacgcagcacctcgcgatgcactttgcttaccagcggacaggtggcatcgaccacatgcatgccgcgcgccgcggcctcggctttgaccgccggagacacgccgtgggcggaaaatacgattgggatgccggcttcggcggcggcatcggggatctcagccaattcctgcacgaacaccgcgccctgcgcggccaaatcctcgacgacatgcttgttgtgcacgatctggcggcgcacatacaccggcggcaatccgtcggcacgtggcgtatcggcggatttgagaatcgtccgcaccgtcagaatcgccctatccacgccggcgcagaatccgcgcggatccgccagcacgatgcgtttgcccatgtcaagccgccttccaatcgtatccatccatcacaacagcaatcaccaatattaaggcacgggcgccatcaatcgacatcggccgtcttcatccgcagaatttccacacgacaagcgcatccaccaccacatcgtgagcggtaacatagtagcggaaacacagtcgacaacactatggagtgatttatgacctgcaccaatctgccgccacgcaccggacagcaattttccatttcgcatggcgattaccatgccgtcgtcaccgagttgggcgcgacgctgcgcaaactgacctaccagggcgaggacatcatcgtctcccccggtccggatgacatggtgacctgctgccacggccagctgctcatcccgttcccgaaccgcatcgaaaatggcgaatacaccttcgaaggcaagacctacacgctgccgatcgacgagcatgagcgccacaacgccatccacggctacggcaagcgcgcgttctggaagcttgtctcccttaaagaggatgccgtgaccctcagctggcgcgcccccaacatggagggatatccgttcgacatcgtggtgaccgcgacgtacagcctcgccgacgatggcctgcatctgaacatcagcgcctacaacaacggcgatgcggacgcaccgtgggccttggccatccacccgtggctcgccaacggcttcaacggatacggcgatgagatcgacgcccacaacgccaagtgcagcctgaccgtgccggggcgcacgcatgtcaccgtcaacgagaacctcattccgaccggcaccgagccggtggacggcaccaagtacgacctgcgtaaggacacgctgctcaccgagcagccgttcgacgacgcttggacggatctggagcacgccgaagacggcaccgtcaccgcggtgttcacccgtccggacggcaagaaggtgcgtgtgggcggcgacgagaccgtcacctcgttccaggtgtgcaccggcaccggtttcccggccatcaagcatccggccggcgtggcggtggaaccgcagacggcatacgcgaacgcgttcaacaccggcaaggacctcatcgtcatcaagccgggcgagacgtcaagcacggcgctgttcatcgggatgctcgactgatataatcaccatcggaataagtcccggccacacagcggacgccgaatttggcaaacgtctcgctcgtgtgcgataatcccgaaggcttattaatcgcaagtaaaggagtccaatcatgggcatgcgcggacgtaagcgcaaggatcgtcgtaagaaggccgccaatcacggcaagcgcccgaacgcctgatccctgccggcgcgaatagcgtcacagagcatggaaaaccccgcggaatcattacggttcgcggggttttcccatattcagacgctgatgcggcgggcacgcctcgcggcacatcatcgtggcacttggcgcatgaaacgccgcacgtccgcccaattactcgtcacaacagtggtcgagtgtcgcctcaagcctgtcgatcaggctttgcggcgcgtgtttcggccgcaggtacgcgcgcatcgttgcgatcagcgcacgttcgcgttcatcgcaacaggtctctgggtcgaagcagtccccggaggccacgacatgcacgctggcatgcgtcacctgcgtcaccacaccgttcgtgttggtggtggtcgaagtaatggagatgtgccgttccattggttcgctcatggtcgatccttcccggcagtggcatagccacgttccttggcgtaattggcaagctcacgtttcagctgtgtgcgggcgcggttgagccggctcatcacggtgccgattttcacgccttgttcctcagctacctggctgtatgatttgccgtcgatcgcggcgtcgatgaaaacctgcctgcgttccggggaaagccggttcaaagcggccatgatctcctccggcgcataggcgtccaagtattcctgttcggcggatttgagctgttcggaggaatgctcggacgcggaatacaggtcccagtcgtcgtattcgccggtggaatcgttggcgcgttgcggccgtcgcttggctttggcgtactggttgaaataggcgttgcgttcgatggtggtcatccaagccgcgaaattcgttccttccttgaaggagtcgaacgccttgaatccacgttcgaaggtgtcctgcaccagatcctgcgcgtcgtcgggattgttggtcagtttcatcgcctgccggtacagcgagtccacaacgggcatggcaagcttctcaaaccgcgcgcgccggcccgccatggattccgtttcttgttcagtcacaccctcattgtaacttccccgacgtcacacgtcgtgcacatggttgccgctaaaatggctcttcggtatccgctcggcgtctcatacacagggagaacacgaaaacatggctttgactctggaatcggcggcccgactgctcgataggcacggactgctgcgcgaaatcatccgcggcgatgtctggacgcttgatccgcacgacatcaagggattcgacgagccgttctccgcaatcacctacgacacccgcaaggtggagccgggcacgttcctgtgctgcaagggccgtttcaaggccgaatatctgcagggcatcgacgaacgcggccttgccgcctatgtgtcggagaacgacttctccgacgccacgcaagctccgggccttattgtggatgacgtgcgcaaggccatggctttgctatcggctgaattctatggtcgtccgcaggaccagttgaaggtggtcggcatcaccggcaccaaaggcaagaccaccaccgcctatctcacgcaggcgatgctcaatggctgttccggcggcaagtgcgcgctgttttcctccgtggacaattgtcttgacggccacacctacgtggaatccgatctgaccacgccggaatccatggatgcgttccgcatgatgcgcgaggccgttgataacggcatggaatatctcgtcatggaggtctcctcgcaggcctacaaggtggaccgcgtgttcggtctcacattcgacgtggccgcgttcctcaacatcagcccggaccatatcagcccgatcgagcatccgacattcgaggattatctccactgcaagcgtcagatcgtcaagaactgccgtgccctcgtattgggtgccgattgcgcgcgcgccgacctcatccggcaggacgcacgtcatgccagcgttcccgtcaccacgttcgcgcttggcggcgattccacggcagacgtcatggccacgccggcgaatgacgatcacagccgcttctccatcgtcatcgacggcacctcgatcggcgagttgagcctgacattggacggcgatttcaactatgcgaacgcggcggcggccgtcgcgatcgcccatgcggccggtttcgatttcggttccgcacaggccaaggacgcgttgcgtgagatggagccggtacgcatcgccggacgtatggagcatttcaaggacacgcggtcgaacaccatcgccattgttgattacgcgcataactacgcgtccgtcaccgcgttgcttgactacgtcgatcagcgttacggcagcgaaaagccggaaatcacgctcatcaccggctccgctggaaacaaggcatacgatcgtcgcgccgaaatcgtccacgccgcgcaggaccgcatcgaccatctcgtgctcactttcgaagacaccgacgacgagcctgtggaacaggtctgcgcggacatgaacgacagcgtcaccaacccgcagcttgacgtgaagaccattctcgaccgtgccgaagccgtggagaccacggcaagccgcgatcgcaaggatcccgagcatctgcacatcatcctcatcatcggcaaaggcaacgaacgttggttcaaagaccacggcaagcacatcccttacgagggcgacgaccgcatcgtggaacgcgtgttccgtctcaaataacaactaaggtgaaggcattatgacacgattccaaccgattctgctgggcagcgacatcaacgtctacggcatggccagggcgttccatgaggagtacggcctcgtttccgaggcgtatgcgtatttccagctgagccccacgaaattcagccgtatcgtcaacgtgcacatcgtcgacgatttcaacaacttcgtcacgttccgtaatttcatgctcaagctcggcaagcgtatgaaggccgaggatccggaacgcgtgctgctgctcatcccctgcggcgacgtgtacgccaatctgctgagccagtgcggcgacgatcttcgcgaatatttcgtatacaacacgcttgacgcgaacctttcgcgccggctcgcctacaagtccacgttctaccagatctgcgagcagtatgatctgccccatccgaagacgcgcaccgtcaccgccgatgaggtgaaggcaggagcctaccgtgatttgccgttcagctatccggtggccatgaagcccgcgaattcggtggaatggctcaacatcgatttcgagggccgtcgcaaggcctacatcttcaacgatccggccgaattggagaccatcatcaagcgtgcgtacgatgccggatacacgtccgaaatggtgattcaggacttcatccccggcgacgattcccgcatgcgtgtgctgaacgcctatgtggaccagcatcatcgcgtgcgtatgatgttcctcggccacccgctgctggaggatccctcccctgtcgccgcgggcaattatgcggccattctgcccgactacaacgagggtgtgttccgtcgtatcaaggctttcctcgaggacatcaaatacgagggcgtggccaatttcgacatgaagtacgacgaacgcgacggcgagtacaagctgttcgaaatcaaccttcgccaaggacgttccagctatttcgtcacgctgaacggattcaatctggcgaagtatttcgtcgacgacctcgtcgaggacacgccgttcgacggcaacaccctgttcggccgcggttcgaagctgtggcttgagattccgaagtcgattttccttgattacgtcgcagaaggcgctgacaaggaaaccggcaagcgcatgctcaagtcgggcgattggggtaccaccttggagtattccaaggatatgaatccgctgcgttggctgatgattcggcacatgttctcgatttacaagaagagctatgccaagtacttcaccaagaagggcgagcttaagtgaaacgaccgtttttcgccgtactgggcggcatgggcacgctggccaccgaaagctacatccgcttggtcaaccgcgccacgcatgcccattgcgatcaggattatctggactacatcgtcttcaacgattcctccgtgccggaccgcaccgcgtacattctcggcgaatccgacgagaatcccttccccgtactcgccgacgatatcgagaaggcaacggcgatgggcgcgagtttcattgtgctcacctgcaataccgcgcactatttctatgacgatttccaggcgttgacgacggtgccgattctgcatatgccacgcggcgcggtggcacgcatggctcaacgttatccgaaggatcgttttccgcgggtcggtttcctcggcaccgtgggttcgcgcaaatccggcgtgtacaagcgtgccgtcgaagaggccggatacacgttcgtcgaaccgaccgacgagttgcaggcccgtatcacttcgctgatttatgacgatgtgaaaggtagtggcgagctcaatctggaacgctacgaatcggtgttgcgcgatatgctcgatccggcaggcccctgcgcgtgcgacacgctgatattgggctgcaccgagctgagcgtgctcaacgaggcgtttccgctgccccagctgccggtcatcgacgcgcaggccgtgctggtggaagataccgtggcgcgggccgaagcgttgcgcgcgtagctattatttgtcacgcctatcttcgactgcttaggcgtcggacgataaaacaaggttgtgggtggcttcccattgcctggggagccacccacaatctgttttacatggacgatgtacgccgcacgtatggcgtcatcgtccgatgttgtttcgcttcgtcacttcgtttcgttttccgaagccgtttccgcatccgccggttcgttggcatccgccgcctcacccatttcatccgcatcggcgtctgctaaaacggaatcgtccggaccgacgctgccgaaatcgttgatgttgaaatcagggttggcgtcggattcgaaatccacgtcagcctcgtcctgctttttgcgcggttccggatcgacggcttcctggaacacacgttcggcctttggcttcttcaggtcggggttgatcttctcctccagcatgagtcgcgcatcaccggcggtggtgaagctgccacagacgagcacgccatgaccgtagccgacgcccagttcgtcatcggcatcaaccatgttgacggcttcctggatggcgtccggcaattcgggaatgcaggtgacgcgttccggcccgaaaacacggtccgcgatcttcttcagatcctcagccggcatcactcggtcacgccacgagttctcggtgacgatcacatggctcagcaacggttcgagcacgcccagatactcctcgacctgcttgtcccccatcatggcgaccacgccgacgagctgctggaaatcatagttctcttcaatggcggcacgcagcgattcggccgcgttcacgttgtgtccgccatcaaggatgatggtaggcgaggtacgaatttgttcgatacgtcccggaatgcgtacgctgctcaacgcttcggccaccaaatcgccgtccaacgcgccgttgacgggaatcaccacttccgccgcgcacagtgcggcgagcgcgttgtgtgcctgatgctcgccgaatttggcgatcggcacttccgtgtaggtgccgttcggggtgcgcagggtggccacctggccgccgacggccggcactcgggtaacgacttccgattcgacgccgtcgcgcaccaagctggcgtggttctccttggccgcggcctcgataatcggcatgacctcgtcctcgtgtggctggcggccgatgatggcggtgcagttcggcttgatgatgccgaccttttccgtggcgatttcctccacggtgtcgccgagccatgccatgtggtccatgtcgaccggtccgatgatggccgcgtccgcgtcgagcacgttggtggcgtcccatcggccgcccatgccgacttccacgatggcgacgtcgaccggcgcgtcggcgaatttccagatggccatggcggtgagcacttcgaagaagctcatcttcggcttgcccagctcgtccattttcatgtccacgatggcgacgaggtccttgacctggtcccatgtgtcgacgaaatcgtcgtctgacagctgctggccgtcgatggcgatgcgttcgttgacgtgttccagatggggcgaggtgtataggcccgtacgcatgccgtaggcgcggcagatggcttcggccatacgtgccgtggagcccttgccgttggtgccggtgatgtggatgacgcggaacgactgctccggatggcccatgatgtcgaggatcatcttcatgcgttgcaggtcgagattggtggtgttgcgttccgatggacggctcatgatgtcgcgttcgacgtcgatcatgctttcgttgttgcgattgggatgttcgaatgacatatttcccgttttcctcccgtaccttgcggacagcacactaaacttttcccattctagatgtccgcatgaacgttgcgcgccgggaaaagttataggatgggttgcggtaatttccgtacgttacgaatgcatgttcaggagatgtgatgggcgaagtcattactgacaaggacaaggaatacgagaagatggagcgggaggccgctccgggaccggatcaggccatgagcgatcgtgtgaacaatcgttcgctgcgtccgcgttccgaggcgttcaaggagttcatgaccaccggttgggatgacaacgagccgcagatcgagccgttggagtcctccaagtacacgccggcgcgtctggaggcgttgggcaaggcgttcccgggcgagcgtatcgtgattccggccggacagccgaaggtgcgcaacaacgattgcgattacgtgttccgtccggatacgacgttttcctactacaccggtttgggtgaggatttcgaggccggcgcggtgctggtgctgaatcccgtcgatccggattctccggaggcgaaggccggcaagacgcatgttccggaactgttcgtggctccgcgtgccaaccattacacgcaggactttttcatgaacgcccattatggcgagtattgggtgggtccgcgtgccggtgtgaaggaaatgaccgcgatgaccggcatcgaaaccaacgacatcgcgcagctgcccgacgcgttgagcaaggatgtcggcactgaggccggcgcggtgcgcgtgcgcgtgatccgcgaagccgatccggcgattaccagcatggtcgaggagatccgtgaagccaacggtttcgccgatccggacaacaacaccgctgccgatgacaagctgcacgaattcgccgccgaggcacgcatgtgcaaggatgagtatgaggttcgtgagatgcgcaaggcggtcgcggcaaccaagcatggtttcgacaacattctgcgcaagattccgtcttcccttggcaagccgcgttcggagcgcatgctggagggcgcgttcaacgccatctcccgtgaagaaggcaacgaggtcggctacgacaccatcatcgcttccggcgcccacgctccgattctgcattggatgcgcaataccggtaccgtggagtcgggcgagctgctgctcatcgacgccggtgtggaggtcaacagcctgtataccgccgacatcacccgcacgttcccgaccaacggcaagttcaccgatttccagaagaagctgtaccaggccgtgttggattcccagcaggccggtttcgaggcggccaagccgggcgccacgtattcggacatccatcatgcgtgcatgcgcgtgatcgccgaacgtctgcatgactggggtattctgccggtcgatgtcgaggagtcgctctcccctgaaggccagcagcatcgccgttggctcgcctgcggcgtggcccaccatctgggtctcgacgtgcatgattgcgcgcaggcgcgttatgagtcgtatcagaatgccaagattcgtccgggcatgatcttcaccatcgaaccgggcctgtacttccgtgaggatgatctgctgattccgccggaataccgtggcatcggcattcgtatcgaggatgatgtgctcatgacggaggatggtccggaatggatttccgcgggcattccgaagcagatcgacgatgtcgaggcgtggatggccgatatggccgccgaaggcgtgaaggcctgaggacgcatcatgcccacgcctgaattcgtgctctcgctacgtgaaaaaataggccacgatctgttatggctcatgggcgtctccggctatgtcgaggacgagcagggccgtgtgctgttggggcgtcgttccgacaccggcgaatgggccatggtgtatggcatcaacgagcccggagaggaaccggccgataccgttgcccgcgaggtcaaggaggagaccggcgtggatgtggtcgtcaccgatctggtgtcggtcaaatcgtccagaaaggtcctcacctatgcgaatggggacaacaccatgtacatggatcacctgttcatctgcaggcccgatccgaatggcaacacggagccgttcgtcggcgatgaggaaagcctcaacgtgggctggttctcccctgatgctctgcccgaaccgttggcagccaccacggtggaacgcatggcttacgtacgcgaatatctgaaggccaaggcgaatggcgattcccatgcccagtttgccttcaacggcaccatccgctgaaatcgccttccatacatcataaaatggaatccccgcaacgtttcaagcgttgcggggattcctttttattagattccgtggatcagctcactgctgggcggcaagcagctcatgcagatgctcgcgatgcttgcgctgttcgcgcggatcgggcaccggcagggaggccagcagcttctgcgtgtatgggttctgcggattctgcatgatctggtccgcatcgccatgttccacgatctggcccttgtgcatcaccatgatgcggtcggcgagcatgtcgaccacggcgagatcgtgggtaatgaacaggcatgcgaagccgatttcggcctgcagcttcttgaacagttccagcaccttcgcctgcaccgacacatccaacgcggaggtcggttcgtcggcgatgagcaggctcggcttcaacgccaacgcgcgtgccaaggaggcgcgctggcgctggccgccggacagctcgtgcgggaaacggttcatgtaggcgcgcggaagctgcaccatctcaagcagatcgcccacatacttgcgggcgtctgataccgacgagaacttcttgtgcacgatcaacggttcggccacgttttccgcgatggtcatcagcggattgaacgagctgcccggatcctggaacacgaagccgatgtcggcgcgcttgggcttgaaatcacgttccttcacaccgttcatttctatgcctagaacgttcagggaaccgccggaaaccttctgcaggcctgcgatggcacggccagtggtggatttgccggaaccggactcgcctaccagaccgagcacttcggaacggtggatggtgaagtcgatgccgtccacggccttgaaatcaggctgcatgagatgacccggatacgtgatggtcagtcccttggcctcgaccgcgatgggctgatcgcgccaatccttctcacgttcgatgaccttgccatcggcatccttgacgaccagtttctggccaatacgcggcacggcggcaagcagacgcttggtgtagtcgtccttcggcgagtagaagatctgctcgacgctgccctgttcgacgacgtggccgcggtacatgaccacgacctcatcggcgatgtcggcgatcacgcccatgttgtgggtgatgatgagcacggatgcgtcgaactcgtcgcgcgccagacgcagcaggtcgaggatttcggcctgcacggtcacgtcgagggcggtggtcggctcgtcggccagaatcaggccggggttgagcaccagggccatggcgatgacgatgcgctgcttctggccgccggagaactggtgtgggtagtagtcgatgcgggtttccgcgtccggaatgccgaccttcttgagaatgtcgatggacttggcacggagttccttcttgtccttcatgccatgggcgcgaaggccttcctcgatctgccatccgatggtatacaccgggttgagcaccgaattgggctcctggaacaccatggccgcttcggcgccgcgcatttcgcgcagctgttcgccggacagcgacagcacttccagctcctcggtgcccgcgcggttcgacaggtacaccgcgccggaggtcgtagcggtctccggcagcagcttgatgagggagcgtgcggtcacggacttgccggaaccggactcgcccaccacgccgatgaccttcttacggggaatttcgaagctgatcttgtcgatggctttgatggaaccggcgtcggtcatgaacgagacgctgaggtccttgatctcggcgagattgccttccttgatttcactcatcggttcactccccttcctcggaagcccattcggaagccacgaatgacggatcacggtcggtgacggtcaccggtttgtcgctggctcccatcggattcttcgccgcctcaagttcggcgacgacctcgttgcgcttgcctggctcctggctggggtccacggacgtgtcttcgatggaacccaccacttcgcctgcggacttgcgggcgcgcagacgcggatcggccagatcgttcagcgattcgcccaccagggtgatgcccagcacgatgagcacgatggccagacccgggaacacggcggtccaccagatgccggcggtcacatcggagacggcgcggttgaggtcgtatccccattcggcggccgcggtcggttcgatgccgaagcccaggaagcccaggcccgcaagggtcaggatggcttcggaggagttcagcgtcaggatgaccggcagggttcgtgtggagttcttgaacaggtgcttggtcatgatgcgccacgtggaggcgccgaccacgcgggcggattccacgtacgcggattccttgatgcggatcacttcggcacggatggtacggaagtattgcggaatatagaccacggtgatggagatgccggaggcgaagatgccgctccacaggccggactggccgtgggagatcatgatcgccatcagaatcgccagcagcagcgacgggaaggagtacacggcgtcggcgatcatgacgagcacacgatcgacccatccgccgaaatagccggagaccaggccgagcagcacgcctgcgaaaatcgacagcaataccgcgacgacgatggcgatgacggcggtgcgggcaccccagaccacacggctgaacacatcgtagccacctgcagtggtgccccagatgtgttcggaggacggtgccgcctgggccgggaaggaaacgccgtcggcgcccttgagctgcgcgtagctgtatggcgcgatgagcggcgcgaaaatggcgaccagcaggaagaacgccgtgagcacgaggcctgtgatcagcatgcctttctgccagccgactgcgacgcgtagttccttgatgatcggaatcttatgccagaatggcgtcttgttgccgagcttgagctcgtccagacgattgtcgcctggaacggtgaccttgttggcagatgctgcggtcatgtcagtacctcactctcgggtcgaccaacgcggcgatgacgtcgacgatgaagttgacgacggccacgatgatggcgattaggataacgatgccctgcacggccacgaagtcgcgtgccttcaggtactgcgacagcatgaagccgagtcccttccattcgaaggtggtttcggtgagcaccgcgcctgcgagcatcagggcgatctgcatgcccatgacggtgatgattggaatcaacgccggcttccatgcgtgcttgttgagcagacgcttctcggagacgccgcgggaacgtgccgcttcgacgtagccggaattgtaggtggcgatcacgttggtgcgcaccaaacggatgaacacgccggcggtcagcaggcccaacgcaagggccggcaacacagcgtgacggagcacatcaagcaacacggacatatcacccaactggatcgcgtcgatgatgtagaagccggtcggcgagaccagtcgggagaactgcatctcgctgccaagcgatgagcgcccggatgccggcagcacgttcagccagatggcgaagatgagcttcagaatcaggccgaggaagaacaccggggtggcatagcacaggatggcgaaggtgcggatgcccgcatcggccgcgtggtcacgcttgcgtgcggcgatgcgtcccaagccgatgccgacgatgagcgcgacgatgagcgcgaggaacgccagctcgaatgtagcggcaccatagtgagtaaggatggtactcactttttggttatcggtcaatgtggtgccgagatcgccatgcagcaggccgccaagataatcgatgtactgcacgatgagcggacggtcataaccggccgcgtggatacgcttctgcagttcctcgggagtgagacggccaccaagagcggcggaaatcggatcgccggtagcgcgcatcacgaagaagacgatggttacaagaataaatactgtaggaatgatcagcagaaagcgtgtgagcacgaaacggaagaatccgcttgaaagcttgtttttcttggctttcggctgagcctcggttgcgctttgcgtcacgtcgggctccttttccttattggtgttttagatacaaattgagcccctgcctgacttaggcgggtcaggcaggggcggtcaaagccttccgtcaggccttggtcacggacgagtagcggaagcggaaggaagcgtcaaggacgacacccttcacattagaaccggtgaccgcaacctgggcaccctgcagcagcgggatggtggacaggtcatcggtttcgagcttctggatttccttcaacaggtcctcacgggccttggcgtcagtctctccggcctgcttgacgatcagatcgttgacttccttgttggagtatccgttgttcacgaagttgccgtcacggaagaatggggacaggtagttgtccggatcggagtagtcagggaaccaaccgagctggtagaccgggtaggaaccatcggaatcctcggtgaccacacggtccttgttgaactgggtccattcggtggactgcaggtcgaccttgaacaggccgccttcctcgagctgggccttgatggccgcatactcgtcggcggaggactggccgtagtggtccgggttgtactggagcttcaggtctaccggggtcttcacaccggcggcttcgagggtcttcttggccttggccgcatccggcttgccggaaccgtcgccataggcttccttcagggtgtcgtcgtggccggacaggccatccggaatgaaggagtacagcggggtgtaggtgctcttgtagaccttggtggccagctcgttgcggtcgatcaggcttgcaacggcctgacgcacggccttggccttgtcggcgttcggctcgctggacttctcgccgtacggcatgatcttgaagttgaaggcaaggaagcgctcttcgccgcccggtcccttgacgaccttgaccttgttgtccttggacaggtcctcgacgtcggtcggggtcatggagcggtaggccacgtcgacctggccctgctgcacggccatcttcaggttggaggaatcggcgaagtacttgacctgcacaacgtcgttcttagctggggtcaaacccttgtaggaaacgttcttggcatatgccagggcctcgttcaccttgtaggaggtgagcttgtacgggcctgcgaaggcgttgtccttgacgatggtgttggcatcggtcagcttgtcggcggagaaggactcttcgtcgacgatcgggccggccgggctggagagcacctgcttcagggtcacgtcgtccttgaccgcggagtggaacacgacggtggtgtcatccttggcctcgacggactcgatgttggccagcagggaggacggaccgttctcgtcgttgatcttcttgatacggtcgaaggagaacttgacgtcggaggcggtcagatcgtggccgttcgcgaacttcaggcccttcttgagcttgacggtgaactcggtgccgtcggcgctccaggtaccgtcatcggcggcgatgtccggagacagctcggaagtgttgtagttctgcgcgtacaggaacgggaacacctgaatctgcacggcgtaggaaccgttgtcgtaggagccagccggatcaaggctggtgatcttatcggtcgtgccgacggtgatggtgttgccagttgcggcgccaccgtccttcacgccgccgcaggcggccagggaagccagagccgcgacagaagccagagcggcgataactttcttgcgattcactatggaatcctctcttttctatccgaatcgcccctgtgcaaggcgatatagtgacaagaatcggcgcgcaatgttaaccgtacgtttcattggaggccgttttacccacctaccttatattcgccgttttctgctatgcattaaaacggcgaaattccaacgttttaacgactagtgaaagaaaataagaaaaaccagccattttatgagacggacccagccaaagtcgcattcaaggtctacgtccttctttttcactcattgctttcgcacagagagacccagataagcgcgcgacacgcggcacaacacgaattgcattaatcaattaacggcgttaatatattaagaagttcaacgagggtccatgcactgtcgcaaggaggtgagcatgagtaggtacagcgcccaacagtcatcgatctcggaaaacaaccgttcccgcatcctgcaatacctgtaccacaatggcatctgctcacgcgcgcagatcgccaaagccatcaagctcactccggcggcaatcaccaaaatcaccgcgaaactgctggcgcagggcatcatcgaagaaaccggcgacatggacggagacaagaaccgccgttccatcggtctgaatctcaattgcgccaaataccacatcatcggcgtgaagttcgcccgcagtctggtgcaaatcgcggtcttcgacctcaagtgcaaccgtatcttcctgtccgacttgcctaccgtcagcgaagagcacatccccgaaacggtggagcgcattcgagataccgtacgccagctcatcaaggacgaccccagcatcgtggccgtcggcatggcggttccggggccctatttaaaggacgaaggacgcaccgctttggtctcctccatgcagggctggaggcaaatcaacttcatcgacgaattcagcaacgcattcagcgtccccgtgttcgtcgaacaggacgcccgcgccggcgcgctggcgcagttcctgttcaatccggaactgtcggaaggttccctcgcctactatctgcttggcgaaggcatcggcctcggagtcatcgacaacggcaccatctactacggcgagcacggcaccgccacggaaatcggacacgtctccatcgacgtgaacggcaagccatgcgactgcggcaatgtcggatgcctggaacgctactgctccgccaacgccatccacgaacaactcaacgccaacccgagcatcgttcccggatgcgagacgatgacgcatgcgcaggcttgcgcagcactgttcgccaaggcgaacgcgggagacgagaccgcgacgcttctgatgctcgatgttgcccgatacgttgggtacggcgcggtcaccatcatcaacgctttcaatccgacacacatcgttcttggagacatcatcgcgcaagccggccagccgttgctcgacgaagtcacacaagtcgtgcgcgaacgcacgatccccgaaatcgggcgcaacacccgaatcaccctgtccgccctgcccaccgacgccaccgtcaccggtgccgccgccgtggccatcaccaattttttggaacatccatcgatgttcttcgacgtcgcatagcacgccgcccaccaaagaaaggaaccacccatgtccaagccaatcgtcatcgccctcggtgaaatcctgtgggatatgctccccaccggcaagcgcgccggcggcgctcccgtcaacttcgcctaccacgcgtcccagaacggcgcagaaagctacgccatcagcgccgtcggtaacgacgagctgggcgccgagctgctcaacgatgcgcacaaggccggcatcaacacgctggtgcagaccaacgaatacccgaccggcaccgtcgccgtggcactgaccaacggcattccggaatacaccatcgtgcagaacgtagcttgggaccacatcggctacaccgacgaactcgccgaggccgtgtccaaggccgacgccatctgcttcggcacgctgggtctgcgttcccaggaatcgcatgacaccatcatcaaactgctccagcataccaaggaaggcgcgctgaagttcttcgacatcaacctgcgcgccaacttctactccaaggagctgatcgaggagctgctgggatacgccaacatcttcaagatcaacgacgacgagctcatcatgatgcgtgagatgttctccattccggagggcaacgacgaagaggcctgcaagtggttcatggatcgcttcgatctggagtacaccatcctgaccggcggcgcgaccttcagcaccatcatcgccaaggacggcgagacctccactctgctgaccccgcatgtcgaggtggccgacaccgtcggagccggcgattccttctccggctccttcaccggtaagatcctgtccggtgcctccctcaaggaagcgcatcgcgcggccgtgaacaccgccgcctacgtgtgcaccaaggaaggcggctggccggcctacccgaccgaaggcgttccggattacctcgccgcagcagccaagtaagcgtatcttttcctttcatcatcaccgattccgcatgccgtcaaataacggcatgcggaatttttttaccggttttgcgaagtttcgtcggtatgatgaatcgccgatagcataatttggtttgtcggataaaccgtggtatcttgaaatttctggctataaagccggaaggtttgataattcaatatttggggatgatcggtttcgacggtgacctgttcgtcgcagggaagcgtgccgagaacgtagggtccgctcgtggatgccccctacaaaagaataagtgctaaatctaaccgcactgagttcgctctcgctgcctgagcttcgcgccaggattaaccagtgagcagccgctccgttcactccccctcgtctttggggggatgttgagcgtcgtttagaagacttgccttaccggctgagccacagggccggcaagggacttttactgtagatatgctcgccatcagttgtctgcgacatcgatgggggcagaaaaaccgccgcacggccagcagactacgcacgtagaagactgagggttcggtcatcggaccggggttcgattccccgcatctccacggattgaaagccgccagaaatggcggcttttcctttatttccaacggtttccaccacttttgcaattcgctgcaattcaccctttatcgcgatatttctcaaaaacatgggcaaaatgtgggcacgaatcatgtgtcagcaatgacggctttttgtatttgcaatcacatttctcgtttggtgaaacaacgcatgtcggcagcaacgcctccgtattatcgaaataaccgtccggcgcctttcaatattgcaagccgccgcccagccaaccatcgaaagggacgatatcatggcgaagcttacagaggaaatgaaggatttcatcagcagcaatctcgcttgggtggccaccatcggcaaggatggacacgtcgatttggggccgaaaatgagcacgttcgtcatcgatgacactcatatcggctatcacgagcgtaccgccggccaaatgtaccgtaatctgctcgacggcagcgaactggtcatcgcagtggccaatcttgagcagaagcgaggttatcgtttccgtggcaacgtcactctgcattccgatgatgcgatctacgatgagcaggtcgctgtggccgaacataacggcacgaagaagcccatgaccattcccgttctggagatcacggagattcaggacttgacgccaggggcgaccgcaggcaagaccatcgtcaaggactgacgcccgttcaacgcatacggctaataccatccatccaaacgcggaaacgcgctctggccctcccttggaaagaaggtccagagcgcgtttcgtttttctgtcaagacaaaaagagctagatcaaagtatttccgctccgtcatgcagtgacgttgcgcaataacgctatttgatgatcggtctcaacggcgcggacacgtccacgttatgcttgtctccaatcacgttcggatcattgacgatcttgtccaccaccgctttcttgagcttcaggtccgaggaatcaccccatacgatcacgcggtctcccccattgagttccgtggtgatggaatcctgggtcgccgcggtgaccttggtgatggaattgcgcatcgattccggcagtgagctgagaatcttcaacgcttccttgataggacgcctagacaggctcgcatcgacgttctgcacttcgatgacgggaatgccttccacggaaacgccgctgacggaattgagcacgcggcccttgctgtcgaccgccgtcatatggtcctcgctggttttgagcatggccgcgggtttctgcgccttgatcgtcacttcaagcgagttcggcagctgtttcttcgacttggctgacgtgactcccggaatcgccttgatctgcttctccacggctccatccgaaaccaggaacaacgattttccggactgctgcctcgcgatgtcaagcacctgcgattcgctcacccattcgttggcgccgaccacgctgatgttgcctggctccaaacggaacaccgacgagaagaggaacagccagacgacagctcccaaaaccacggctacgacaagaccgatgagcacgcgcaggactatggctcgcgcgccggcctgacggcgttccttgagccgttcgccgaaatcaaccactttcggacgtgtcatgatgccgatcgtgccggtggtctcctgcagggttttggaaaccaggtcctcgctttgcaaacgtcgcgcgtctacgaagccttcggcttttgaacggtccgcgtacccttcaatcgaccgtccttcggcatgctccgatgagatggaccgtccggaacgtcgtccgcccgactggtccgtctcctgcacatccttgccggaactgatgacccgtcgagccatcagccctcgcaatcccaacgatgcgcttcaagagcatgcaggatgacctcgtccatctgcgtgatgtcgccggcgcctacggtgaagatgacgtcgccatgatgcgcgcgcatcaccatcatttgggccgcggtgtgcatgtcttcgacgccacggatccagtccttggccggttcatgctcaagcttgagcgcctcgtccacgatggtggccggagtcacgtcggggaaatcctcctgcttctcgcgcgcggggaagatgccggtaacgatgacgtcatcggccttggcaagcgcctgcgcgaattcagagctgaagaaacgcgtgcgggagaacaggtgcggctggaagatcacacggatcttggactgcgggtagcggcgacgggccgcatccagcagcgcagcgatttcggttggatgatgcgcgtaatcatcgacgaccgtcacttggctgacggtgccacggacctggaagcggcgtgcggcaccgaggaacgaggtgaccgccgcggaggcacgttcgacgtccatgcccaacagcgcggccgcgataatcgccgcggaggcgttgcgtgcgttgtggatgccgggaacggtaagcgtcacggcgatgcggcgctcctcttcgccgatcagtccgcccggaatatgcagcgtgaaatgttcggcgccgctttcggcggtttcgctttccgattcgatgcgtaccagcgtggcaccgttcaggtcgcccaattcggcggcgttccgtgttgaatagacgatcgtgcgtccggccacggtggcgtcaagcgcacgtagcacggcaaggttgccttcgtcgtcgccgcacatgattacggctttggtggcgtgtccggcatggtccacgaatgcggcccgataattgtcctgcgtgccgtagtggtcaaggtggtcggcttcggaattggtgatgatggcgatttgcggatggtatttggcgaagctgccgtccgattcgtcggcctcggccaccagcacgttgcccttgccggcatggccgccgtccaaaatggcaccgtctttgccttggatggaaccgccgatggcgtagctcggatcggcgagttcgccttctccggcgttcacgagaatgtgcgccagcatggagctggtcgtggtcttgccgtgggcgccggccacggtcaccgcacgtttcgcgttcatcagcagggcgaggatgtcgctgcggtgcacgatgcgctcccctgcctcatgcgcggcgacgatttccggattgtccggcttgatggcgctggagaacacgacggtgttcttgccttcgacgttcttcgcctgctggccgaattcgacggtgatgccgaggctttgcagacggtcggttttggcgcttggctcacggtccgaaccatcgacctcgacgccctgctcatgcagcatttcagcgagcacgctcatgcctgcgccaccaatgccgatgaaatgcgtggcacctaggtcatgcaccgtctcttcaggtgcgaacgacgcatgggttgggtcaagaattatggtaccggcttcacgctggttgtcagacacgattgctcctcgtaaattgttttcaagctcatttcattatggccgcacccatggtctcccacggggtgcggccatgattgttcggccggttaatcagctggctgatcgattagcgcgagcacgcgcttcgccatgacttcggcggcgtcgcggatgccgtatttccacgcgttggcaccgtatcgggacagcttgtccggatcggcaagcagttccggcacatggccacggacccaatccggggtgaaatcgccatccgccaccatcaagcccccttccgcgtcgaccacgggctgcgcgttgaaacgctgctcgccattgccgatcggcagaggcacgtaaatcgccggcagtcccaaagccgtcagctcgctgaccgtgccggctccggaacggcagatgatcagatcggcgcaggcgaacgccagatcgatgcgttccagatagggagccacacggtagtcgccatccgaaacgtggtcggggccaagctcgccgagcacgtcctctccggcgcttaccgacaccaaggaacgcacttcgtcgtctttgcccttaccggtcagatgaatcacctgggcgtgcgcaagcagatccttggcggaagcggccacagccctgttcacgttcaccgcgcccaaggatccgccggtgatgaccacgagcggacggtccggatcgacaccaagctgcgccgcggcggctttacgagtggcggtacggtcatgttccagatcggacgccaatcgtgcgattgccggacgaagcggcaggcccacgcgttcgacttcgacgcccctgcgtggtttcagtcctggctgggcgtatgcggcaccgatcatggacgcccaacgcgcgcccagcttgttggccatgcccgcacgtgcgttctgttcgtgaatcgcaatcggaattcccatgctgtgcgcggccgcgtatacgggtgcggacgtgtatccgccgaaaccgacgaccacttgggcctgatgccgggtgaggatgtcacgtactttggccttctcggccttccatttggctggaaactgcaacgcagccttgttgggcctgcgcgggaacggcactttttcgatggtttccagttcgaaaccggcctgcggaaccaaatcacgctccagaccgacggcggtgcccaccaccgcgatatccgcttccggttcaagctcgcgaatcacatgcgccacggcgagcagaggattgacgtggcctgccgtgccgccaccggcaagaacgatatgcttctgattgctcataatccacgagcttagcccaccatgcggcggcaggccacgcggcataccgccgccgatgcagatacttacatttcgtctacttttcttttgcttgcttcgcaactcgcatgacgggaaccgattacagtatgcggttctcggctttgacctgcggctgctccttcatcaggctgatggccacgccggcggcccccagacacatgataagagacgatccgcctgctgatacgaacggcatcggcacgcccatgaccggcagcaggctgacgacgacgccgatgttgacaaacgcctggccgacgatccataccgcgatgcacaccaacgccatggtgatgtaccggtcgcggacctgcacggccaccatcagcatgcaccacgtcatgacgatgaacagcagaatcaccatggctgctccgacgaatccggtttcctcgccgatgatggcgaagataaaatcgttgtgcgcttcgggaagatagccccatttctcgccggaattgccgatgccgacgcccaacaagccgccggatgcgatcgcgtatttgccgtggaccgcctgatagcacacgccctgcaggtcggacggagagcaggtccggtaggccgccatgatgcggccgagtcggttggggctggtcagaatgaatccgacgataccgcatatgccaagcagcgcggctccggcaagccatttgccggggaatccgccaagcagcaatgcaatgccgccaattgcgagaataatcaagcccgtaccaagatccttgccggacatgaccaggcagaacgcgcacagatagccgagaataagcttggagtacgcgcggggcgcgccgaccttcctcacctgcttgcgcgcgttgatcagctcgttcggcatccagatgcataacgccagcttgacgatttccgcgggctgcatggtgaacacgcccggaatgccgatccatcctttgttgccgttgacttcgacgcccaatggtgtcagtgtggcagcctgcatgaccatggcgccaagcaggaaccagaagctgatctttcggtagaagctggccggcagcatcatcgtgatgaatgctatgaccaggccgaacacgcagtacatgccctgtttcagcgcctgcgcccatggcgactgcccgttggcgatcatgttcaccgaagagctggagaacaccatgatcacgccgaagatcgtgaggatgatcacgcataggcggaatccgtggaagcaccataacgggttggcgagattacgcgttccgccgttcttcaacggttctcgtgtctgtgccgcggcgccgtccgtcatgttcgggcggcttgcggaagacgtgatgctacggctggcctcaggcttccccatgctcattcacccaacgctgagcctgctgcgcgaactggtttccgcgatcggcgtacgacttgaactggtccatggacgcgcaggccggagccatgagcaccacatcgccggattgcgcgtaggtgccggcagcgtcgatggcgcgggccatgacggtgtcgttgtccgtgggatcgatgatggacatgggaatgtcgggagcgcttgccttgaacgcgtccagcattggctgctggtccttgccgatgatgatggccgccttgatggtgtgcgcctggtcggcgacgagctgttcgaaacggcctcctttggcaagtccgccggcgatccacaccacggacttgtccgcgaagctgttaagcgacgccttggccgcatgcgcgttggtggctttggagtcatccacgaaacggatggtgccaccgtcggacgttttggcgacggcgacggtctggatgcggtggccgcccggcgtgaactgcttgagcgcggccaacgccttgtctttgtctgctccgagacccaacaccagcgccaacgcggtcagggcgtcggcgagcagatgcgggtagaccgtgccatccggctcggtcagatgcgtgaaatcggtgaccttcgccacttggaacggctttcccgcttctccgccggcaatgccggacatgtcgacgatccagccatctttcacaccgatctgcccgtccttcggctcggccaacgtgaagccgatcctgcggcattccggcgcggtctgggccgcgaacgccaatttggtgacgcgttcgtcgtcggcgttgtagaccagcgccttcttgacgttgtggaacaccttcgccttgtcggcggcatagttctcgatgccgccatgccaatcgagatggtcgtcggcgatgttggtgatcgccgcgcagtcaagttccagagaataggtgaaatgcagctggaacgagctcagttcgacgcagagcacgtcgttcgcggggtcgacggcggcgtgcgacacggctttgccgatgttgccgacggcgggagcggccaggccgcatgcggtcagcatttcggaggtcatttccgtggtcgaggtcttgccgttggtgccggtgatgccgatccactgcgccggcttgccggtggtgttgctgttcacgcgcagctgccaggccagttcgacttcgctcatgaccggtatgttgcgtttctgcgcctcaaggatgaatggcgtgcgcgggttgaagaccggcgaggtcatcaccatgtcggtattgtcccaatcgatttggtcgaaggaatgcaggtcggagtccggcttcttctcatccacgcccagcactctgccggcacgggagcccagcacttccatcatgctttgcccggagacaccgagaccagccacgattacggtcttgccatccatattcatatccatcacccttcaatcggaaacgtcatttgccgtgatagcacactcatattgcgggcgtaaagccgcgcccgcaatcgtgtcacaggccggaacgggccacccaatcgccgtagaacagcaccaaggcgatcagcacgaacagcatctcgatcatccagaaccggaccacgaccttcacttccggccagcccttcaattcgaaatgatggtggatcggagccatcttgaaaacgcgcttgtgggtcatcttgaagtagccgacctggatgatgtcgctcatggtctcgatgacgaacagaccgccaaggatgatcgccaggaattcggtgtgcgtggcgatggacatggctgcgaacagaccgccaagcgccaaggagccggtgtctcccatgaagatggaggccggattggagttgtaccacaggaagccgaagcaggctacggccgcgcacgccgcgatgatggtcaggtcaagaggatcggacaccgcataggtgaagcctggatggtccgaacccttgaggtggtagaactcccagaacgcgatgatcgcatagccgatgaaggcgatcatcgaggagccggcggccaagccgtcaagaccgtcggtcagattgatggcgttggtccatgcggtcatcaggaaattcacccagatcacgaacagcacgatggccacgacacgaccggcgaattcaaagctgaagaacggcttttcgatgaagctcatgccggcctgggcgctggggaagccggatttggtcggcagaatcagcgccagcaccgcgtatatggtggcgaggatgaactgtccgatgaacttgcccttgacggtcagtccctcgctctgcttcttgcggaccttcgcgaaatcgtcgatgaatcccaagaatcccatcgacagcatggcgaacagcaccaacaccgcggaccacgacggcacctctcccctggtgaggaaccgatacagtgccgaggagcaccagccgagcaccaccgcgaggttgatgaccacgccgccaagcgtcggcgtgccgcgcttgacgagatgcgacttcgggccatcctgacggatgtactgtccgtaattgagcttgtgcaccaacttaatcagcagcggagtgcccacaatcgtcacgacgagcgacaccataatgccgatgatgagtgaaatcacctgatcttctccgtttcagtcagctatgatcggcacgacgccgattccgtcagttttgcgtccaacgctccgccagagcgctcaatccggacgcgtgggatcctttcagcaacaccactgtaccctcatggtcggtcgcaagccgggtgaccattcggtcggcctgttcggcatcatgcgcccattgcaccatcgtcgggtcggcggcaaccgccttgccgccctgcgccatggcctcggcaagcgcgtccaacgcctcgtcggaagtgctgccgaccgtcacaagcgcgtccgcaccgccctcgacggcgtatctgccgacatcctcatgcaggcgatgctcatccggtccgagctccaacatggctccgagaaccgctattctgaacggctgctgctcggcgccggcatgccagcgcgacagaccatcgagtccggccttcatggaatcggggttggcgttgaacgaatcgtcgatcagtgtgaacgacgtttcgggcttggtgacggtggacaccgccatgcgatgcgggctgatgctcgtcacgtcggataggccggaggccacagcgtcaatcggcatgcccaacgtcatcgccaccgtggctgcggcaagcgcgttcatgacgttgtgctgtccgcagatgccgagcgtgacgttggcgtgccggcctgtcttgtcttccagtacgaatgacggatggtcgagatcgtcgcagcgcacgtcgagcgcggtcgtgtccagttgcgcgtcttctttctgcggcaggccgaaccacagcacatcggccggagcgatggcgctcatcgcggccacatgttcgtcgttggcgttgaggatggtcaggccgcccggcaccagtccgcgtacgatttccgatttggcttgggcgatgcgttccgcagagccgaattctcccagatgcgccacgcccaccttgagcaccacggcgatgtccggcggaaccagggaggtgaggttggcgatttcgcccacgtgattggcgcccatttccgccaccaggaaacgcgtgccggcgttcaccttgagcgacgtcagcggcaggccgatctcattgttgaacgatccgaccggagcgacggtgtcgcccattttggacagcagcgatttgagcagatccttggtggtggttttgccgacggaaccggtgatgccgatgacggtgaacggcgattccagcgcgcgccgacgctcgatattatgcttggcgagcgctcccaacgccttgacggtgttttctacgacgatctgcggcacctgcgcgcccgcgatttcgtggtcgaccagtgcggccacagccccctgcgcgccgaccttcggcacgaaatcatgaccgtcgacgcgttcgccggcaatcgccacgaaaacggatcccggcacgatctggcgcgaatccgtgaaggcgctgatggccaccggttcgtcggtcggcacggtcgtcggcatcaaccgtccatcaaccgcctgcgcgatctccgtcaggctcatcggcatcatggtcgggctgctcactgtcgttactcctctaatggttgggtttgtgtttgatgtggagaatgtttcgttccacgtttagttcaggtcacgcgagacgcgtaacgcgcttttgatgttggctttcctcacgccggcggccagcaccatggcgatggacagggacagcgaacggctgtccgtctggccgtatgccgtcgcggcctgcgccgcaagcaggtcggattcctgggttcgtcccgcgatgcgggtctgtttgccgaccgcgcatccgaattttgcgacgagtttcgcaacctcggcatcgctcaaaccattgtcatcgcaggcaagcacatcgacgctgaccgattgcaacgcgtcctcacgcagggtctcttcatccaacgcgaggatcacagcggctgcgccgtcttcggcgcacaccgccatggtacgttgcacatcgatggccgacagaggatattccagattgaggaagcgttccaatgactgtgaatcggacgagctgatcacgccgacggggttgcccagcatgtgcaggaaatccgcgaggttcctcacttcggattccacgatctccctgttcttccccgtgatggcgaatacggccaatgcgtcggacggattgccggccatgtcgctcaccagtttgccgagctgtcccatggtgggttcggcgtagatgagcggaatctggatgtcgtcggtttgaccgcgcagcgcatggggcacgatcgcgccatatgctccctgctcctgagcctgcgacaactggtgcacgtccacatcggcggacgggacgaacagtgcgccgggacgcaccgattcgacatcatccgcgatggaagtgatcgtcacttcagccgccgacgtcggatcaagatcgaaaccgtatcggctggcaagcagccctaaagtcattcgtctgttcatggattcgctgaccgcgctcacctttccgcccctccgtgtctgaatacgtattcgctcaccaattcaccggaatagcatccgtgcgaggtgaagacgccggcacttcatacttctgcataaggaattcaccaatctccgcggtgacaggacccgccgtcaaaccgccgaagctgccttgggggtctttgagcaccacggtgatgacgaagcgtggattatccgcgggaatgatcgtcgagtaatcgctgatgatcgaggtcagttggccgttcgctccggcgacttctgctgtgcctgatttcgccgccatacgatagccgtcgaccttcacgaaagtgttgtagtgttcagcggacgattccatggcgttgagcatctggctcgccacggattcgtcgatgacgcgtgtcgcctcgcccttggactgctgctcttcgacatgccccgcggtgtcggtgatggacttgatgatgcgttgcggctttttgacgcccttgttggctatcaccgaaaccgcgttggtcagctgcatgacgttcaccgtgtacccttgaccgaacagcacggtgttgcgggttcgcctgtcccagctatccgaggggtgcagcacgccttcggattcgcctggcaggttcagtcctgtggcctgtccgataccgaatttgctgatgaagttgtaccgctgctcgttggtcatcttgtctccggcaatgaccatgccaacgttcgacgactgttcgaggatgccggcgagcgtccaatgttcgttgccatggtccaccgcgtccttataggtctgtccttccacggtcaccgtgttcggtaccgtgaatttgtcatcgaccttgtgcaatcccagttgcagcatgcccgacatggccagcaccttgccgatggagccaggttcgaaggtctcgctcaccgcccgggaggcgcccatcttcgcctggtcgcttccggcctcggtcgtatcgctgtccgccaaagcgaggatgtcgcccgactgcacgtcctggaccatggcgatgccccaagcggaatggtatttgttttcgctgtcgctcagcactttctcggtgtaccactgcacatcccgatcgatggtgagggtgacgtcggatccgttgaccgcgtctttggattcggtcatggttccggggatttcgacgccgctgttgccctgttggtacacctggtagccgtcacggcccgtcaatgtcttgttttccatctgctcgatgccggccacgcccttgccgtcggcgtcgacaccacccaatagcgaacccatcaaagtgccgttggagtacagacgttcgttgcttagttccgcgtagacgatgccgccgaggttcagcttggagattttacgcttgaccgcaggcgtcacgtccttcttcaataccacgtattgcccgctgatcgacagtttggcgcccagttccgtggcgtccatgcccaatacgggggccagcagacgagccacggctgcggctcccgtcacgccgaccggcttgccgttgatctggtggcagttgctgccggtctgtttggtgcaggtggtcggtatgaacgcctgcgcctgttcggggttgccgatgatggtgtagcgttcgacactttgcgcgagaatcgcgccattggtatccatgatcttgccgcgtcgagccttcaacgtcacggtggtggtgcggctttgcgccgcggcctgcgccatccctttgccgttgaccagttgaatattggcaagttggataaggcaggtggtgcccatcagcgccagaacgacgccgatggccatggttttcgtcaacaggttcttgtggaagaacgtgtagatcctgcggatagggttcaccgggtcttgtctccacttgcgtttgcctgatagccgttcagatcgatggtcaatgcgcctttctgcgggaccatgcccatctcttcggccttgctcggcaatgaggcgtcaagttcgtcgagcttggcctgatcgtcctcgacgtcctgggtcagctgggtgatatgcgtttcgatttggctcgcctcgaaggaattctgcaccatttgggtacgcagcatcagtgagcccagcaggcatacaccaaggaacaccgcggcgatgaccaggtgcagcagcggcgtgctacgggtccgcgtccatgtgatgagttgttcgaagccgtgacggatgccgttgccttcgactctggtccctttgatgacgtgcagttcgggacgcgtggtgccgatggtctcggtctggcttttgcggccggccggagccgcattcgaagcgatcgttcttggtgccgccacttcagtcccttcttccttgtctggtcatgcttgcgtaatccgcgccttggtcgaaccgtttgcgccatcgtgcgggaatcggtctggtcaattccaccgcgcgcaatctgacggacgccgatcgtggattgttggcgatttcctccgcgtccgccttgatggcgccgcgggtcagttccttgaagaacggcatcatgtcgggcggcaccacgggcatatccgccggagcgtcgaccttaagcccttggttcatgaaggctttgacggttttgtcttccaacgagtggtacgactccaccaccagacgtcctcccactgcaaggtggttggcgatttgcggcagcgtgccggcaagcttgtccagttcgccgttgacttcgatgcgcagcgcctggaagacgcgtttcgcggggttgccggcgggacggtgggcctgcggcacgacctcgtccaccaaacgattgagctggcccgacgtggtcagcggctcggtttcacgccggcgtacgatttcccgtgcgatctgcttggagaaccgctcctcgccgtatgtgcggaagatacgcaccaaatcggcgaacgaatattcggcgagcacctgctctgcggtcaggggctgcgtcacgtccatacgcatgtcgagcggcgcgtcatgggaataggagaagccacgttccgtctcatcgatctgcaggctggacaatccgaggtccatgaacaccgcgttgaccttgtcgacgccttggtcggaaagcacttgggagaagtcgtcgaatgccgcgtgcacgggcgtgaaacggtcggcaaggccttccatttccatgcgtttcgtggcgagcgcgagcgcctcggtgtcccggtcgatgccgatcaggcgggcgttggggcttgctttgaggaacgctgtggaatgcccggcgaggccgagtgtgcaatccaccgcgatcgagccgggcttcgccaatgccggtgccaccaggtccacgcaatcgcggagcagcaccggctgatgaatcgtcgtcacgtctgtcattagaactccatcgccggcaatacgtcatcggcaatgtcggaatatccttgttccttgtcggccaagtaatcctcccatgcctgtctgttccaaatctcggcccgggttcccacgccgatcaccacaatgtcgctgcccagattcgcgtaatcgcggagcatctgcggcacaagcacacgtccttgcttgtctggctcctggtcgaccgcgccggaaaggaacacacgcaggtagtcgcgtgccgccttgtttcccatggacgtgcgttggatctgcaccgcgatccgtctgaattccgattgcggcagcaggtagacgcatcgttcctggcctcttgccatcaccatgccggagcccagttggctgcggaacttcgcaggcaatgccatacgtcctttggcgtcgattttcggagtgtaggtgcccagcagcaatggcggcaagtccgccatcatgccgccggattgagccgggtcatcgtcggagacggattctgttccaatgtcatggaccattaccgcacctcctttttgcccacactcggcccaccaatccgagacactttccccactctaccccactgctcaccatttttccccacgaaaaagcaaaaatgcctcaaaatattgtcgatttctccccatatttgagattgcgcgtccgcaccgtacagttccgtcgctgtcagaccgtcgcgattcgccgcgatcactcgccgctcgtagaagccttggggtacattagagtgccttaagtttttgatgaagggacagcaatgtcgagttattccgcccagttgcgtgaggagcaacaggccgtcagccgcgcatatgatcgtctggacgcgttgagggcgcaggctcggtcgcgtctcgacacggtccgggccgcaggatcgcacggttcgcccacgcaacgcaccgaacgcgattccttcgccaccatgtacgaggaccgtctcacccagcttcgtgcggtggaggatcgtctggttttcggcaggctcgacgacgtgcatggcgcgcatcgctacattgggcgtatcggcctgtccgatgaggatcatgagccgattctcaccgactggcgtgccgacgcggcacgcccgttctatgaggcgacgccttcgaatcatggcgacatcgtcatgcgccggcatatcacgttgagtttccgggaagtggtcggcgtcgaggatgaggtgctcgacgtgcattccgatcaggtcggcgaggcgtcctccaatggcacattgaccggcgagggtgctctgcttgcgtcgcttaacgccaaacgcaccggcaagatgaccgatatcgtggccaccatccagggcgagcaggaccgtatcatccgtgcggacctcaaccaggcggtggtggtgcagggcggtccgggaaccggcaaaaccgcggtcgcgttgcatcgcgcggcctacctgttgtatacgcatcgtcgcgcgttgcagcgttccggagtgctggtggtcggccccagctcgacgttcctgcattacatcgaccaggtgctcccctcgctgggtgagacgggtgtggtcagccgtaccatcgcggatctgattcccggcatcatcgccaccgcgcatgacgacccgtatgcggccaagctcaagggtgaacgccgtatggccaaggcgatcgccaatgccgtggcggctcgtgaacgcgtgccttcgcatctgccggtcatccgcatcaacggtttcaacgtgccgatggtgcgtgcggatatcgagcaggccatcgccgatgccaagcgcacgcggcagccgcataacaaggcgcgcgagaccttcgtgcgcgacatgctgtcggccatgcgcaaccggtacgtcgaacggcttgactacgagccggagcaggccgagcttaacgatgtgatgcagcagttgcgtatgaacgacgatttatgcaagacgctgaacctcgcatggctgccgatgaccggcgaatggctggtcgaccagctgttcgcgaaaccgcagcaattgcgccgtttcgccccctggctcgaagagcgtgacatcgagacgctgacgcgtccgaagggctcgcccttcaccgtcagcgacgtacctctgctggatgaggccatggaattgcttggaccggatccgaaggccgtggccaggcagaaggcgttggatgccaagcgcgccgaggaagagcagttcgccaaggacacgctggcgcaggccggtatcggttccggcatcgtcacttcgcagatgctggtggacaatatcaatggcatggacgccgaattgaccgcgcagcgcgccgcggccgaccgcgagtggacgtatggccatatcgtggtggatgaggcgcaggagctgaccgcgatggattggcgcatgctgatccgtcgttgtccgtcgcgctcgttcacgattgtgggcgacgtggcgcagacctccgcgttgggcggcacccggtcctggcgtcgcatgatggatccgctgttcggcgaacgcaactggcagctcaacgagttgacgatcaactaccgcaatccgaaggaggtgtcgcagctcgccagcgatttcgcctcgtccgaaggcctgtacatctccacggtgaacgccgtgcgtggcgtcccggattcagtcaagcgtctcaccttgcgtgacgatagcctgatcggcgacgccgtcgcgcagcagaccgtcgagttggtgcgcgcctacgtttcctccgacggtaccggtcgtgtggcgatcatcgcgccggacgatatgctcaagccgttgcgcgcacgcgtatacgcacaacttcaggatgagctcgacccgaaggaattcgacaggctcgatgcccagagttcctgggacgagcaggtcaccgtatgttccacacagaccgtgaagggtctggagtatgatgccgtgatggtggtccagcccggacgaatcgaggagaacgcgccgtcgcgtatcgtagcggcctccgatttgtatgtcgccatgacgaggcccacgcagcgtctgcttatactgcggacaaaagacgacgaaaagctgctcaagctataaggtaggaaccatgcctaaagcattgttacttgaaaacatccatcccgacgcggcgcagtcgctgcgcgaccatggcttcgaggtcgagtgcctcaagggagccctgagcgaggacgagctgattgatgcgttggaaggtgtcgacctgctcggcatccgttccaagaccagtgtgacccgcaaggtcatcgacgcgcgtccgacgctcaccgcggtcggctgcttctgcattggcaccaaccaggtggatctcgaatacgcgggcaagaacggcatcgccgtcttcaacgcgccgtattcgaatacccgttccgtggtggagctggtgatcggcgacatcatctgcctgatgcgccgcattcccgcgcacacccatcatatgaagcacggcatgtgggataagtccgcctccggctcccatgaggtccgaggcaagacgctcggcatcatcggctacggcaacatcggctcccagctttccgtcgtcgccgaggcgcttggcatgcgcgtgctgttctacgacattgaagagaagctcgccatgggcaacgcccaccgttgcgacacgctcaacgaattgctggaacagtccgatgtggtcacgcttcatgtggatggacgcaagtcgaacacgggattcttcggcgaagaccagttcgagcatatgaagcaggatgccatcttcatcaacctgtcccgtggtttcgtggcggatttggatgcgttgaagaagcatctggattccggccatctgtccggcgcggcggtggacgtgttcccaatcgaaccgaagaagaccggcgacgagttcctgaccgaccttgcggacgaggacaacatgatcctcaccccgcatatcggcggctccacgcttgaggcgcagaagtccatcggacagttcgtctcccagcgtcttgaggattattggttcaagggttccaccatgttgtcggtgaatctgccgcagatcaccctgtccgacatcaagtcgaatttccgcatcgcccacctgcatgcgaatcttccgggtgtgctggcacgcgtcaaccgtgtgctgggcgaggacggcatcaacatcgccgcccaggccttgggcacggaaggcgagatcggctatgtggtcaccgatgtggcacagcgcccggaccagagggctctcgaccagctcgcctccatcgagggtacgatccgcatgcgcgtgatcagctgagcacgcaatacgaaacgttacgataatgcgggcggggttccaaccatcaggattggaaccccgcccgcattatatatgctgtatttgcttacggatgcggcacccgtctcacaccatcattcggaacttgcgcccttcagctcgtcgatggccctttggaagtcctccagattctcgaaattctggtagacgctggcgaagcgcatgtacgccaccatgtccaagtcacgcagcggcttgagaatcgccttgccgacctcatcagatttgacttgggccaatcctcgtgaacgaagatcttcctcgaccttctgccccagcatcttcagatcgtcctcgttgatgggacggccctggcatgccttgcgcacgccggaaatcaccttattgcggtcgaattgctcgacgtttccggaacgcttcacgaccaatagcatggtcgtctccaatgtggtgaatcgcttggagcatttcgggcattcgcgcctgcgacggatggagtgaccatcgtcgctaatacgggtatcgaccaccttggtgtctggattctggcaaaacgggcaatgcatgttgtccagaatagactgagcccttgaaataagccacgcttggcggcccctacgcctcatggggaacaatgaggcgctgccccgcatgcaaagacaccgtatcaaggttgttcagccgcatcagttcatccaccgtatctccgacattgccaccctccggagtgatgctcgccgcatacctccacaaggtgtcgccgggttgcaccgtatacacggcgacagcggtggaatccggcgcggactgcgcacttccgggcgcgatgaatccaaaaagacaccaggcaagaccggccgccatgatcgccatggcgattcgatttgccacatttccgatattcgccgcaccgttcaccacgccactccttttcgaacagctgttctatcgaacgcttgttccaagtatggcacatatgttcgataaacgcaaacacacctcgaacagatgtttgattttatcggcgtttcgcgttatgcttctaaggaactacgaaaggagcccatcgtgagcaccatccccttcacgcccaagaagagcgacgagcgtccggatgaaagcacgttgaccgaccgccagcgcaaggtgcttgacgccatcaaaacgcatttggccaagcagggattcgctccttcgttccgtgagattggtgaggccgcagggcttaaaagcccgtcatccgtcaaacaccagcttcaggttcttgacgaaaaaggcttcatccgcatgaacgcgaacaaggggagggccatcgaagtggtgaacctcaatgacgaggagccgaatggaaaagtcgcccaggtcatcccgttccccagtcaggacgacgcatgcggctccatcatggcctcgcatgacgttccactggtcgggcgcatcgccgccggcgtgccgatcacggccgagcagcatgtcgatgatgtgatgaggcttcccgaacggcttaccggcaccggcaatctgttcatgcttgaagtgcacggtgattccatgatcgacgccgccatttgcgatggtgatttcgtggtggtccgcgagcagaacagcgcggagaatggcgatatcgtcgccgcattgctggatgacgaggccacggtcaagacgttccgcaaggatcacggccatgtctggctgattccgcacaatccggcctactcccccatcgacggcacgcatgccgagatcatgggcaaggtcgtcaccgtgctgcgcaagatctgattgctttcacacgttaaacggcaaagggcgtcgaacataccattttgaggcatgtccgacgccctttgccataccctttgccataccgcgcggttgtgcattcaccttgcgaatccatcaagaatgaatgcgagggcatttcaaaatgtcgtcgcattcttgaagttcgggagcacggttcaggaatgcagttccttgcggctgtccgaatcgtatccttcaggttcaagctggaaggtggtgtgcggcacggatacggggaagtgctcacgcaggcagttctgcaattgggagaggatgtcggcggcatcatccatggtcagcccgcgctccactaccacatgggccatgacgacgggcatgccggtagagacggtgctggcgtgcaggtcgtgcacggccaccacgtgcggcacctgctcaagatgttcgcgcacctcgtccagatcgagttcctgtggggtttcctccagcagcacgcgcacggcgttgcgcagcagcacgaacgcccgggggatcatcatcaatgcgatgatgccgcccgcgacggcatcgaagccggcccagcccgttgagatcagcacgatggctgaaacgatcacggccacggaccccaatgcgtcgttcatgacttcgaggaacgcggctttcatgttcatgttgtcctcgctttgccccgcgaggatgaagatcgaaccgacgttggcggcaaggccgagtatgcccatgaacagcagcaaccgcacgtcgtgcacttcgtcggcggctccgccgaacagcctcatgccggcttcgacgagcgcgtagatgccgacgatcaggagcacgagcgcgccgaccgcggcggtgagcacttcgagtcgcgcccatccccaggtgcgtttgttgctaggtttgcgttgcatgagcaccgcggtgacggtggaggcgatcagcaccgacatgtcggtgagcatgtggccggcgtcgaccagcagcgccagcgatccggtgacgatggcgctgaccacttcggcgatgaacaccgtggaagtcagccccaatgacatcatgagtcttttctggtgttcggccccgcttgcggcggtcgtggcgtccacacccgcatggctgtgtgccatgatgggtttcctttcgtcgtctttggttcgatccgcggctattgaaaccgcttctcaataccattttcattcgtctcaaaacgcaggaaaccccagtccgaaggctggggtttccaagttctgctgacagtctagcggctcaccgctcccctgtcaataaagtcaaaccgtcaattaaaaaccgaactgggcggcggtttccttcagcgtctccgcggagcgcttcagggccgcgagctcacggtcggacaccggggtgttgatggcggtattgacgccggaacggttgagcagggtcggcacggacatgcacacgtcggagatgccgtggaagtcgtgcagcatggagctgactggcaggatgcggttggagtcgcgcatgacggcttcgatgatgtccacgccggacatgccgatggcgtagttggtagcgcccttgccgttgatgatcttgtaggcggcgttcttgacttcctggtggatctgctcacgcacttcggcgtccagcggatcgtggcccggcagcggggtccagtcgcacatcgggacgccgccgatggtggcggaggcccacagcgggacttcggaatcaccgtgttcgccggcgatgtaggcgtgcacgttcttgacgttgacgccggtctgctgcgcgatcaggaagcgcagacgggcggagtcgaggttggtgccggagccgaagacctggttggccggcaggccggagatcttctgggccacgtgggtggcgatgtcgaccgggttggtgatgagcatgtagatggcgttcggagcgaccttcacgaggcccggaatgatggccttgaggatgttgatggtggcaccgaccagctcgaggcgggactggcccggcttctggcgcgggcctgcggtgatgacgatcatgtcggcgtcacggcagatctccggatcgtcggagccatcgatggtcacggtcggatagaagctggagccgtgctgcatgtcgagcacttcggcctcgacgcgttccttggcgatgtcttcgagcacgatctcacgtgcgacgccacgctgagcagcagcgaaagcgagagtggagccgactgcgccggcaccgatgatagcgagctttgtgggcttgattggtgaatccaccatgtgctttacctctctttgagcaagaagaacgtcccgcgttgtggcagggtattttctttcgatttcaaccctactttatccatacagcatgacgtttcgccgtgaatccgcatgatttgcaaccactgaaaagtgattttcgtcacagcttttgtgagcgctcacatacactgcgcccgttgaaatgcagctgttgcaatccgttgcagcgtttgcacggccgctccggtaaacgtcatcgggaacggcttgcgcggaagctcagtcgatggcctgctccacgatctgcgcggccagctggtcgtcgacctccgcttcgagcatcatgccgtcgtcgcggtattcgacgttgatcaccttgccgtattcgcgcacgcgggacatgagcgagccggctgtgtacggcagcagcgcctcgacgtgcacgttcggcgtgggcagcatcgattccacgtgctcgcgcagtgcgtcgacgccctcccctgaaaacgcggagacgatgtgcgcttccggcatcagcgcctcgatacgttcgcgtgcggcctcgtccatacggtcggctttgttgaacgccacgatcgtggggatcgtctcgacgccgtcgatgtcggacagcacgtcgttgacggcgtcgatctgggagaacgggtcgggatgcgagccgtcgaccacgtgcacgatcaggtcggcgtcggcgacttcctccaacgtggatttgaacgcttcgatgagctgcgttggcaggcggcgcacgaaaccgacggtgtccacatacgcgtacagtcgcccgtccttggctttcgcacggcgtacggcggtatccaaagtggcgaacagcgcgttctccaccagttccgcggaaccggtcagccggttggtcaacgacgatttgccggcgttcgtatagccgaccacggcgacggtcggcaggccgaagcgacggcgcgcgccacgtttgacgtcacgcgcgggcgccatctgtgcgatctgccggcgtagtttggcgattctgctgcggatcacgcgacggtccatttcgattttcgtctcacccggaccacgcgagccgatgcccgcgtcgcctgccgcgcggccgcccgcctgacgcgacagcgacccgccccagccgcgcagtcgcggcagcatgtattcgagctgtgccagctccacctgcgccttgccttcgcgcgaagtcgcatgctgtgcgaagatgtcgaggatgacggcggtgcggtcgaccaccttcactttggtggcgtcttccaatgcgcgtcgttggctcggcggcagatcatcgtcgacgacgatggtgtccgcctcgtcctgcgccacgatgccggccagttcgcgcgccttgccggaacccacgtatgtggccgcatccggcttgatgcgatgctgcagcagaccgtcgcacaccacggcgcccgcggtttcggcgagcgcggcgagttctcggagcgattcctcggccgcggcctgcgtggtctcgcggctggaccatacgcctacgagcacgacgcgttcgagcctgactttacggtattcgacttcggtgacgtcctggatctcgcccagacccgccacatgcttcaatgcgttgcgggattcgcgttcctgccactgttcgtcgtgggtttcgcgaaagtgttccccgccgtcggtatcaagcagcacgtcggattggtcggcgagcactcccccgacgtcgcctgcggtcatgctctgctcgatatcgttctcttggctcaatggcacctctcacggttaaactatggtgtctttattatcatcattgtctagagacatgggcatcaccgttttcgccacgtggacgcgattaccgcgcggatgccggaggacgaacgtttgcaaggagagagcatggcacaggccgagcagtatttcgcggcggaaccgcagtcgaaggacgtgcgcaggaagctgcatgtcacgttgcgtggcaatgaggcggatgtggaagtgtcgaacggcgtgttttccggcaatcgtgtggatttgggcacgtcggtgctgcttcgccaggcgccggaaccgccggaggagggcacgttccttgatctgggctgcggttggggtccgatcgcgctgacgttgggtttcgaatcgcccaaggccgatatctgggcgttggatgtgaacgaacgcgcgcttgagctcacgcgccgcaacgccgagttgaacggcatgggcaatatccatgccgtcaccgccgagcaggttccggccgttctcacgttcgatctgatctggtcgaatccgccgatccgcgtcggcaaggaggctctgcacgagctgctgatgacgtggctgccgcggcttaacgcgggcggtgccgcctatctggtggtgcagaggaatctgggttccgattcgctgattccgtggctcgccacgcagttgggcgacgggtttgaagtgggcaagtacgcgagttcgaagggcttccgcgtcatcgaggttgtgagggcatgaaattcgaatatccttccgaactgccggtttccgcggctcgcagcgacatcgccgaagccgtcaggtcaagccaggtggtgatcgtttccggccagacgggctccggcaaaaccacgcagctgccgaagattctgctggaactgggccgtggatcgcacggcaggcagatcgtgcacacgcagccgcgcaggcttgccgcacgtaccgtcgccgagcgaatcgccagcgaaatgggcgtgacgttgggtgaggaagtcggctatcaggtgcgtttcacggacgaaagctcgccgaagacgcgcctgcgcgtggtgacggacggtattctgctggcgcagatccaacgcgatccgaagctcatgcagtacgacacgatcatcatcgacgaggcgcatgagcgcagcctgaacatcgacttcctgctcggctatctgaccgcgttgctgccgaaacgacgcgatctgaagctcgtcatcacgtccgccaccatcgattcggtgaagttccaggagcatttcgaacacgcgctgcatacgaaagtgccggtgatcgaagtgtcgggacgcacctaccccgtgcagatcgtgtacgagccgttgggtaccgcgccggcgctgatgcgctccgtgccgggcttcgaaaccggcgcgatgccgggagacgctgactacgagagcctgtccgcagcgccggatggtagggatggccgcgattcacgcgatacgaacgtagacatgtccaccgccgtggcacgcgcctgcgccgaactggtcatccattcaagccacgaccgcgggccacgcgacatcctcgtgttcgcctccggcgagcgcgacatccacgaattcgaaaacgcgctgcgccgccattacggaccgcgcgcggtggacatgcgccgccccgacgcgatcgagatcgtgcccctgttcgccaggctctcctcgaaggagcagcataaggtgttcgagccgcacgagcatcagcgcatcgtgatcgccacgaacgtggccgaaacgtcgttgacggtgccgggcatccgctatgtggtcgatccgggcacggcgcgcatctcccgttattcgaagacggcgaaggtgcagcggctgccgatcgaaccaatcagccaggcgagcgcgaaccaacgttcgggccgctgcggccgtatcgccgacggcatcgcgatccgcctgtactcacgtgaggatttcgagacgcgtcccgaattcacggagccggagatcctacgcacgtccttgggcgcggtcgtcctgcacatgctgtcggtgggcgtggcgcgcaccgcgcgggatgtgacggatttcggtttcatcgacccgccggatatgaaggctgtgtccgatggtttcaacgagctgaccgaactgaaggccatcgcccgcaagcatggcgaagtggtgttgacgcatacgggccgcatgctggcgcgcatcccgatcgacgtgcgtttgggccgcatgatcatcgaggccgcgaagtcaaccacgccgaacacactggccgccgtattggtggtcgtggcgttcctcagcctgcaggatccgcgcgaacgtcccgatgagaaccgtgaggaggcggaccgcatccacaaccggtatgcggacccgaccagtgacttcctgaccgcgttgaacctgtgggaccgcgtgttccaagctgatggcgaaccaagcaattccgcactgcgccgcatctgcaagaccgagtacttgagttggctgcgcatgcgccaatggaaggatctggtcgcccagctgcgcgaaatgtgccgggagttcacattcaagctcggcgagccgattcccgtgtcccgcccaccgttggaaatccgccagctaccgctcaaccagcaggcagcgcattcgctgtgctgctcatgggacgcgcagggcatccacacgtccatgctttccggcctgctgtccatgatgggcatgcagatcgtgcgcgagccgaaggcttccgatttcgccgggctcaagggagcggcacgggcacgcgcgatgaaacgtgcgcagaagatggcgaagaacgactatcagggcgcgcgcggcacgcatttcgccctgttccccgcctccgccgtagccaagtcgaccccgcaatgggtgatgagcaccgaactggtggagacaagccggctgtgggcgcggtactccgcccagatcgaccccgcatgggccgaaccgctcgccggagcgctcacccgcaccacctacgccgacccgcactggtccggttcgcgtggctcggccgtggcgagcgcgaaggtgctcctgtacggcctgccgatcgtgcaggaccgcaccgtgcaatgggggtgcatcaacccgctcgaggcacgcgacttcctcatccgccaaggcctggtggaaggcgacatccagcaacggttctcctacgacgatttcgtcatgcggaaccgcgacatcctcgaagacgcggccgacgacgcgagccgcacccgccaggtggcgcagaccgtcggcgacgaggacctgttcgacttctacaacgccatcatccccaacaccgtcaccagcgtggccgacctggcgaaatggtggaagacaaggcacgacgaacaacccgacctgctggatttcgacccggacaaggtggaacgcctcgccgactccgattcggtatccttggacgactatcccgaccattggcatacgctcggcaccgacggctcccccatcgacctaaggttgagctacatctacgatccgcacgacccgaacgacggcgtcaccgtgcacgtgccgttgaaggcgctgtcgcggctgaccccggaacagttcacatggaacgtgccgggactgctggacgagctcatcatcggcatgatcaaatcattgccgaaaaccctgcgcgtacagttcgtacccgccccggacacggcacgcaggatccgcgcctggatcgacgaacgctaccccgacctacccggctccggaagccagcaaaaaccaaacctggcccccgaaaacgaggatggcgtcgccacatggcccgacctgccacacgcgttcacccaagcggccatcagcatcgtcggcgcgcaaatccacccggaagtcctcaccggagaactatggaacaagctcgcaccatacctgcgcatgaccttcgccgtggaacagcagctgccacccaaccgcaagaaccagcacggcagacggcacgcgcgaggccccgtcaaaacactcggcaccggcaaatcactcgtcgacctgcaacgcaaattcgcagaacaagccaaagcctccgcacgccacatggtcgagaaacaagcccgaaacgccggagaccaaggcaaaatcgtcgaaaaagccaacctgctcaacaaagcgggagcaaccaccgaagcacgcgccaccatgctctggcaaggtgcactcgacacactgcgcctgcccggtgaacgcatctcctcacgctggctcggcacggaaacgctcatgctcgcctccgccccctacaaatccacgaaggaactcaccgaagacctgcaattggccgccgtcaaacgactcctgccgaacgtcgaccagctgcccgacgacgaagcgctcgccaacgcagtgctcgacgtgcgcgaagtgtacgaggacaccgtgtatgcggtggcgcacgacgtgatcgccatactgaaacggtatgcggaagtcgacaaggcggtatccggcaaagccgacctacccctgctgagcgtactgcagtcgatccgcgagcacatcgccacgctcgtcttccccggattcatcggcaagacgccaccggacgcattgccgtccatcgaacgatacctgcacgccgacctgctgcgcctcaccaaagcgaaaaacgacaagaaccgcgacgtgcgatgggcttgggaagccgacgaagccaaacaacttgccgacaaggccgtggcgaaagcacaacgtgaaccagccggcccacgccacgaaacgctgatgaagcaggcggaaaccgtacgttggatgctggaggaattctacgtgtccctgtgggcacaggaactcggcacgccgaaaccgatcagcctgcaacgcatcaaaaaggcgatcgcctagccaccagccaaaccccaacggattgttccgtttcttcaaacccgtcaacgcttcttgaagaaacggaacaactgcgattcacgaatcaacaaccccaccaatagactcgccaccatgacaccggcgaacacagccaacggcgtacgcaccgcagccgccaacaccgccacccaatcggaccggctcatccgcaccgcatacgccaacaacaacgcacacgaagcaaacgtagccagcccggcccaaacaccggtctccacaccaatacccagcaactgcgcacccttcgactgccccgaatgcaacgcacccgcatattccaacctacgccggcgcacaccaaacacaccaaccaacacgccaatcgccaaccccacccacggcatccaccgcgtcgaacgattcacatacgacgcacgcgcgtcataatgcgcatcaaaccccttattcacctgcgtcacacccgcattcgacgagccggaacccgccaccaacgtggcatacagcagattctccgtctgcccatcaaccggccactgcttgacccagcattcgtcaaacgtcgaagcgctcgccgacaccggcacgatgaacgcgtaggcgaaacgcgtgtcacgcccatcgttcggccagtcgaacacaccagccacacgcgtagtgccttcgcgtgtctgcaatgcgctgcccacggcgagcccgaagtccttggccacgtcgcgcggcacccatacgccggacacgtcggccttggcattgccggcgatcagccggatcataccgggtgtcacgtcatacgatgagatgtccttgccgggtgtcgcgagtggcacgacctgtttgccggcacgcatcgcgccagccaaggtgcccgtcattccatcgccagcgtcggacaaccggtcgcatgcggtgccatccaccgttccaccgacgatggcgttgacgtcagcgtacgcgttgatgcgctgcacggcctgcgattccaagtcgatcacggtcatcgcctcatatccgcccagcagcgttccggagagcagcacggcgaggaacatggcgaacgcgcggctcacgcccgagccgatgttgcgcagcgcttcggaaagcaccgatccaagtctcatatacgcttccttattggcggtttcatgcggttttcacactgtttggcgaagttcaacggtttcttgcgattcgtccgccgactatttgcaaaccagcccgttgagcccgctgccgatttcgacgttggcgatcgcggacacgtcggcatcctgcgtctgcaccagactcacgcccagctcgctgcccacaatcgtcaccttcgccggcgtattagacgcattgtgggattttggtacgatgcagccgctgctgccgtcgatgccaaacaccgctcccgccggcacacgcagcacctgtaatggttccttcaatgccacggtggcatcgagaccggcctttttggtctgcatgtccatggactggaacgtctcgcttgccgacacattacgcaggaattcggcgtcggtgatttccgtgctatcggccggcaatattccattgacgccatacatgcttatggtgcgatcctgtcctaccgccgcgccgtttttcacggtgagtttcgtcaacgctcccggtatttttccgattgccgtaccgcccgtcaccatggaaccggtggtggccgtccactcgtcgaccgcgactgcgttttcaggaatccacatggtgtcggcaagcgcaagcgtgccgtcggaggggttgccgttgtcgttcatgagttgccgccagccgtcggatgttgcccaccagtaggtgtcggaaccggccacgctgttgtatccgagtcggctcagctcgttgttcagtgcgagcacgtcgtcgcccttgtctccggttttgaggtcacggtataggggtgtggcagtgttcaaggccacgaccacgcggtcgttgactttgtatgcgcctttgccggaggcgagtccgtctgcggaccagtcggcggtgacggtgccgttggcgttgccgagaagattacgttcggtggagatagtgggcacaaccgtcacttgctggctgccggagtattcctgcacgctggctggcgcggtggtcgtctcccctgccgagccgagcaatgccggcgcgcgatccggcaggagcagcgcgcatgctcccacggacacgcagatggcggttgccacggcgagcaggctccaagcccatgcgagtcgtccgcgtccggcaccgttcgtcacggctgtggcgttatgtttctttcccatgagtcgatgcctttctattcgtctattcttccaattccggttcctgcgatttgctgccgcctggcgcgtagtcggcgaggtcgagcacacggtcgcaggcgtcgcgggtgtcgggatcgtgtgtggccacgagcacgatcatgccttggccggaaaggttgttcagcacatggctgacggaatgcgcggtgcgcgtatccaattgagcggtcggctcgtccacgagcagcatgtcgggtttggagcagacggcgcgtgccagcatgagacgttgcgcctcgccgccggagaggtcggagaaccggcggtcggccgcgtattcgaggtcgaacagccccatggcttccaaggctttgagctccgcttccttgcgccgcatgcctttggcgagcagcgggaacaccacgtggtcgagcgcggtgcgttccgccacaccgtacgggttttgaaacacccatcccacacggttcacgccttcacgggttacggttccggcatatggtttctcccaaccggcgagaatcgacagcaatgtcgatttaccacaaccggatggtccgcataccgcgatggtggagccaggttccgccacgaaatcaagatgctcgaacagcaggtctgtccccgggaaccggtgggccagcccttccacaaccactcgcatatgagccccttcgcgcatcagactacttcagcggataccagaccgtctcatccgaggcggtcacgttcactccggccgtcaccaagcaggtcagcgccttcctgttatcgcgcagtcctgcgctttctccggattccaaatccttctccagcttatcggcggtgtagtctttgggctttatgccttccttgcgcagacagtcggccgccacctccttgtcattgagcagcagcttcggattgcccaactggagcctgtacacggtgttgatatccgtgacatgcagcatactgcaggatgtcagatcgtcattgagcttgcggaccgcctctttgctggcaccatcggtgttgtacgagggcagagcgtaaatgccgttgtcgtacttgtcgaacgtcggctcggcatagcctttgtctatgatgcactgcttgtaatccgcccatgcgtgttcgtagtcggcttggctgacttttccgcctgaagcggccttctccagcgcggacttctgctgatcggatattttgccgccgtcggaatccaacaacgatcgcgcataatccttcagcgacgacgcgattcgttcaccctgttgcgatgattgaccctgctgggattgacgctcccgtcgcaagccttctttcagtgccccgcagcccgtgcagccgacaagcaaagcgagacagcatatgacggcaatagctttgccacgcatgcccgttttcctcgacatcgtcatcagcccccccacaaacgacgcagccgtcaggccgccatgacccgctttatcccctagtctagacccccaagacctgccgtcacgcgcggcatacccaatatgggtatgtggaaccaggtgttccccagcatcatccaccggctcgttgcatttaccccgttctccgcgccggaaagccatcagtcaaacggaatgcgcgcgtggaacatccatatgccgttctcgcaatcggtggaaagacttcctccgatatgctcgatttcagccgcgaactgtctgagaccatggccgccgggcaggctgccggaatgccaggcacccatatcattcacttcagtgatttccaaggaatcgtcttcaccagaaccgacacctcgtacttgcctccggaaggcgcatgacgcgaaacgttcgcgtacacctcgccaatcaaccggccgatcacatccttatgataggcatacggacgcgcgcacgggaccagaaataggcgagaccggtcagcataatctgcatgacggtaaacatcaatgccattggcgaaccggggtggcacaccgcctcatagaccatcagaagttcgcacgtcatgatggccgcaagacggaacggatgtttgattcgcggcatatccgacaaccggaacgctccgttcttttcggtcatgtcagcgcccgttcccacgtttcagccatgtgatgatggcttgccgttgcgtacggcagttcagtcgtttgacgatgttctgcatgtgcttgcgcacggtggcgatggatatgccgagccgttcggctatctctccatccgtcagatactcgttcgcgcacagattcatgatggtttcctgcatgttggtgagcgtggactccgcttgagtatcgcatttcagcttcgcataagccgccatcggagtttcaaaaccgggcaggaaacatcctgaaaggacacgggagacggcttgttcgagctgcgtctcgtcacctttaccgacaagcccctgcgcgccagccgccgccagcggcacgcgataccggttcagactgaagctggtcatgccgagaatcggcgtggaacagtccatcaaccgcatgcgacggcagacttccgggccttgcataccttccaacgacatatcaagcagcacaagagcatattggtcggcatttgatgcaaacaattccaaagcctcaacgccgctggtagccgaatcgacgatacccaccgccggaagaatccgcttgaataggtcagtcagcgcctcgatgacgattttgtcatcgtcaacaagcaatatcttcggaccaccaaccgttttccccgtcatggtacaacgctccttcccccccgggaaacatccccctgccgcaatacaatacatcatttcatcaccaccccttactcatattgagtagatcgttcgcaataaccccgtaaaacaactcatatcatatgaatcaccgggccaaggcagttcgatatgatgatgaaaggtggacgatgatgtcctggatgaaacacaataaattagcgaaaacaattgccgcatcaatagcagctgtcggaatatgcttcggcgccactgccgtggcgagtgctgtatgtcggtaccctgtcaccagtggctcatatagcgagggcccttatcatgttgaatggagtgtgcaaccgacaagttcatatgtaaggactcaaaccgattaccataaccaatattgctacgcacagcaagataggacgcaacattcgcagacaagcagagcgctcgctaagcaacattgctccgcctcagtcagcggaggctcttcattgactcaaaatgattatgttgaatattatcagtattaggaagctcgatcaccatgcggaatggaatagtccatgtgttgagaaacatcaccacatgcttggtaggcataactcttatcggctgcgcgggctgtggggtggctgtcgaccagcaggatacgaaacagccgaccggaagtgccggcagcgacacatccaaatccaaaatcgcgaattcgataccggattacatcgatttccttcttgatttggacgccaaacccgataccaaatatcccatgagtgacgcacagaaaacgattctgaagcgttccagaaagtcgggaagcgtatcgaaaccggattacgagcttgcctggtcgaattacaagcagtgcgtgaccagctatgggtatacgacaccggtgctcaggcagttctccaatggcctgtacatgatcgccatgcgggataccaccggcatgagcgaccaacagcgcaagaagttcaacgaggatgagaacaaatgctataacactgaagtcattgcggtgaccggtgtataccagatgcagatcggcaatcccggcatgctttccgatggcgaccaggccatggtcgattgcctgcataaggccggtatcgtgccgaaaaactacgacaaggaagcgtacaagaaggatctggacgcgcacgccaaaaaccagcccaccacagtggatttctcaaacgcggaaatgcaaagctgttgggtggcgaacggcgcgtcgttcggagacgtcaatgacaccgatcagtggaagccgctcggctgaccaccgtgttccccgtcatgcatcagcagacgaccgtaagccctgcatgatttggaatcgtgcggaacggaaacgttcatgcgcgttgggtggcatagaacttgcgttcctgcgccacgaacggacgcagcatggtggtagtggcgatcgcgcatagcaggaacagcgcgccaaccgggccaagccatgtcagtccgaaatgtccgttgaccagaccgccgaccgcggaaccaagcgcgatgccgatgttgaacgacatggaattgagcgacgcggccaagttgagcgatcccgggtgcgattgtgaggcgacatccatatacagcacctgtgacgcggaattctgcagatacatgaacatgccgagtaccacgagcagcaacgcgccgtataccggcacccaatgcgccacgacgagcgacgccataagcaccgcgtgcgcgcagtagatgggacggatgtgcgtcagcggctccactcccctgccacggtcggccagtttgccgccatacaggttgctccacaggcatgccgcgccgaaaatcaccagtccgacgctcaggtactgttccggcacatgaacttcgtcgcgcatgatcggcgtcagatacgtgtagaagacatagctggcggccgcgccgaacaccacggtgagcacaccaagctggatacgacggtcgaagaacaggcggaactgcggcaggaagccgattttcacgatgtggctgttgcgcggcagcgccacgaccataccgacgatgagcataatggtgagcacgttaatgatatggaacgcccaacgccagccgaacgtgttggccacccatgtgccgaccggcacgccgaccacggatgcgatggagaagccggagaacacccatgcgatgaatttcgtgcggaatttgtccgtcgtcacgtcgggcgcatacgtcatggccacggccaccaaagtgccggacaccaacgcgatcatgatgcgcgccaccaccagcaccgcgtaattgggtgcgaacgcgcacaggagattaccggcaaggaatatgccgatcagcgtcagatgagtggcgaatcgcgggaaccgcgccgacagcgccgagccgagcggcgtgacgggcgcgtacacgaacgcgaacaacgacaccagattgccgaccgtcacctccgatatcttcagatcggctgcgatgtcgggcaggatgcccaccacgatgaattcactcatgccaagcatgaaactcgaggcgatcaggataagcaccggaagattgaagaaccgttcctttgccatgccgcatctcccttccacaccgggacatcaatcgattgacgtaaccaatccgaggcaacattatgccatgcgcgatacaatatgacgcacgatgacacgcaagacgaacagcacgcgcaaagcacggaaaacccgcaatcgcaagcccctcaatctcaagaatctccgcaccatgtggcggaaggcgaatcccatcgcacgcatcggcatggtcgccaccgcgaccgtggcagcgatcgcggcgatcgccatcatcgtgggggcggtgcgcttcatcggctggcgcgtgcaggtgaacgaggcgctcaccgcgcaaagccagtcgcagtcgcaatacgacttcaatcccggcaacatcatttccgacggcacgttcttcaacggcaatgcgttgagcgagcagcaggtcagcaccatcatcgaacagcagggcgtggcctgcagtggcgaacgatgcctgaagtccatgacgttcagcaccgaatcgcagtccgcggacgaatattgccaggcttatgatggtggcccgaacgaaagcgcggcggcgattgtctacaaggcgggcaaggcatgcggcatcagccagaaggtgctgctcaccgtgttgcaaaaggagcagcatctgctcacggccaccaatccaaacgatttccaattcaaagcggcgatgggcctgagctgcccggatgatgcgaactgcgaccccacctatgccggcttcttcaaacaggtgtacggcgcggccaaacggtaccagtactatattcggcacgagggacgctacggctaccatgccggacggctcaattacatccagtacaatccaaatgccagctgcggcggcagcaacgtgtacatcgagaaccgagcgaccgcgctgctgtacatatacaccccgtatcagccgaatgccgcggcgctcgaagcgggggccggtgaaggcgattcctgctcgtcatacggcaaccgcaatttcgcgattatctaccattcgatgttcggcagcccgcgaggctgatgcatcccaatgaggatatgccgttcgagcatatcctcgaccagtccgacaccgattccccgtggcctttccgctatagacgtgtgcgaaacgcacgagcaaggccgccgcccggtttatgttccggacggcggcctcgtgtatgacgttttttctatcgatggtccgcgatcacagcttcggcagatacttcttcagctcgaacggggtgacctgcttgcggtactcatcccattcctgatgcttgttgcgcaggaagtattcgaacgcatgctcgccgagcacatccgccacgaagtcggatttctccatgatcttcagagcctcgtcaagcgattccggcagcggctggatgcccatggcctgacgctcggcgtcggtgagctcccacacgtcgtcgctggtgggctcgcccagctgcatttgcttgtcgatgccgtcgagaccggctgcgagcagcacggaatacgcgaggtacggattggcgaccgggtcgagtgcgcggaattccatacgtgcggaattgcctttgccgggcttgtactgcgggatgcgcagcaacgcggagcgattgttgtggccccagcagatgtagctcggcgcctcggcaccgccccacagcctcttgtaggagttgacgtactggtcggtgaccgcgcagatctcggccgcatggtacaggatgccggccgcgaactgtcgtgcggtgacggacatgttgaattcctgcccggcctcgtagaacgcgttggcgtcaccttcgaacaggctcaagtgcgtgtgcatgccggagcccggagcgtcggcgagaggcttcggcatgaagctggcatggatgcctcgctccagcgaaatctccttgacgacggtgcggaaggtcatgatgttgtcggccgtggtgagcgcgtccgcatatcgcagatcgatctcgttctggcctggccccgcctcgtggtgcgagtactccaccgagatgcccatctgctcgagcatgttgacggtggcgcggcggaagtccatgccggggctgcgcggcacatggtcgaagtagccgccctcatcgatcggcttcggagtctgcgcccagtcatcctgcttttcaaacagatagaattcaatctccggatgcacgtagaaggtgaaacccttctccttggccttggacagcgcttgcttgagcacgtggcgcgggtcacccaaggacggctcaccatcaggcgtgagcacgtcgcagaacatgcgcgcggtgccctgcggaccacctctccagggaagaatctggaacgtcgacggatcgggcttgacgatcatatcgtcttcggacacgcgggtgaggccttccacggcggaaccgtcgaatccgagcccttcctcgaatgcggcttccagttccgccggcgcgatggccacggacttcagtgttcccaacacatccgtgaaccatagacgaatgaagcgcacgtcgcgttcctcgaccgtgcgcaaagcaaactcttgctgtttatccatagtgtccaatcgttccatgcgcatgttacgaacgtcgttaacacatgccgtgtcgcgacatgtcagcgtgcgacttcgagggcttcctccagcgtgaaggcgcgcgcgtacagcgatttgccgagaatcgcggcgtccacgcccagttcggcgagctccttgatgttgcgcaggtcgtcgagcttggagatgccaccggatgcggtgaccttcgcgtcggtgcgtgacgccacttcgcgcagcagctcgatgttcgggccgctcatcatgccgtcgcgtgccacgtcggtgaccacgtaacgggagcagccgacggagtcgaggaacttcatggtctcgaacaggtcgccaccttccttcacccagccgcgagccgcgagggtgtggccgcgcacgtcaaggccgacggccacgcggtcgccgtacttcttgatgacggaagcggtccagtcggggttctccagagccgcggtgccgatgttcacgcgggccgcgccggcttcgagcgccgcgtcgagcgaggcgtcgtcgcgcacgccgccggacatttcgatgttgaccttgtcgcccagttccttgacgatggcgcgcagctggtcacggttgttgccggtgccgaatgcggcgtcgagatcgacgaggtggatccattccgcacccgattccacccacgtgcgggcggcttccagcggggagccgtagtcggtttcggagccggattcgccttggcgcaggcgcacggccttgccatcacggacgtcgacggcgggaagcagcgtcaaagacatgtcatacctttcgttgcgttgaacggttttcggccgttcaacggatcttgcgattaccgatttgaatttacgattttgcgattgttgcgattgccttgcacgaatccgcgttcagaacgtcgcaacccagttacgcagcagctgcgcgccggcttcggcggatttctccggatggaactgcgtggcgaacaacggtccacgttcgtaggcggccacgaatcggctgcgcccgtaggtgcaccacgtcacatgctcttccgcatcgccgaagtccagctggtcggcggaggtgtcggcaggcgaagcgctcatcgcggcaaaggagtgcacgaaatagaatcgttcgttctccacgcccttgagcagcacggaaccttccggcgcttcgacggtgtcccaacccatgtgcggcaccacgtcggcgtcgagcagctcgacatcgcccttgatcagaccgagaccgggcgtgccgtcgccatgttccatgccacgttcgaacatgatctgctcgcccacgcagacgccgagcaccgggcggccggcgcgcagacggtctttgatgaccctgtctccgccgacgcttttcagtccttccatgcatgcgccgaacgcgcccacacccggcaccaccagtccgtcggcttccagagcctgacgatggtcggacgtgagggtcacgtcgaggtcgagattggccagcgcgcgcaccatggaacgcacgttgccgaaaccgtaatcgaacaccaccacggaagtcatgggcgctctccttcttttgcttgccgaagaatccatccttcggggaaaaacttattcgatgcttgacgaaccacgaccgaatcgcgtgtgctcggcgaggatcttcatggcgtcatcacgggtcaggcttgcggaatcgacggtttccacgccggaatcacgcaccccctgaacgtcggtgatgcccagcagcaggtcttcgacgaacggcgcggtggaggtgagcagcaccggtggcgcgaacgtctggccgaccttgccttgcaggtacatcgtcgcctcgagcttgtccgcacggttgatcgcgaggacggcaggcatgccggagaccacggtggtcagatctttgatggccgcttccgggccatcgccgtcgagattgcgtaatacagcgaccgcgccttgcggtgaggcgaggcattgcgcggagatgtcggacagttggcagaacgcggcgaacaggcgtgcggaggcaagtcgggtgatgatcaccgcgactttcgcacggttgcccagcagtccctgcaactcgtcgtcgaatgacagcgagttctcggcttcggacagtaccgcgtcggcttccttcgattgcaggccgtcctgcgattcgtcggaagacgcatcggaattaaccgtctcatccggctgatcgaatggcacctgcgcgggagcatcgttctgttgggcaacttcctcgtcctggaattccttttcgaagccggccatggccgcttccagctcctcttcgctgaaatgcatgccgtcgtcgttggtcttccccaagccgtcgaaaccgttcaaatcgtccttgtcgtcggacatcacagcgcgcccttcgtgctgggaatgccgtcgacgcgcggatcgggttcgatggcgaaacgcaatgcgcgggccaaagccttgaattcggcttcggcgatgtggtgcgggtcgcggccggaaatcacgtgcaggtgcaggcaaatgccggcatgcatggcgatggattccatgacgtggcgaacgagcgaaccggtaaaatgcccgccaatcatgcagtattcgaagccttctggctctccggtgcacacgcagtacgggcgtccggaaatgtcgacgacggctttggcgagtgcctcgtcgagcggcacggtggcgtcggcgaaacggcggatgccacgcttgtctccgagggcctgcttcagagcctcgccgaatacgatggcgatgtcttcgacggtgtggtgcgcgtcgatgtcggtgtccccggtggctttgattttcaggtcgatcagcgaatgcttgccgagcgccgtcatcatgtgattgtagaacggcacggatgtgtcgatgtcggttttgccggttccgtcgaggttgagactcagctccaccttggattcgctggtttcacgaacgatggttgcagtacgtgccatgttgcgactccttttgcgatgttgcagttgcgatattacagctacgatattgcgattgcggtggttgcgtcttccgcagccaccgcgattctgttctgtttcaagcttattgccgaatactgtcacgaacttccgttccggacagtatcccagcttgcgttccggcttgttcagccctgttccacgatgcgcagcacttcgaccaacgcctcacggaaccgtgccatttcctcgtcggtgcccatgcacactcgcatccagccttccggaccgacgacgcggatgagcacgccgcgcttcaacagttcgtcgaagatgcggtcgcggtcgtcgaaatggccgccgaagagaatgaagttcgactgggtttcggccacttcgagcgactggcccttgtaggtctgctccttgagccatgcggaggtggcgttgcgggtttcgcgcaggtgcgccacgcggctcagctgttcgtcggtgtgttcgaacgcggcgagggcggcggcctgggtgacggcggacaggtggtacggcatgcgcacgatgcgcacgcagtcgatgatgcccttgttagcggccaggtagccgacgcgtgcgccggcgaaggcgaacgccttgctcatggtgcggctgacggcgaggttttcgtattcgccgatgagttccagcgcggtgggcgtgcccggatctcggaattcgatgtacgcctcgtccaccacgaccaccggatgcacgccttcggcggcgcctgccacttcggcggtacgggcggcttcgagcacgcgcttcagatcttccggcttgagcggggtgccggtcggattgttcgggctggtgagcacgatcatggccggcttgacctcttcgatcgccttgatggtggcgtccacgtcaagcgtgaagtcggcgttacgatgcgcaagcttccacgtggtgaacgtgtcgcgcgcgtattccggatacatggagtacgtcggatcgcagccgagcgcgatgcggccggggccgccgaacgcctggaacagctgcagcatgatctcgttggagccgttggcgccccacaactggtcgacgctgagcttcacgcccgattcgcgttccagatatgtggagaacgccttgcgcagttcgatgtgctcgcggtccggataacggttgagcgtcggggcgatctccttgacacgctgggcgatggtttccaccacggccggttcgggcgcgtacggattctcgttgacgttgaggcacaccggcacgtcgagctgcggcgcgccgtacggttcttcgccgatcaggtcgttgcgcagcggcagatatgccggaatcgcgttgctggaagtctcgctcatcggaggccggcctgctcttcctgttccttgatggtcgccttgttgtacgggtcgtcgatgaagcggctcagcacgcattcgccgtgtgccggcagatcttcggagacggcgaaggcgttcacacgggcggcgagggtcttcagtccctgctcgtcgtattcgatgacttcgaccggcttcatgaaggtgtgcacgccgaggccggcggcgaagcgcgcggtgccggaggtcggcagcacgtggttggaaccggacatgtagtcgcccagcggaaccggggagtacgggccacggaagatggcgccggcgttgcggatcttggcgatcacggcatccggatcagcggtctgcacttcaaggtgttcggccgcgtacgcgttggccgcgtcgatggactgttcgatgccgtctgtgaggatgatgccggactggcggccgcgcagcgacgtgttgacgcgctcggcgtgctcggtgcgaggcacgcggtacttgaggctctcctgcaccttgtcggcgatgtcttcgctgtcggtgataagcacggaaccggcgagctcgtcatgttcagcctggccgatcagatcggcggcgagccagcttgggttggcacccttgtcggcgatgatggcgatttcggtcggaccggcgacggcgtcgatgccgacgatgccggagaccatgcgcttggcggtggcgacgaagatgttgcccgggccggtgatcttgtccaccggatcgcacagaatctcgccgtcctgcggttcggagcccttggcgccgtaagcgaacatggcgatggcctgagcgccgccgaccgcgtacacctcgtccacgccgaggatggcgcaggtggcgaggatggtcttgtccggcaggccgtcggagttgctgcggctcggcggggtggcgatggccagcgattcgacgcctgcggcctgcgccggcaccacgttcatgatgacggagctcgggtagacggccttgcctcccggcacgtacaggccgacgcgctgcaccggaatccaacgttcggcgacgcgtgcgccttcggcgaggtcggtgtggaacggggcgggcacctgggatgcggacacggcgcggcagcggcgcacggattcctcgatggcggcgcgcacttccggatcgagctcgtcgacggcggccttcatggcctcgaccggcacacgcagatgctcgggacggatatggtcgaacttctccgcgaagtcacgcagggccgcagcgccgcgggccttcacatcatcgagaatcggctgtacgagctcagtggcctcgttggtgcccatctcggcgcggggcatggcttccagcatttcggctcgggtcagcttcttgccgcgcaggtcaatgattcgcatatagttttcttcgctcataacgccccatggtaacaacgccaagtcacgagaacgtcccgtcgtctcacattcagccgcattgtgagacacgcaggtccgccgttttccataccatgacgatttccgcgaaaaatatatgccggtcgacaccattcagcgtcggccggcaatcaaaaacctgttcaggtcaaaccgttcaagtcaaaccgctcaggccaacggaagcgagctcggtccgaagagaatcttgatttcggcgaacaacgacgtgtcgcgtttgacgcggaaccggtcgccgaacgtcagcaccttggcgttgcctttgtcgtccatcaacgccagtttcacctcgcacgggccgggatggctggtcagaatctgcccgagccgccgcacatgcgactggtcaagcgcaatcggcggcagcacaatcgtcagcggacgttcatcctgcgcctccaacgtcggtacggtgaattcggtggcgcgcatgctcactgtctcatcgcgcttctccacctggccgcggatctgtaccacggtgtcgacggcgagctcgggcgcggcggcctcgtacaccttgccgaagaacatgcattggatggagctttccaaatcctcgacggttacgatggcccacggattgccctttttcgacacgcggcggtccacgttcgtgatcaggcccgcgatcgtcacctgctggccgtccggcatgcttcccgcgcggtcgatcaggtgggctatcgacatttcgcgcaacgacaccagaatcgactgcatgccgctcaacggatggtcggacacgtacaggccaagcatctcgcgttcgaagttgagcttggttttcttgtcccactcctccacgtcgggcacctgcaccatggcgtctcccatggcggaatcgttctctttggaatcgtccaggtcggcgaacaggtcgaactggccttccgcctgcttgcgtttcaggccgacgaccgaattgatggccgtttcgtggatggtgaacagcgcacgacggttcgggtcgatcgagtcgaacgcgccggccttgatcaacgattccaccaatcgcctgttcagcgcctccaacggcacgcgtttgatgaaatcggtgaagttcacgtacttgccgtggccgttctcacgttccgcgatgatcgcatcgaccgcgttcttgccgacgttgcggatggcgccgaggccgaatcgcacgacgtcgccgactgccgaatactcgtacaccgactcgttcacgtccggagaaagcacctggatgcccatgcgtcgcgcctcgcccaggtacagcgcggtcttgtctttgttcgtgctggcgccttgcagcagggcggccatgaactccaccggataatgcgttttcagatacgcggtccagtaggagatcaaaccgtatgcggccgaatgcgccttgttgaacgcgtagccggagaacggcacgaggatgtcccacacggcctgcgcggcctcttcggaatatccatgctccttcatgccggcgaagaacggaatcttctccttggccagcacttccggcttcttcttgcccatcgctcgacgcagcacgtctgccttgcccagcgaatagccggcgaggattcgcgccgcggactgcacctgctcctggtagacgatcagaccgtaggtctcgtcgagcacttccttaagcggttcggccacttcggggtggattggcgtgatcttctgcagaccgttcttgcgcttcgcatagttggtgtgcgaatccatatccatcggacctggacggtacagcgcgatcagtgcggaaatatcgttgaagttgttcggcttcaacgttttcagcagcgagcgcatgccgtcggaatcgagctggaacacgccgagcgtgtcgccacgggacagcaggtcgtaggtggggcggtcgtccagcggaatcttcgtatggtcgatgcgttccttgccgttcgcctcgatgttgttcagggtgtctcggatcaccgtcaagttggaaagtccgaggaagtccatcttgaccagaccgagcgtttcgcacgtatggtattcgagcgtggtggtgacggtgccgtcggtacgttccagcagcggcgacgtgttggtgatcggctcgctgcccatgatggtggcgcaggcgtgcacaccggtctgacgaatcagaccttcgatgcccatcgcctcgtccgtgatgcgtttcgcgtccgggtcggaatcgtacagttcgcggaattcgcgtgcttccgcgtatcgtttcgcgcttgggtcgaagatgtcgtgcagcggaatgtccttgccgccggtctgtgcgggaggcagggctttggtgatcttgtctccgacggagaagtcgtatcccatgatgcgggcggagtccttcagcgcctgcttggttttgatggtgccgtagatcacgcactgcgccactttgtcacgtccgtatttctcacccacgtagtcgagcacgcgtccacgaccgtccgggtcgaagtcgacgtcgatatcaggcagtgagacacgttccggattgaggaatcgttcgaagatcagaccgtgttcaagcggatcaagttcggtgatgcccatcgcatacgcgaccatggcgcctgcggcggagccacggcccggccccaccatcacgccgtgggccttcgcccagttgatgtagtcggccacgacgaggaagtagccgcagaactgcatctggcagatcacgccgcattcgtagtcggcctgccgcagcacttcgagcgacggcttgccgttgtaccggcgttccaggccttcctcgaccttcttcaggaacagcgacgtctcgtcccagccttccggacagtcgaattgcggcatgaacgcgccgtcttcatgatcgtcgaacatgacgttgcagcgttcggcgatctccaacgtgttgtcgcacgcttcgggaaggtctttgaacagttcgcgcatttcctcggcggatttgatgtagtagccggtgccgtcgaatttgaatcggcccggctcgtccagcgtggagccggagttgatgcacagcatggcgtcctgcgcgccggcgtcttcggcacgcgtgtaatgggaatcgttggtggccagcagcggcgcgttgagcttttttgcaatgtcgagcagcccgtcggtcacttgcttttcgattttcaggccgtggtccatgaattcgatgtagaaattatcgcggccgaaaatgtcttggaattcgccggcggcacgcaacgcgtcatcgaactggcccaggcgcagacgagtctggatgatgcccgacgggcagccggacgaggcgatgatgcctttcgaatatttggcgaggatttccttatccatacgcggatagcgcatgactcggccttcaaggttcgcgtcggtggaggctttcatgaggttgacgaggccttcgtcgttttctgcccacatggtcaggtgggtgatgacaccgccgccggacacatcatccgggttacggcggcgatgcagcggatccagatccggattccagttggtgtcccagctcacacgggtggggtcctgacgtgcggtttccggcgtcacataggcttcgatgccgatgatcggcttgatgccggcgttgaccgcggcgctccacatctcatacgcgccatgcatgttgccgtggtcggtgatgccgacggccggcatgcccagttccttggcgcgcttgaccagatccggtattttcgatgcgccgtcgagcagcgaataatgcgtgtgattatgcagttgcacgaaatttgcggaagtagccatgcgttccaatttagctgggcttcatgacggcgtggagtcgtttctggccgtccggccacacttttatagggactggtcggcgtgccgtgcgcgcatcacgtcaagcgcatgctgcaggtcggcgggatagtgcgatttcaccgtggtccacacgtgcgtacgcggatggcggaattccaattgcatggcgtgcagccattgccgttcaaggccaagcgcctcgctcagctgcggattcgcgccgtacatggcgtcccccgccaacggatgcccgatggatgagaaatgcacgcggatctgatgggtgcggccggtttccaggttcacggatacgagcgtggcttcgccgaaacgttccatcacgtcccaatgcgtgatggcctctttgccggccggtgtcacgcagaagcggaagtcggagactttggcgcgtccgatcggcgcttcgatggtggctttgtcttctttgagattgccttgcacgagtgcgtgatatgttttgacgacctcatgttcggcgaactgccggcgcatctccacgtacgcaagatcggacttgcatacgagcatcagtcccgatgtgcccacgtcgagtcgtgacacgatgccttgacggcctgccgcgccatatgacgtgatgtgcactcccctgtcgatcaggctgccaagcaccgtcggaccggtccatccgacggatgcgtgcgcggcgacgccgaccggcttgtccaccacgaccacatcgtcgtcctcatagacgacggccatgtcatgggcgatcggttccggttcggaccgttcctcgacgatgtcgaattctacggtttcgcctgcctgcagggtcgacgatttggaaatgtccctgccgagcacgcgcgcctgtccgctttcgatgaggtcggccgccttggcccgggaaatgccaagcattttggcgaccgcgacgtcgaatcgtttgccgacgagcgcgtcgggagcgggtacgagacggctcatgctgctttcgccccgtcgtcggttgcgttcgcatcatcaccaagcgtcttgccgttggcctcgtcaaggtccttttggctgaacggttccccgaggaacagcagcagcaccgccgcaacgcccgcgagcatgaggaagatgtccgccacgttgccgatggaccatccgtagttcaggaaatccacgaccttgccgttgaggaacccttccgcgtagatgacgcggtcgatgaggttgccgaacgctcctgcgaaggcgaaggcgaacagcaccgtccatttcatggaaatggtgcggacggcaagtacgaccaacgccacgcaggccgccatcgccagcagggaaatcagccacgtcatgccggagcccatgccgagcgaggcgcctggattacgcaccaatgtcaacgaaagcaggccgggaatcacgcgtatggtacggccatcggccaatgcggacaaagcccacatcttggtgagctggtcaatcgcgatcgtcgcgatcgcaatacacgcaaagacggccacgcggtcgcgcagccgtctttgatcattcttcatgatgtcagacacaggctaatctcagtcgttgttgtcctgagggtcctggtcgtagttgttcgtatcggacacctggttgacgagctggccgaggaagtcggtgagtcgtgcacggtattcggtttcgaactgcttgaggcccttgatgttgccttcgatgaccttggtctgggtctcgaggttgtcgcggacctgctgggcgtagtcgtcggcagcggtacgggtcttcgaatcgtagtcgaaggcgcgcttctgcacttcggcttcgtagttgtcggcctcggtgtgcttgtcggagaagtacgtgtcggcgtcctgggtcttctgagccaggtagccgtcgccctcttcctgcttctgcgcgaagtaggcgtcgccttcctgctgcttctgctccagataagcgtcgccatcctgctgcttgccggccagataggcattgccttcctcggtcttctgcgcaaggtaggcgtcgccctcctcggtcttctggttcaggtacgcatcgccatcctgctgcttctgtgccagataggcatcgccatcctgggtcttgccggacaggtagttgtcggcgttggcgcgggtgtcggtggagtactggtcagcctcggaacgagtgcggttggagtagtcgttggcgctgccgatgatctcttcgtacttgcgctggctttcctcggtgatctccttggccttggccttgcccttgtcgacgtactggtcgtgcagctgcatggccagcgtcagcatggcggtggcgcgctccggctcggtattggcgcttgccgcggcacctgcgatcttctgcaggctgccggtttcggtgctcggctcggacttggcgacctgttcgcgcagctgtgcctcgcgaatctgggaatccttcagttgctgggcaagctgctggatctgcatggcctgctgcttcacctgggcatcctgctgctgggactgggcagcatgctcctgagtgagctgctgggcctgagcgacctggtcctgcgcttcctgaagctttgcggtgagctgatcgatctgctccttctgacgctgagccacgaccacctgctcctgggccgatgccagctgacgggacaggtcctcggtctgtgcgcggaacgtgtcacgctcgtgctgcacggcggtaagctgctcgccaaggtcggcctgaccggccgcttcggctgcctgggcggtgagctgatcgacctgcgcggacagacgatcgatctgccccttgagctgctcgttctgggaagacagcgcacgattgctttcctctgcctcggaaagcttggcggccgcggcctgagcggcctgagcggcctggtctcccgcaccagctgcctgctcggaggcggacttcagcgtcgcgttctcctgctgcagggactggatctgagcattcaactcggaaatcttggaattgagtcctgcgacatccgggccaagagactgcgtggcctgtccgccggcaactgcctgcttgccaagggcttccaccgtctcggttacctgatcgaggaagtcatcgacttcatcgacgtcatagccttccttgaaccttacggtctggaaagtatgctccctaatatctttcggcgtcaacagagccataaatccttacacctcgctttgggcttgatgccttactgttgttgctttcagtgttcgactctagcacgaaaccatagatattttgcggaaaaacggttttttagaggtgctaaataaggaaatcaatgaccacaagaacgaaataaagcacaagatacgcgacgtcaaaatagatcggtccgagcggaacgggacgaatatactgccgcaaccaccttaacggcggctccgtcagctggtagatggcgtcgaacaacgaggccacgattccgcttggccgccacgtcggcgacaatgccaacacccagtcgagaatcatgcggacgaacagcaccaggatataggcgttgaccagaaaatggacgacgctaccaattatcgagagaatcacgttgccactgtatcaagcgcgcataacaaaatgcccccgctttcagtgggggcataatcgtctgatttgtgcttgctctgtgctacacggctcagtcggcgaacaggtcgtgggccggacccttgtcttcaggctcctcgaccttgatgttcacttgggccgggctcagcaggaacacgcgcggagtgacgcgttcgatggagccgcgcacgccgaacaccacaccggcggagaagtcgacgatgcggtatgccacggcttcggccacacctgtcaggttcagcaccaccggaatgccgtcacgaatggcgcgaccgaccatctgcgcatcgtcataggtcttcggatggatggtggtgatgcggctcactctacccccctggaacgggttggactgctcacgcggagcggacggcgtggaagcggaagccgaagaggaaggcatcggggtgacggaatgatccgaatcgaacgaggtctcgccggtgtcgacgtcatcctcgaaatcatcctcaccctcggcgacgtcggacattcccaagtacgacatcgcgttcttcatgaaacctgccatgtatgttcctttcgcgtctacgcgttgactttagcgcaggaaatccggaatatcgaggtcgcccggatcgttagccgaaaccacttcatgctcggtggtctggtcgaacgaggcgacgttctggtccggagtggacggaatgtagctggacagcggctgcacctgcggcaccgccggagtctgcaccggctgcggctgctgggcgggagcctgcacgccggcggacaacgcggacagcggtaccgtgttttccttggccgcggccggcttttcttcggccggctggtcgggcttcttagaattggcatcgaaacctgccgcgatgacggtgacacgcacctcgtcgccgtaggcgtcgtccagggacaggccccagatgatctgcgcttccggatggatggccttctgcaccagcgcgaccgcggctgcggcttcctgcagcttcaggtcggtcggaccggcgatgttgatcagtgcgccatgcgcaccctcgatgctttcctccagcagcggcgagctgatggcgatttccgcggcctgcgtggcgcggtcctctccccgagcggaaccgatgccgaacagcgcggtgccggcaccacgcagaatcgcgttgacatcgttgaaatcaacgtggatgtacgaattcgaggtaatcaggtcggtgatgccctgcacgccggccagcagtgcggtgtcggcggtcttgaacgcgtcgacgatgccaatggtgcggtcggacagttccagcagtcggtcgttcggaatgacgatcagcgcgtcgacttccttgcgcaggttctcgatgccgagcgcggcggaagcggaacgctgcggaccttcgaagctgaacggacgggtcaccacggcgatggtcagcgcgccctgctggtgggccgcacgtgccacgatcgggctggcgccggttccggtgccaccgccctcaccgcaggtgacgaacaccatgtcggagcccttaagcgcctcttcgatgtcggactggtgatcctgcgccgccttggcacccttttccgggtcggcgccagcgcccagaccacggctggaggcatcgttcagcgagatcttgacatcggcgtcggatcgcagcagatcctttgcatcagtgttgatcgcaataaattcgacgctttgaagaccctccgcaatcatgcgattgacagcgttgcctccggctccaccgacaccgacgaccttgatgttggtcttgtcgttgaaattgtcagtctgggcaatctcgctcaccattgtctcctgttcactcacgtatatgaacaactctatcgcaatcgcgccgatgatacgcgcacttttccaggcgtgtaccaccgttttttcacttttttgctgtcagcatgttcattctgcctgcgttgaccccttcagtcatttgtacacggctcttcgaacatgcgtgacgggctttagtagctggcatccatcgggtcatccccgaacagcgcctcacgctcctcgtgcgtggtttcccgggattccaaccatccgtaaggcagatgcacctttttggcgaagcgcacgcgcccccttggcttgtcggcgatgcgttctgggaaccgaatgttcgggtcgagtctgcctatctcgcgccggacatcctcaagattttcacattccatgaacgcacggcgtgtggaaccgcccacggggaagcccttcagataccatgcgacgtgcttgcgcaggtcatgcacggccatccgctcgtcgccatcatagaattcggtcagcagttcggcatgccgttcgatcacgcggcacacgtcgcccagcgtggggtcgacgcgctcgtcactgccggcgaacgcgttcttgatgtcggcgaacaaccatggacggccttggcagccgcggccgatcgcaacacccgcgcaaccggtttcggtgaccatcgccaacgcgtcgttggcaccccaaatatccccgttgccgaagacgggaatatcaagctcggaaaccagctcgccgatgcgggaccaatcggaatgcccaccgtaatattcggcggtggtgcgcgcgtgcagggtgacggccttgcagccttcctcctgcgcgatgtgcccggcttcgaggaacgtctcgtgttcatggtcgatgccgacgcggattttggccgtgactggtacgttggccgcgtcgcacaccttgaccacgcgttggatgatctcacggaacaggtccgtcttccatggcagcgcggatccgccgccacgacgcgtcaccttgggcaccgggcagccgaagttgaggtcgacatggtcggccatgttctcgtcgatgacgattttcgcggcctgctccacaatcgagggattgacgccgtacagctgcagcgagcgaatcttctcgctgggtgcgaaacggcataggcgcagggctttcggattgcgggccaccaatgcgcgcgcggtgatcatttccgccacgtacagaccgtcgggaccgtagctttcgcagatcacgcggaacggccagttggtgacgcccgccataggcgaaagcaccaccggcgtttcgacgtgcaccggacccagatcaacgggctttataacgggaggaaccgacggccgttccgcgtcggtacgcgggtcgagcacgtcggattcctcgtaggcattcacaatgctatctggcataggtcagacttgttccgttcaatatgaccgattcggggcgatcagtacaggccaccggcttcggcgatcttgacggactcaggccaagcctcgccacccatttcgaccggcatctgcggcacgctgacgcgcttctcgccgatacgctcggcgatgtagtcggccaccttgtcgaggctgacgcgctcctgctgcatggtgtcgcgttcacggatggtgacggcctggtcgtcgagggtgtcgaagtcgacggtgacgcacagcggggtgccgatctcgtcttcacgacggtaacgacggccgatcgcgccggcctcgtcgtagtcgatcatccactcgttctggcgcaggtcggcggcgagcttctgcgccacgttctgcagatcgggcttcttgctcaacggcagcacggcggccttgaccggagccagacgcgggtcgaggtgcaggacggtgcgcttgtccacgccgcccttggtgttcggagcctcgtccacgtcgtaggcgtcgacgaggaagcacatgagggaacgggtcaggccggcggccggctcaatgacgtacggcacgtacttttcgccggtggcctggttgaagtagctcaggtcctcgccggagtgctccgcgtgcgcggacaggtcgaagtcggtacggttggcgatgccttcgagctcgccccaatcggagccctggaagccgaacttgtattcgatgtcgacggtgcgcttcgaatagtgggccagcttctccttcggatgctcgtagtggcgcaggttctccggcttgacgccgaggtcgaggtaccactgggtacgggcgtcgatccagtactggtgccaggcttcgtcctcgccgggcttgacgaagaattccatttccatctgctcgaactcacgggtacggaagatgaagttgcccggggtgatctcgttacggaaggacttgcccatgttggcgatgccgaacggcggcttcttgcgggaagaggtcatcacgttcttgaagtccacgaagatgccctgcgcggtttccggacgcaggtagtgcagggagttctcgtcctcgaccgggccgaggtgggtgcgcagcatcatgttgaagtcgcgcggttcggtccacttgccgcgggtgccgcagtcggggcacacgatgtcggccatgccgttctccggcagcttgtctccatgcttctcggcgtaggattcctcaagcttgtcggaacgctggcgcttatggcagttgaggcactcgaccagcggatcgttgaagacggccacgtggccggaagccacccacacgggggtcggcaggatgatggaggtgtccacgcccaccacgtcgccacgggtgacgaccatggagcgccaccattcgcgcttgatattgtccttcagcgccacgccgagcggaccgtaatcccatgcggaacgggttccgccgtagatttcaccggcgggaaaaacaaagccacgacgcttggcaagggatacgacttcatcgagtttggatacagccacaatgcaccttctggattgaatggtttggggtctttacaagcgcaaagcctaccgtcacatgctgacagttttgcctgacagtttcacggcatggcaagttacgtgatttccgatggggatgaacggcaaattgatgcaagaaccgaatgaaaacacataagaatatgtgaagatacataaggggcttcccgcgaatgcggaaggccccatgtaatggataaggagagaatcgttctttatgtattgtttgtcactgcttggtaacgttctcgtcttcgacggtgtcattgttaagcagcagcgaccagattttacaattaatggtcacgttgttcttggtggcgtcgccgcccttatcaagggtgtacgtcacatcttcaggaacggcaatacggttgatgccctgcacggcctgaacgaagccacgcattgcatcatagctgccattcgcagtaatgctcaccggaacctgcacaagccggccggctttgatggttccctgcatttcggacggcacttcagcggtggtggcctcatcgaaggtcacagactggatggagacgcccgcaccatcagcagcggcattcaacgaatcgatgaattcgttttggttatagccgtcaggaatctggcgctgcagctgacgcaaacgatccttctgcaggccgatcgtctcgctcgccatacgcagcgtttcaatctggtcacgcgttttcttgttgctttcttcgatctgcgcagtctgcgcgtcggcttccttaatgtgtgtaagacgcggagatacgcctacaagccatgtcaacatcagcaccactacgatgccgacggccagtgcgatccatgcgattttatgcttgttcatgtttcctcctgcttatcagttggacgatccgctggcatcggatgaggtgtcagtcgactggttggcagaagcatcagactgtccggacgcagccttgtcgaggcttgcgcgcagcttggcgagcaaatcacggttggcctgggtcgcgcctgctgagttgtcgcttcgcgaagtggtgttgccgtccatcaccagtgaaatcgttccggtatacgtgtaggtggtgccaccttcactgtcattcttggtaatagagctcacataacccgtcttgtacgtggggatcgaggcgaaattgttgataaagtccttggccgagtagaaattcggcgattcgatggtgaagtccgcggaaatcacgccgttaccagaccacacagtggacgtattgtcggaggatgaggacgaattgttcgatgaagcgatctggaagcttttgagttccagattcgtatactggccgccttccggaagcgagctgttcagcgaatcggcgaccttcatccagtccatttcgtcatacagcatggcaatcttcgccttctgcgcatcgtccagcgaattcaacgtgtcttcgacatccttgaactgcgctttctccttttgcagggaaatggtcttctgttgagccacttccacacgatggtccgcccatgtggattgggcgaacatgaacacgctgaccaccaaagatacaatgagcacgccgatcagcacatacgttaacaggtatttgatggctcgatcgcgattcaatccgacgatggaacgcggaatcaggttagcgcgcatggtccagtcggctgggttttccggcgcggtgctacgcttgccgataccgcccgccttcaacgcattgctgatatcggagacgttcatggatagcagggtgcccttctgaccgtccgaagtgtccggataggcgatttccttgccacgtccacggtgggagttggccttgtttttcttggatttcatatcaagtttcataatcacactcacctcggcttctttccgatgaccagtcccagcaccccgcctaaatcgaccgcgtgcgccacaatgttctgacgttcgacttccttggacagcttgaagcggatgaacggatcgccaatgcgcaccatcttgttgatggagcttgccaacactgggggcagaccaatgagtcgcgcacccgtaccggtgaggatgatgccgctgatggtgctgtccgcatggtcgacgtcgtacatgttcaacgtattgcgaataccgacgatgagctgcgccgtggtttcacgaatgacttcctcggctttttcgagacgttcgtcaccggtcacattttgcagaccaatctggtttttgatgcgttccgcgtcttcgaaggagatgctcagcgcattggcgatggcgtcggacacgtcgtcggcaccggacggcacgacgcgcatataggcgggttttccgttattgagcacgatcacgtcggtgcagttgccgttgatgttgaccaccgcttcggtctgcgcctggttggtgtcgctgaacaggcgggccaacgcgaacggaccggcgtcgatggaggtgatcacgaaacccgcttcttctgcggtatacgcggttttttccagaccgccgcgcagggtggctacgagaatgccatgaagctgcttgccgttctgctcgtcatccactacagacaacggcacgaagtcaagttcggattcctcaatgggcaatggaatcatgcctttggcctggaatggcagggttgagcgtaaatcagctagggacatgtaggggaagtccgcctcacggaacaccatacgacggctcgaataaacgagtatggtgttctcacgcgggaacttgaagcgttgcaccaacgttttcagtagaccggtgaccacttcggcgtccaccacttcgccatccaccacagctccaacgggcagcggaagcgcctggaagtgtttgatggtcggcgaatccgtataggggtcggctatgaccgccgctcgtatggcgtcgctcgcaatcgacagcgccgttattgctctcatggtctctccttatatatatgggtcttgtatgcggatgcgttacgcaagtccggtgagttgcaggtatagtgtggcgattggtacgccggcgaaaatgccaagccatgcgccgagcagcatggatggcccaaaggggatgcctccatgaaggtcgacctttttgctggccagcaataccaagctgatggcaccgccgatgaagaacgcggcgaacgatccaatgatgaattgcggccagccaagccagccaagcagcaatccgagaatgaacgcgagtttgatgtcgccgtctcccatgccacctttccagatgagtgagagtatgaaatagaacacgaagagaatcagcgcgcagagcgctccgcgaccaagacgagtccactcgcctatgccaaacgatgccacaaccagcagcaacaccgttgcgataagcgtcggcagtagcactacgttgaggatgagatggtggtccaagtcgatgaacgctatgacgatggacacgcatgcgaacacgtacagcacgggtagtgcccacaacgggtatgcgccgaacattccacctgcggttacggcaaggaaggacagtccgccaagcgattcgaccagcggatatcgtgcggcaatcggttccttgcagtgtcggcatttcgcgccgagtgccaaccaggaaaagatgggaatattgtcataccaagcgattggcgcttcgcatttcggacaaaagctacgtttcggattggtgatgcttatgtggttcggcacacgccatatcactacattcaggaaagatccgaagatacagccgatgatcagcgaggccaccagcagtatcaccacggtaggaacatcattcactatatccatgccgttcaccactttctggatgtgacggtggagtccacaaccgctgagaaataggtactggtagggatagatacggtggtcgttgtcgttgtccaagtaatgctaccggccgatccggcatcaccataattcactgaagcgttccatgcctgcgatttcaccagtcgcccacgcacgtcacgatcggttccgcatgaaaccattttcagcatggaatgaccgtctgagcgattgtattgacggtctttcttcccattgctttccacatagtctcccggatagatttccgtcaggcacatgccttcgctggtttggaaagtgccagcccatggatactgcgtcttgccgccgtaactcaccgctttcgaggtgttgtgctcgttgtatcggcggaactttgtggcgtcacttggattatcggtcaacgacaccttactgccggaaacatgcaggtacttcgcgttgccgttggtgtcgtgcagggctatggtggtgtcgatgccagtgccatcggcgctggcatcttcggtataggagacgcggtcggatgtgaagttgaagttctccttgtcggcggtcgaacagtgagaggtcgagatgaaatcgctgccttgccccatgatcgtcttctggtagcatttcgcatcgaagtccgcactatgcacgtcgcaggtgtcggcgtatacgtcgttgccgtccatcaccatgcagaatccggatgcggagttcaccatctgattggtgccgtatcccgcttcgcctgcttggctgaaggatgcggtggcatcctgcatgtcggcaccgttcgaaaagtaggaatcgctgaagttataggtccattgcgacaccatatacgcctgacggtagagggtggctttgatattgccgcccgcgaaatgcggatcgccactgtcttgtgggctaccgccgtaatgggtgacttccagacgttggaacttggtctttttgccgctctgcacgccggctacggcatatcccttgctttcaggcaaggcggaatcatatgacgctgcttgcgcactgacatcgcccgtcagctcgttccagtatccggcgttgatgaacccgttgtagaagttccatttctggtatttgttgagcagactgttcgggtcgttcttctccgtctgctgcgcaaccttattcggatccatataataatcgccttggaagtggactccgtatgatgtgccgcatggctgcaaggtggctggagtcttgccgtcggtgtcatcgatgctcacaccggtgacgcacaatcccatattcgaggccagacggatggaattgtccttgtagtacacccacgtgttcaatgaggagtacgcaccgtcagcacggcattcctcagtatattggtaggtgtcacctcccgcgttgtatgcggcgggcagtaccaccagcccagaaccggcttgaggcgatttgcttaaatcgaggttctcggcaatgcttttcttctcgttggtaaccggaatggtggtggccagcatgcaggtgcggttcactggattcaacgtcgcagtgccatcggacagctggctggtattggtgtgtccggaatccaccgtgccggagaatttaacttcgccggttggatcggatccgatggacacgccatcataatccacgggtacccatacgaactgcgaatcgagcctgttgtagggcgccgcggcataaaaacccatgcccatgcggccaccgacgcccagggtgctggaatggttcgtggtggtggagtccgtcttggcttcgatcctgcataccgcacgtttcatggcctgcgggcttttggtgttgcctgctgtacggccgtccttataccggttgatgaagcccgtggccaccacttcggcatactgtaggtttttcagatcggatggagagctgatcatctccgccgatgcgtcatccggattggtgtcgtagaaattgatgcgcacacgataggacaggtcatccggcgtatatgaagccgtatccgatgtttttaccgtcttattcaaagcaacatgattcaacaatacggatgcgccatcatatttggcaaattcaccatccttggaactgtcgttcatatcagcatcaacggcaggcaacaccttctgtaaatcatcaagactcgtagaaccttgcaacttcgccagagtctcattgatatagctcaagccgacttcaaggccggattcggccgcatagttggcttgggaattttccttattgttcttgtaaggaatcgcctgggcaagcagggtagtcatgaccagagcggatgtggtgagcaccaccatcacgaacagaacggccagcatcatggcggcgccgcgctcccccatgcgttcgcgtaatgccgcacggtacctgcggttgagtctggaccacaatccggtctgtttcatgcttgctcctatatataaaggtatgtttcgctcgggtactcggatatcagatcaggcctgaccattgatggcgtcgaacatggagaacatcggcatatacaatgccaccaccatgaagccgaccaccacgccgaggaacagaatcatcagcggttccagcaacgaggtgagctgtttggccatggattgggcctcttcgtcatacgctcggcccgcactggacagcattttgtcgatggcgccggagtcctcgccaatggccaccatctgcaccagcatgttcgggaagatcttttcggtgctcatgctgtcggccagacggtagccacgttccaccaaacggcccacacgcttcgaagacgaatcaatcacatagttgcccgaagtcgatccgacgatatcaagtgcctggagaatcggcacgccggaagcgagcatggaagagaaattattgcagaaacgggccaaggccacgttggtgtccagcttgccgaacaccggtgccttgagtgtgaacggatcccaccaagtgcggatgatgtctttgttacggttgcgcttccagaacatggccagcgccacgacggccacgatcagcatcggaagcacgtagggcatcactttgccgaggtccaccaggatctgggtcacgaacggcaactgggcattcatggaatcgtacatgctggcgaacatcggcacgatggtgagcagcatcaccatcaccaagatcaaggcgatgcccaacaccacgaccggataggccatggcgcttttgatctgcccttggagcctcacatccgcttcgaagctgtccgccacggtgagcagcgatttgtctaggaagccgccggtctcgccggcacgaaccatgttgaccatgatcggcgggaacagggaatcgggatccgccgacatggcttcggagaaggacgagccgccttccacttgcgccacgcaggcctgcaccgccttacggagtttcacgttctcgatttgttcggtgacgatgttcaaggctcggatcagcgagacgccagccgccaccatggtggcgagctgccgtgccgttactgcgaagtcttttttgcttggatatttctcgaacgccttgatgttgatttcagtgttgagaccggtgcctgcggagaggttcaccagttcggtggggatggctcccatctgagtgatgcgcgccacggcctggtcgcgcgagttggcttcgatggtgcctttcatctgcttggtgccatcgagcgagacgcccttgtacttccacttctgcgtggtgttctgctgcagtggcgcttgtgcctgtgccttggccatggattcccctcaattaccgaatggcgtacaaaatattttcgtgaatatgagtaaggtgccgaaggcatcatttgccttcgacaccttgaactacctggtacctaacaatcgttttttattcgctaatcttgccagttgaagacttgtacgtataggtcttgcaattatcatcgctggtattgtgaccttcaatggtatagccattatcaccgtccgcggcaatcttcagctcgaccttgtcactgacggtaatttcgttatcgtcaatggtgcaatttgtaccaatcgtatccgcacaaggcgaaaggtcaacaccactcagagaaccattgtgattggtcataatggtttccataacaacgctggcattcttgacgtcggtctgggcggcggagttccaggcggccttgcgctggttcaggtagatcgggatggccacggcggcaaggatgccgatgatgatgacgaccacgagcagttcgacgagggtgaagcccttctcgcccttggcacggcggttgagtgcgttacgtacgctcttcataatgaacccttctttccaattggaaggacataccgtgagaccgtccaacttcggatgatccacagcgattcttctttgcgttattaccccttgtgggggtggctggctcacataaccaacaactctcagcgtagtcgtattgacatcgtttgcagtaccagatgcagtgcaccaatcgcaccaatgatgtttcatccaccgttttcatcacaaccccgaatcaaactttttcaatacgattgcataacccctcttcacacaatcaccaccgtccgattccgtaacatgcgttgagtccgtcggtctaccggtgtatctcttcgtctgaaacatttgccctggaatagttatattttcaatagtgtttcagaaaatattttcagcacgttttgacgaaaattcatcaaaaaaccatttccccccgggcgcgtcgggggtatttaaaagtatagaaaaagggctcccccacaagggagagcccttacagacacagtcattcaacgacattgactgaagtcgaccgaagcactcgaacccacattgcgagctgtaaacgatgtcaatgtgttcgaggtgaccggcttgccacccacatacgaacccgtcaccggcgaataccgcaccacgcgcgtaccgccatccatgctgaacagtttgtttttgaacagcgaatcatcggacgttgaagcggtactgttgttcatcaccgccgtcaacaccgcatgctcgctccacgctccccccgcaccggttgcgtatggcctggtttttaccacgacggaaccataatcatcaactcgcccgccggaccacgtggcctctgtgtactcaatcacaacgcattgccgaatcccatcggcatcagtggtcaccaaagtcaacctgtcaccgctggcagcctcttccacaccttcggcattgcgaacatatcggtccagagcctgcaccgatgtagctatttccgtagccgatctggtgcggatagcatcggctgtggtggaatgcaaatattgcacgatcgacaccgtgaacatggtggaaacaatggcaaaaataaacaatgaaaccatcatctccaccaaggtaacgccgccttccccacgagcacgcctacggagcgcacgtaataatcggcgattcagactgaatccagagttcttctcttccataagccgtcccgctccttcaggccccgatcacattcaacagttcattggtggtatacacggccgttttgtctgcgtcaatattatccgaccaggtgacgcctaccaccacgcgtaccatcggcatatacgttttcgccataaaggtgaatcccttagtaggaatgttgtcctgactcaggatgctggatcgcagcgaggcgtcaggagtaccgtcaagaccgctaatggacgcatgcccgtcaatacctagttccgaagcggttctacaatccatggtgccgctttcccgatagcacttctcaatcacggtgttcaccgtatatgtagtatgtttgacgtctttgcccgtggtagtgcgcaccggctgaatgtacttgctcgtatcggcatccggagtggccgtagcctccaaatccgagaattgcgaggtgatggcccccactgccgtgagattcgcatgtgctttcttcacatcatccacacccatgccaggcagcaaatccgtgtaataggaggatggcgcagaagtatgatccgctatctgtgcgcgcatgcgttcgataccatcgctacccaaagcaatggctgctgaacgctgctgctgggcataagaagtacgaatcgcagtaatcgcgaactgtgcggcggcaagacctgtgatgctcagcaccacaatcgccaccaatacctcaaccaatgtgaaacccgactcgccacgcttcggcaatcgtttgacgttatgtattgcaagccctgtcgcggcatcatttaccgccctacgccagctgtgctccatgagcagctccttcatgcagtatcaccccatcatcggaggcaacaggaaaaatcaccgcagaaaaggcggtgcatgaatatctgtactgtatcacgattccctgccaacgttttcacacccttccaaacaccacatgacaattggcgtttcagccacaaagccgctaaactatgcgagtagtagtgcacaacactgcaatcgttagctcacatgaccatgaacaactgaacattctcaggcccgcaaacacctgtgttcgcaaagggccataagtcataccgtgcgttccggcgcatggtccaggaggtcattatgagcgacgccggttcgggaagccgtttccctttcctcaagcgcaatcgaaacgacgacacgccgagcgatttctcacagcgcatggatttgaattccccggtcacaggagaaatcaaccagattttcacgccgagccagccacgccatgccgctgcacccagcgacgccactagcgactttcccgccatgcccacatccaccgaaggcatggacgaaaacaccgaacgcgaatatgccatggcgctagctcaaggcatgagcctaccgttcgtagacctcaacgaataccaagtagacaaagaagtcatcagcatggtgccggacgacctgtgccgtcgcaaccagctgctgccattgtccattgtcaacggacgcatcaccgtggccatggccaacccgaaaaacttcgccgccatcgacgacgtgtccgccagcaccggcatgccggtcattcccatggtggccatgccatcccaagtgaaggatgccatcaatcgctatctgcgcgccaacgcggaattgactgagctttcccacgaaatcgccgcaaccgcgaaaaaggaagtcgacctcgaatccgacagcggcgaggacgcttcccccgtggcacgcttcgtcagtctacttatcaaccaggccatcgacgaccactgctccgatatccacatcgaaccgcaggaagacggtctgctcgtgcgctaccgtatcgacggtgtgctgcacgtgttccaaaaggcgccgaaagccatgacccaaggtgtgatcagccgcatcaaggtcatgtccgatatggatatcggcgagcgccgtaagccgcaggatggccgtatcaccgtcaagcacaatggtcagaaggtggatcttcgtgtggccgcactgccgacggtatggggcgagaagattgttatgcgaatcctgagcacgccttcgggcaatctcaaggtggaggatttgaatttcagccaacgtaatttcgacgtgttctccaaggcgtacaaccgtccgtatggtctggtgttggtcaccggtcctaccggttcgggtaagtcgaccacgttgtatgccacgttgggcgatgtggcgaagccggaaatcaacatcatcacggttgaggacccggtggaattccgtatgagaggcatcaatcaggttcaggtgaacaacaaggccggtatgacgttcgccgcggctctgcgttcgatccttcgtgcagaccctgatgtggtgctcatcggcgagattcgagatcaggagaccgccaacattgctattgaggcttcgttgaccggccatttggtgctttccaccctgcacaccaatgatgcgccaagcgcggtgacacgtttgacggaaatgggtgtggagccgttcctattgagctcgtcgcttgctgcggtgatggctcagcgactggctcgccgcctgtgcaagaagtgcaagcgtcaggataccgccaccgaggcggagcttcggacgttgggtgttccacacatgccagatacccctcttccgacgatatggcgtccggtaggatgccgagaatgcgccaacaccggctatagcggccgtgtggccatccagcaggtcatgggcgtggattcaacaatggaggatcttatagcccgtggcgccacgtcgattgatattgacaaggcggcgaaggagcaaggcatgaccacacttcgtaaggacggttggcagaaggcgcttcaaggcattacctccgtggaggaagtgcttcgcgtgacggtgtaggttccacctgacgttacatgcacctatgcacctctccgcacttataaaacacctataaaacgttcggttgcatcggcgcgtcgaagcgccggcacgaccgacattttcagacagcaacccacctattaaaaggacaatgatgaccatcgagcaaacgtggaacaatggcggatatctttccggtctcaaaggcgtgaccattcccaacaacactccatcgttcaatgaggatccccgcaagggacgtcattggtcttccgacaatgcgattcaggcagatgatgaaagccttaagggcattttcgcttcgcttaattcaatgccgactgtaagccagcaggatgtgcaaattcccgacccgcagccagtttcacagtctcaaccatccgaacagtctgttgctcaacaacagactacgcaagccatacaacaatcgcaggaagcgcatgtttttccaacaacaagcgaccgtcaaccagtcggtaccggcagcctgcagtttgatgagaacactgacgcgacccagcaaaatcccgcatatgaggagcatgggccgatccagcagatcgacagcaatccaccgtccttcgtaccgggtgccacaccattcgctaagcgacaggccgacatcaccgaaaccgcagcgcagcagatgcctccgaccatcactcacattccgcaggacgcagctttccaaaggccgcagccacagcaacagcagatgagtcagccccagccgcagaccaggccattcgcggatttcgtagtgcctgaaaccaacgacgccgacgaggatgccgttccggaagaacgtaagatcaaggccgagcaggtcgaacagacgctgcgcaccgaacatccggacgcggacgacgaattcgtgtcggccatccgccagctggttgagctcaatgcgtccgatttgcacttggtaatcaacgacccgccaatgctgcgcgtggatggcaagctgcgccccgccaagggattgagcgtgtggacgaaggatcacacgtacgaagcagtgaaaatcatgaccaacgaattggagatggaacgtttcaaagatgatctggaacttgatatctccttcgccattggcgatctgctgcgcttccgcgtgaacgtataccgcgaccgtatgggcgtatgcgccgcgttgcgtaccattcccacggaaatcaaaaccgcgcaggaactgggaattgacccgcgtatcgccgaccttgcgctgttgccgcgtggtctggtgcttgtatgcggcccgaccggttccggtaagtcgaccacactggccgcaatcgtggacaaggcgaatgcggaacgcgccgaccatatcatcaccatcgaagacccgatcgaattcgtgcatcagcacaagcgttgcgtgatgagccagcgtgaggtgggcaccgacacgaagagcttcgcggaagcactgaaacgcgcgctgcgtgaggatccggacatcatcgaagtcggcgagcttcgagacctggagaccatctccaccgcattgaccgcagtggagaccggccacttggtgttcgcaacccttcatactcaggacgccggctccaccgtggaccgtctcatcgacgtgtatccggaaaaccagcagcagcagattcgcgtgcaggtagcttccaccttgcgtgccgtgatcgtacagacactgattccgcgcgctaccggccatggccgtgcaccagccactgaagtgatgatcaacactccggccgtttcctcactgatccgcagtggcaaggcgcatcagattcgcaccgtgctacagtccggcgagaaggaaggcatgcacacgctcgaccaggatttggcgcgactggtgaacaagggcaccatcacgttcgaggatgcgttggtgaaggtgcaagtgcgtgaagagttcgagaagctctgcggcgcacgttcctcgttctaaggatggccggcacggctggcgcgtggtatgcccatatgtccaatggcggttccgcaacatggaatatgacggaaccgccatgatccatgcgcggccacgcaataatcgcaaagtcacgcagcaatcgcgcgtatttcgaacgcaacgggaaacaggaaacatgagttctgcaacagtagcagccacagacaacagaacacgatgcgacgcaattcggcattggctcacgcctcatcgtttgcactgcatcgcgctcgcggcgtatgtcatcgtggtgggcacggtgatgtgtttccacgaaccatggttcgacgaggcgcaagcctggctcatcgcgcgcgactgctcgtggcgggagatgattctggaacgtccacactatgagcatcatccgcctctgtggtggatgatgctcgccgcacccgcaaaactcggcgtaccctacgagatcggtctgaaaagcatcaatctggcatgcgccacactcatgatctggctgttggaattcaaaaccaaactgccggaaccattcaaagtcatcctgccgttctcctatttcctgtgctatcagtacggcgtcacgtcgcgcccctatgcgctgatggtcgccgccatgctgctggtggctatcaactggaaaacccgcgacgagaaaccatggcgcgaagcgctcagcatgatgctgctgtgcctgaccagttcatatggactggtaatcgccggcatgttcgcggcgaattgggtagtgcggttcgtctggcaggaacactcgttgatacgtaaccggcaacggttcatcgcgctgctggcgctgctcgcggcggcgatggccatactgatcgacgtgatgcccgcaaaagacgtgtattccggcaatttcgacatctccggcatgacacagccggcaccactatggatacaaatctgcaattcctggctgctgctgccggccgaagcattattcacctcgacggtgtcggacacgaatctggtattcatcggcctatcaccgacactgctgtacacgggaaccgtgtcatgcctcatgtgggccccgctcatccacatcagccgacgtcggcacaacgcaatgctgctgctgagctcgtacacagtgatgtgcttggtgttcgcgcagcatttctctatgcaccatctgggcatcctgctgggattcttcatcgcggtgctcgcgattgactgcgacgagcgacgtatcagcacggacgactggccggcctggtgcatcaccatggccgaccgattcatcggcaagcttggagcgaggaaagcgcgcaactatctcatcacgctgaaggccctcgctttaggtgccatgctcatcagcgtgtattggacgatcaacgccagcatatgcgacatacgatacgagtattcctcatcccggacggtggcctcgttcatcaagaccaatcatctggagcaataccgttggatggctggctggactcgcatcaattccacgaatgcgtccccggacgtcaaagcacgaatcaagcaaggcggctactgcgccaatggcaaggactgcatcgactacacatcatgggtgagcggaacactggtcaccgccgacccgtacttcaagcgtacgctcatgtccaatgcctacaaagggcgcagctacatctcttgggaatggtgcatagacccctatgccggcaaacaagacatcgaaacctggagatcatggggcgaacccgaattctacgacaccatctatcagccgttcttcttcagcgccctcggctatgaccggaacgactacacgaaaatacgcatcgccgaaaccgtcacgccatggaaagaccagcggtcgcgcggttccgtggaaatctacgtacgcaacgacatctacaagaacgtcctgcactcccctgacaccggcatcgcatggccggatggagccaaacggcggtagatgggagcatcggtgcatcacacgagcaaggtagtctgagaatatgccgtaccacaacccgaattcacgcagccggcggaatgtcctacgcatcgtgggcgtgctcgtcgtgcttgccgtcatcgccggcgtcgccaatttcctgcacgccaccaccagtgaagcggccggcaatgtcaagccgcagatcgaaaccatgcaaggcatccggcagaccgcgcaggacagcatcacgttcgcgcagggcctggatgatccggaccgattcgccgcgcacatcgaaaccgtgcagcagtgcatggacgattacgaccggcttgccgacgccaagcagatcaagtatctgctgtcggacaatctgcaggaacgcatcatcggactgttgtaccgcaaccagcagcgcaccatcatcgacagcatgcgcgtggcggcacataatctcgacggacagaccaaggagctgctcagcgcggtcgacgcggccatggcggacgatttcagccagcatgcggcgcaatggctgctgcaggtggacgatccgacgcaggcgaacgagctcatcgaccgatacggcaaacagcgcgcgtatgcatcgatgagggagatgctcgccgacctacggtcgctgcacaaactacgctcggacgtgaaacagcaggtctcgactgcggtcagcaatctgcataacgcggaagccgcagcggctgcgatcgccgtgcccgaacgcaacggtgatctcgatccggccgggtggtacacgctcgccacgaacgtggcatcgacgatgggcgtgcagatcgagcagaccatggaattcaactgcggcggccagtcaggtgagaatccgaacggattcgtggcggcctattactgccagatgcccgaccgcacgcagcgggatgtcgtgcatatcctcaccacgcatccggattggacgcagaccgcgcgaagcccttggctggtggacatggtcaagcacgagctctcgcaccgctcgatcatgatctcctgcggcaccacgcaaccgacaatcgcagccgaccgcaccgaggcggtgacgaattcctattcggtgctgtttttcggggccgatcgcaaccgcatcgccaaccagcagcagggcgtcgccgaatacgcgatggatgcgcacagcgaccagctggccacagccatccacgatggcaattgcgggtgatgtgagtcggtttccgcttggcgactattgcacatccttgaattcgatagtccagttcttcgcgtcgtcgccaagcacattgcgcacatactgctctagaatagtccgcgcgcgagcttcggcttgggcaagcaacgccgaatcggttttcgcctgcttcagcatgctttgctgggccttatcaaacatttccgttttctcttcggcggtaatcgaagtggcgaaaccagtgctcaccagcggtttgctgaacgacttctcatttacgtccggatcatccaacacgtgagctggaggcacggtaatgattactctatgaccgttggcatctggactaattgttactttatcggcatcaataccgtacttcacgatgccactgtattccatccacatacgtttgtagccattattgaagaaccacgatccctcatgactgagcttggccgtgttgtggtaataacattttaatgtggccatctgtgcgatatacgtggcattcgagaaagttgggatagcttctttcttttcctcgccgcaccctacagcagaacatgcaagcgtagcaacacataatgcggcaatcgcacgtttcatggaacgattattcgtcagcatgcgcggtctccttagtgagctttacggtctcggccttctgcaatttgtatccttttgcttccacgagatccttggtcaacgcatccacagtttgttcaagattgctggcagcaatagaaataatgtctccgtttgtcttggtctcctgttgcgcatcctgcttgcaaagcttgatcacctcatcaatttcaacggacggattgttctcgaaaaagtcgaggctgccgctatcaaccacgacgtccccaatagtcggcttcggcagaatcggagtgacggtcttcgcggtatcgtccacttcgaacgtgatatcgctcatcttgacgccagcagtcaccgtcgcctcatatgcaacatgccacttgtccttaccagcattgtctttctttacagcaacaccgccataatggaatttcgcggtcgatagatcgtcgatattcacagccgcctgcaactggctttccacactgatggtagattcggtccttgcattgtcaaaaacaggtttaacgacaccgttccacacaaacaggacaactgcaacagtgacaattgccgcaacagcaccaaacaacaccttacgcaacttttttgcactgagatcgccgaacaacctatcgcaaagaccgccccgtctccttcgactcccgtcatttctcgccaacgcacattcctttcacggttctcttccgtcaacaattctatccccgcatgcaaatacataggggcgtcacaaacgtctcaggaaataatacggggaagcccatctcgtggaatgattatcggaaataatccgatatttgatgacgtttcatcataatgaaaatgcccgccatgtcttcctgcaaggcaggacagcacacataccacttactacttccacgcctgcttaaacattcggatgggatactcaaaagagcgtggaagaggcgacctgctattcagcacacgaaatgctgcagccgaacgtacaatggtcgccccatgtcttcgtattcggcgatgccgtttttggactaaatcagccaatcggtcacgtccttctcggaaacagattccgagaaacgatgcccggtaagccatgtaccactgcctgccattttctggagcgtggatgcactgttgccgatatcggagctggcggaagtgcagaacggaatgatcgtcttacctgcgaaatcgttggatttgacggaatcgttcaccagccaaacaggtgccatccaccaaatcgggaagcccagatacacagtgctgccggcaccgaccatgtcatgggccggaatcactcgcggccggcacgttccttgacataactgacgaagcggtcgaccgcctcaggggtgtcgtggcgaaagaacatgctggtcttggtgtcaaggcccgcgatggttgtcatctcgctgtcggagagccggaaatcgaagatgttcaggttttcttccatgcgctccttgtgcgtggacttgggcagagcgacgatgtcgcgctgagtgagccaacgcaggatcacctgcgcgacggacttgccatgtacctcgccaatcttggccagggtgggattggagaacatgttctgcatgccctccccgaacggagcccatgcttcctgagccacgccccgcttgaccatgttcttgcgagcttcgatctgctggttgagcggattagtctcgacctgatcgaccatcggggcgatctcattgaaggcgaccatatcggccagacgatccggatagaagttactcacgccgatggcgcggatcacgccgtccttgtagagcttttcgagtgcacgccacgcgccgtaggtatcggaaaacggctggtgcagtaacaccagatcgagatagtcggtgccaagcttcttcaaggacacatcgacggacctcagcgtgttctcatagccgtaattgctgatccagatcttggtagtgaggaacagatccttacgatcaataccggaatccttgattccttggccgacttcggcctcgttgaagtacgactgtgcggtgtcgatatggcggtacccggtctcgatggcctcgcgcacgcagcgaggagcatcgtccttgctgatctggaagacgccgtatccgatcttcggaatctcaacaccgttggcaagtttcacgtattccactgtttttccttccataaattcgtcggtattcagtgccggcatgtatgccgttctgaccctcaagataaaatccggtagccgctaccggtcaaattacggcacgccggtactatctaccggtattaataaccggaaatgtgacatgataggtacaaacaaaaagaacaatgcgcctcaagcccgaccccatccggcggcacccgccgaacgtcctgccgcgcagcgtccgaaaggagccacgtatggcaatcacggcagtgccactccataagaacatgaaaacctatacgatgaagcaggcctgcaaactaaccggcatgaattacgaagcattgaagttctattgcaattcaggactcgtgcccggtctcaaacgagaccagaacaaccgacgcgtcttcgacgagcgatgcatcgcatggatcaacgacctgacatgtctcaaacgctgcggtctgggcatcaaggagatgcggcactacacgcaactctgtcttgaaggtgagtcatcgataccggaacgtcaggaaatccttgccgaaaaacgcgagcatctggagacgcaactggaggaactgcgtaaagccatcgcctacatcgatgaaaaacagcgcttctacgccgacgtgactgccggcaggacggcatactgcagcaacgtcatcgacacgacgcaaagcgactgactgcgttccgtaggtgatttttgcgttccgtaggcggtcagcttcgaatccggacacgagcaaacgcctaattccaggcatctcgccgatgcttatccggcagcaaccacctacggaagcccaaaatcacctacggaatcgcgcctgtcaagggacgcagatagattaagcactgttgtaaacatgcgggggtgcttgatggccaagtccatcaagctgagataggcatgaacgcctgaccctttgaacctgttggttaggaccaacgtagggagcagatcatgagcgatgactcatccgccaatgacgcactcggcgcattgcgtgccgccatcaaacaagccgtcatggacgtacgcgagcagacgccgctggcgcagtcgttcaccaatttcgtaaccatcaatctggtggccaacgcgcagcttgcggcgggcggcaccgcggccatgagctatctgccggatgatgtgatcgccaccgccgaaatcgccggatcgaactacatcaacgtgggcacgttgctgccgttcttcaaggacgcgctgccggaaatcgcgcgcaaactgcacgaaaacggcaagacgtgggtgctagacccggttgctgcgggcattggcgaaacacgcacgttcattcttgaatcgttccgtgacgcgcctccgaccattgtgcgcggcaatgcgagcgaggtcatcgcgcttgatgcgatgtgggggctggccgacgccgacagcactgatccgaccacgcgtccggctggagtggaggccgttgacgaggtcgacgcggccatcgacgcggccaaacgtgtggcccgccatttggcgaagcactcccccgtcggcaagggcgcggttgcggtgtccggcgcggttgatctggtgaccgacggcgagcgcacgttccgcctgcccggaggcagcgcgatgatgacgaagatcaccggcgccggctgttcgctcggcggcgtgaccgcaacgtatcttgccgtggccgagccgctggtcgccgcccttgccgcgtcgctgctgtatgatcgtgcgtccgaaatcgccgaagtcaaatccgatggccccggttcgttccaggtggcgctgctcgacgcgctgtggaacgtcaccgccgatcaggtggccgcgtccgacatcatcgaaaccaactgaccgcaacgttccgttgatggtttcgcaccatcgcaatcgtatatacggaatatatacgttcagtgcggtgcgacggaaaataaacggaaaataacaagacttcttctggagcacttacccaaagaacaacaaaggggaaaccaatgaataattatccattcgcctcgatgcgcgactgctttgatatgagcgcgtatttcgtggtcggtccgcaggattgcaagggccggccggtgacggatgtggtggatgacgcgttgcgtgggggcgcgacgttcatccaattgcgcgccaagaacgcggatgcgaaggatatcaccgaaatggcccgcgatatcgcgcaggtcatcaagaacagcggcaagtccgattccgtggcgtttgtgatcgacgaccgcgtggatgtggtgtggcaggcgcgcgacaagggcatcaaggtggatggcgtgcatatcggccagaccgatatggaaccgcaggaggctcgcgcgctgctcggcgaggatgccatcgtgggcctgtccgccgagaccgaaagtctggtgaagcttatcaacgagctgccgagcggctgcatcgactacatcggcgccggcccgctacatgtgtccaccaccaagccggaggcttccgtgggcggcaacgacggttccgggcacacgcttgacgaggaacagatcaacgcgatttgcgcggcgagcgagttcccggtagtggtcggcggcggcgtacatgccgacgatatggagatgctggcccgttcgaaggcggccggctggttcgtggtgtccgcgatcgccggtgccgacgatccggaagcggccacccgcgaaatggtgacgcgctggaaggcggtgcgcggcgacgcgaagcacggctatgtgccgcgtgtgaagtagtccgtcgtacaggaaatcgacaagcccgctgagatgagcgagaagttccgcaagggtggttctacactgtatcagtgagctcagtgaagataatcaatgaatcagtgagcctaataaggagagttaccatgactagcacattgccaccggtattgagcatcgcaggatcggattcgtccggcggtgccggcattcaggcggatttgaagaccatgctcgccaacggcgtgttcggcatgaccgcgatcgcggcgctgaccgcgcagaacaccaccggcgtgacgatggtcaccaacactcccccggaaatgcttgcggcgcagatcgacgcggtgttcgaagacattccgccggtggcggtgaagatcggcatggtgtccagcgccgagctcatcaccgtgatcgccgaccgtctgaccgcgcacaacgcgaagaacgtggtgctcgacccggtgatggtggccacgtccggcgcgaagctcatcgaggatgatgccatcgcggcgctgacgtccaaactgttcccgctggccaccgtgatcacgccgaacatgccggagacccaggtactgtgcgacttggccgtagagcaaggtgcgggcgcaatcgactatgagaacggcgaatccatctccaccgagaacgacatggtgaccgcaggtcatctgctcgccggccatttcggctgcgcggtgctcgtcaagggcggccacggcacgcatgacgcgagtgacgtgcttgtcgagccggatggcaagatcacctggttccgttcccgtcgcatcaacaacccgaacacgcacggcaccggctgcacgctgtcttccgccatcgccagccatttggctcttggcgaggcgctgtcgacgtccgtcgaccatgccaagctgtacctgaccggcgctttggaagcgcagctcgatcttggacatggttccggtccgatggaccacgcgtggaagtggcgttgaaccaagccacgcaaaccacgcgaaccacggcagccgttggaacagtacaacaagtaatcgcacgaaaacacacgagacaacgctgagaaaggtaatcatgacgctcgatcgcaacgcagaaaagcaggaagtgcccgtcaatccggaaaccggcaaaccgtatatcaacacgcttgcggcggtggccatctcccccgccggagccagcccggagaagtccacgtacgtggcgcaggccgtggacgtaatccgtgaatccggcctgccgaacgagacgaacgccatgttcaccaacatcgaaggagacatcgacgatgtgctcaaggtgatccgcgacgctaccatgaagctcgccggccagggataccgcaccgacgtggtgatccgtctcgacatccgccccggtttcgaaggacagatccacgccaagcaggaactggtaaacgagattctgtcgaaataacccctgacggaacagggaattccacacgtaaggcgcgtttttctgggaaaagcgcgcctttcgcttttgtttgggtatagtgttgcgattatgaccacgatgaaggaaatcgccgaacagacaggggtatccatctccactgtatccctcgtgctcaacggacgcgacgaaggcagggtgaatcccacgcttgcttcgctggtgcggaacaaggcgaccgaactcgggtacaagatcaacccgttggcgcgaagcctacgcaccaacaaaacccgaatcctcggcttcatcagcgaggaagtcgccaccacaccgtacgcgggcggcatcattctgggcgcgcaggacgcggccagcgcctacggctacatgctgttcaccgtcagcaccgacggcaaggcgagcgaggaaaacgagatcgccacactgaaaaggtacggcgtggacggattcttctattcgaagatgtcgaaccgcatcgcacatgttcccgaatcgttgaacgaataccccgtggtgatggtggacgccaccgaccacgagaacaaagtgcccagcatcgagccggacgagttcatgatcggctacgacgccacgaatcggctgatccaggccggatgcaaacgcatcgcatacgtgggttgcgcggaaaacatgatcgcgcaggacggtcgtcttgccggctaccgcaccgcgttgcaggaggccggacgtgcgttcaacccatcgctggtatgcaacgtaatgaacaacggtccagctttacgcgccgtgaacaagttgttcgacgacgagcatccggacggcttcttctgcttcaatgatgcgcgcgcctggtatgtgtacgaatgcgcggcaagaagagggcttacggtaggcaaagatatttccgtggtcggcgtggacaaccaccgcgtgttcgcagagacacttgaaccgcagctgaccaccgtcgaactgccacattacgaaatgggctattggtcagcctgcaagctgatttccatgattgaaggcaaggatgtggataccagttcatgtccatccgccagagcttccctgccgccgcttgatgcgccgattccggcgaagatccactgcgcattgttggaaaaagattccgtcatatcctgatttttctgtttttacaacgattcaaatgcttacgattgttcgcacagccattttctatacatgaaaattgtgcgtttgttcacgacacgccgaataaagcaatcgtgtcaacagtccgccagcagttgattcaggcttaatttcaactatccgcaaatccttacaaacgtttgacgaacgcgcgaaccgttggaaatccaacgttccatcggcgtgtcgaaacttgacaaatcagagcctcttgttctcccaatcgcctatttcgacgccacgcagccacgcaacacacgtgatcactggcagttgaactggtacaacgcccagcccttcgcatatgaagccatattcgaataatcctgaaccttgcgcatcgtgccatctttggcgtactggtcgatcagcttctgatcgtggaacgtgtcgtactgctgcttgaacgtgaacatctgcaggctcggcgcctggccgcccatgctcaggaagtatgcatcgccatccgcgctcagcgggcagacggtattcgtcagcgccttgccgtcgcccgacgcgaacgcattctccgtctgtccgaaaatcgcaccattcttctcggccttcgcgttgtaaatcgggaacagcatatccgcgccgtacatcgccgtcgcatacatggaaccgttcagcggatcggaaaccaccaccgaatcggtaccagtctccttcaccaccttcttgagaatcttctccttcgtggcagtgagctgctcgtccggccgcgcatcgtcaatcgtcatattcgcatagacggcatccgacagggcggaacgaacagtattgccgaattggcaggaaatggcgagcgccgcaagcagaacaatcgcaatgattttcgtgacgttcggcagacggccggcacgcaacaatacgacggcggcgaagacgatcagcggcagcacgccgaacggaatcatggtaagcggtcgggtttcggcgcgataccaggcggcggccacgatgttggggaaccagccagtcagcgcggtcgagcagacgtagacgagaccgaccaggaagaaggccagcagaatggcgatcgcgtcgcggcggagttgcgaggcgtcggaacgtggagtgcggtagctggcggaagtcttgcgattcctacgatcggcaggcatagccgcaaaatcggcaacctgttcgtgcggttgcgctgccgtgctatcggatgcacggtcaatcgcagaagcgccgggcacagtagcggaatcggcgcgattggcggcgaaccattgcgggcggatgatggctgcgccggtgacggcaaacgcgatcagcacgattgcggccatgaaccagccttgtgcgccgccgatattgtcggtgacgtagattttgagagcttcggacactgtgcggttcggaacgaaggtgtggaaccagctggcgggattgaagtagcggtccgatttgtagctggacatcatgtacacaaggaacacggcggcgccgagaaccactacgccagcaaggcctgcgatggctttccatggcagtcgcgtcagcacgaagggggccatgagcaggagccaggtgaacacgatgcgcggatgggcgaacatgcagacgccggcagtgacgaggaaccatatgatccatttgacgagatgttcgcgggtggcgagcgcgtcgagcaggcgaagcgtggtgtacagccagaacggcagaagcgtggtagccaggccgaaggcgatcagcggaccggaagccagcatttggaaggggtgcgaggcggaagcgacggcaagtggggggatgatgagcgcgagtatcgcggggaatagcggaactacgacagacgcgacattgcgggccgaggactttcgtgcgttcgcaaatcggggggagcatacggattgtgccgaatgcgacaggcgacgcgtgaaataggaagcgtacagctgaatcgcaatcggccaaaccaagccggatgtggccagccagaccgtgttgaacgcggcgtaaatcgacagattgacgccgaacaagctggcgagcttaatcatgccggctgcaagcagatggaacaacggcggatagtattcgtcgttcggccacaggtgggtggccgcgccgacgccttcgccgaggatcttgcggatgaagtaatagtgcgcgggcgcgtcgatttcgtgcaatgggttcgtccaagcggcggaaccgtgcggaaaccaggcccatacgatcgcagcggcgagcgcgacgccgatgacggaacagaccggcagtgcgatgcgggataggcggggaacggcggaatcgcaaggcaaaggcgaggtatcgttcgtcgtcttgtttgctatcttgtccgtcgttttagccgtcgtttcgtctgtcgtcttgcttgcggcgactgcgctgtcggcttcatcgactgcgtcgccggccgctgtgggaatcgtattgtctgtgctgtgctgcttcatcgccatccatcgtagccgaagccgcgaaagcaagccacaaatcgcaatcgcacctgcattttgtaatccaaaactggaccgtgcggcaacaaaagctggaaaggcatctaaaaacggatggaacatgcgcgggatgggcgcaagacggacgcggaacgcgggaagaataggcggacgtagagcggagacgagcacgagcaggaacaaaatcgccacttatccaaccttcgattttcaggaagtattcagacttcacacagaggtataacagtgttgcgcaagaaaacaatcacgttggatgggcaggatgattgcacggggcgcattgcgctgtgagcgtactcgctgtcgttgcttgactgtgtgcgtcccggccaacgctggcgtcggcatgcgtcgacgcgtaactacagagaactggagaagtaccgcatgttcgttctcaagaacgcatgggctgcgctcggtcgcgtcaaatggcgtaccgcgctgacggctttgcttgcactgctggtgtcgttctcagccgccgtggatctggcggtgctgagagccgacgacaaggcgaataacgaaacataccaatcgcagaaagcttcggcggtaattcggccgagcgcgaaagtcactgcgaaacgcgacggtgcggactccaattacaccgccaattacatgacgtgggacatgtacaccaagtacgcggaagcggtgcagaagaacaacttgacgttcgaatacacgctcgccacgtcggtgccggtgcgcgccagcaagtcgctgcaggcgatcgcggcgaaaagcgacacgagcgaggacaagaccggcggcaacctgacgttgcaagccttctacacgaacgatgcggcgaaaatcaacgactacggcacgttcaaagtggtcaagggcaagcagctgaactacaagacggccaacgacggcgtgctggtctctcaggcagtggccaagaagaacaatctcaaagtgggcgacaaggtgaccgtcggcaatccgacgaaggcttccgaaacctacaaattcaccgtgcgcggcatctacgagtacaccggcgagacgccggccggatacggttccgacgcgaaatacgcgaaagacaaccgcgagaacgtggtatacacgtcgtacatcaacttcgcgcaaagcggtctggatgtggccggcaccaagggctgggccatcccgaacctcaacatcatcttcacgctgaccgatccggccacatacaacaagttcgtgcgactggtgacaaaggccaagctggacacgtcgaagttcacaatctcatcgccgtcgcttgatgcgtacaagaagcgcatcgcaccgctggacgccgctgccaaggccgcgcgcacggcgttgttggcgaccctgatcgtcggcgggctcgcgctgctggcattggtgctgtgggccgcgatcggtggacgccgtgacgaaatcggcatggcgatggtttccggcgtcaccaagggacgtttgggatggcaattcatgctggaaacgttcatgatgaccgttccaggctgggcaatcggattgattgccggcgcgctgctggccaagccgcttggcaccgcatgggccggtggacaggctgtggccatcacatccgcatccgtgtggaacatgatctggtacggactgggcgcctgcctggttctgggcatcatcgcgttcatgcgcgtgggattcttcgatttgggtcagctgttcgcaggccgttctgacgattcgaacgaatctgccgaagcgaagaacgcagacgagccggaggaaacagtcgagtcgacggaacgtacggaggtgaacgcatgagcgagaaagacgtgaaagacaacgaaaccgaagcattgaacaacgctgccgctgaaaacgcggaaaacgcggacatcgaggcgggcgaaaccgatatggccacgtcgatcgaatcggtcgatttcgcggtggtgtatgacgatggaggcgattccatcgcaaccgaatcggcagaaaacgcggaaaatacggaaggcatcgccacggaagacagcgttgccagcgacaacgcgaatcgcgtgaacgaaacgctcgcattgggcgcgaccgacgacgaacagtcgctcgaccagcacgaaaccgtacaggcggactccgcaaccagcgtgtcatcgcagatcgaccgcgaaatcaaacatcatcgcaagaaggacgcattcttcttcaaggcgaacccgacattcgcgctcgaccatgtgacggtgcacaaccgcaaaaccggtcgcaacgtgctcgacgacgtttccctggcgttccatgccggcgcgacccacgcggtgctggtggatgccgaagatgtcgaacagcatcaggcgctggtggccaccatggtcggcatgatgcggacgaccagcggcaacgtgatgcacaaaagcacgaacctcaccgacgcgacaccggtcgacgtgcttggacaccgcatcggtttcattccgcagcggttcgccgtgcgcggcgaccttgatgcggaaggcaacgtgctgtacgccatggacgcgtcgaaccgcaatttcctgcagcccaagccggtgattgcgcgcgagctgctcaagcgcgtgggattcgaggaagtgacttccggtctgccggtgggcaagatgagtgcgttggaccagcgtcgtgtggccatcgcgcgtgcgctgagctgcgaggcggaggtgattattgccgacgagccgaccgctggattgaaccgtgacgacgccgccgtggtgctggggctgctgaagaaggccaagcgcgatgaggatcgtaagcgtgcgattattgtggtgaccgataatccggaggtcgccgatcagatggagcattgcgcggagcttgagtagcgagcggcgttctgcgaggcgaaagccttgcggactggtgttgcatgccagtccgcaaggcttttttcgtgctggttctggttcgtgccgattcgcgctggttcgcggtgacacaccgctaaaaacatgtcatgcgctacgtgtggcagattctttcatctttggaatctcaaaccgctatgtgtggcagatcgtttgacgcctcgtgagttagagggtctgttttataccccctaatgtatggcgggaaaagagaagtgccacagatagcggttttcagtgcgcaaaactcgggcggcggccaggcttcgaggaattttcgggtgtatctcgcttatgaatggcggatttttccgctcgacgcgtgctatctcgcttatagatggcggatggttttgccgcatgagacttagaggggattgaacttgccccctaacacctagtcttcctgagacacccgccattcataagcgagatagcatccggcagacaccgaaatccgccattcataagcgagataagtaggttcgctactcggcgatgcgcatgtggtactgctcggcgagcggtttgacgtcgaggacgccgtaacgttccagaaggcgcagccattcgcgcttgttgctttcgccgaaacgggcggccttgcgcgtgtaggcttcggcggtcaggaacttcggcggaatcgacttgctgttgtacttgtccgccaccatgacgacctcctgctcgaggttcatcggcacgtagtcggccgggggcaacggcaatccctgcgattccacggtttcgcgggtgaggcccacacccgtgtggttgcgtgcgaactgggcgatcgattcgtcaacgccctcgttcagcaagtattcgtagcccttgagcccgtgctgaacatagtgcggaccgtcgaatttgagcggttcgccgtcggaaccgtcctgcttgagcaggaaatacgtgccgatgtcgtgcagcaaaccgccaatgaccaccagatgctcgtcgatgagccgcggcggaacggtacctccggtcagcccttccgtggacggcaccgcaggcatgtgcaacatgccgagcgattcctcgccggtattgtctttcgtcagttccagcccgaagtcgccggttttttcgggagcgtccgtcggcagggtgcagcgtcgggtgaacagcgcgttctgccggcgggccatgcggcgggcgatgtcggccacgaccacgcaatggccgtggatgaggtcgtatgcggcttgcgattgcgcgattttgcgatgtagctcgtccacttgcgcaagagtggggatatagccggtcgtcggcttgttcgattcggttgtttcgttcgattcgttcgtcatacgcccatcttaggcacgttccatcacgcccagcatacggttcttgacgcagtttccaaaacggttcccaacagccgaagggattcatacaccacgccagataaatcccggaacggacacggattcaacggtttctccgtcttgtcaacgatgttccaaggaatgccgccttaaaacgagcatttatcagctgcccgcagcggacggcacgatacgcggggacgttatgtgcggaaaatcagatggaacggacgcggaattcgccggtgcggttggaagccacgatcatctggtcgttttcgagacgggtccagccgtcttcggcacgctggtcgaagccggagctggccacgaccacgcccttcggctgggcatcgtcgtttccaccgagcgcacggtagcgcagcacgcggtagtcgcgcgcctgctcgccacgaccgtactggtcgtagatttcgacgatgcgcttggaagtgacctcacggccggccgcgcacagggcgatgaactggtcctggctttggatcatgcagttgtagctggacttcggatagcttttgcgcagttcgcgcacggcctgcgccaccgcctcgtcgagtgcgaagccaaagccgatgtattgcaggatgacggcgaagaaaatggcggaatcggaacggccgccagtggactgcacgatgctcggatcgaccgggaacgcgcgattcgtaatgatgttgcggccctggtcgtcagaaatgtcgccattgtggatgaagctcaggccgttcgcatagaagggctgctggttctcaagaatcagcggcaggttggagctggccaggcgcagatgccacaggccgccgcgcgccggagtgttggcgagctcgtcgaaaatcggatcatgacgggcggcgatggtgtttttgtagatcgcggtgccggtttccggagtcggcgcaccgccgtcgcgacggtatggcgattcgtctggcacggtgatcagcgcggcgccccagccgtcgttgtggatctcgctcagatttcggaaatcgcgcacgttctgcatgccgagcacgccattgaggttggtgttgctgcctgccgtcgcgaatccaagtaatctgcacatggttgattactttagcgacggcaggtttcgacgcgcgcgtgccgttatcggagttggttatagcctgcgattcagccgccgattcatacgcatcgcacgtcgcaaaacgcacgtcacgaacgtaagttgtcccgcaaacgagcaggaggaccgacatatcctgttgcagaccgtaaaaactcggcctaagcggcccggagcgtgtcggtaataggatatgccggtcctcctgcggaccatacgcttatagcaaaaagcccggaatgttctgttcgcgaccgtaagcttggccgaacggccttgagtgtgtcgcgaacagaacattccgggcttttcaggacaaattcacacgcgcttcagacgcggcggacgctcggtggcgaggaacagcggctgaatctcaatcagcggattgtagggagcgagtccgaaccatttgaccggagagccggccaaatgacgaatcgcgtacttgatctgcagtgagatcgcgcccttctgggacaccttcgactcgggcatcaacgccttgtgaatcagcacgtagcggataggtccgatgttcggatcggcatccagcttcgggtagcgggtggtctgcttgggcagatcgccggacttcgacagatcgttcatgatctggtggatgtatgcaggaatcgactgcgacaccttgaagcccaagcgaatacgcacgcggaacaggaagtccgtgccgaaattctccaccgaatactcgcgcgtgaacgggttgtcggatgtttccaccgacaccgcccaccatgcgcgggcgcgcttcggatggtccgcgaaaatcgagaagaagatgtcggtatcgacacgcttcatttccggatcggacgtcagatagacgatgttgtccgtgaaatacggaatcgaatcgtcctcatgaagctgcttcagaaccggcacgcaatcggcgggctgcatatgccggcgttgcgcgcgttccagcttcgtgccttcgttccacgtgtacataatcagcagaatcgccaatgtcagcagcatggtgaaccagccaccgtgcaggaacttcgccatcgaagcgaagaagaacaggaactggatggccaggaacaccactgtgaacacgaccgcgccgacgcgcttgccatcgtgccaaatgtagacggccagcagaatcgtcgtggtgatcatcgtgacggtcaatgccaggccgtacgcggcggaaatatgctccgaatcgcggaacatcgccaaaaccagcagggtggagacgcacagcacggcgttgaccaccggaatgtacagctggccgcgggtacgagccggatagcgcacctgcaggtggggcatccagttgagtcgcgtcgcttcggaaaccatggtgtaggcgccggtgatcaacgcctgcgaagcgatcacgccggcgcacacggacagcagcaccgccacgtagcgtacggacggggtcatcatttcgaagaacggattgaggccgtgcatgtggttgtacgcggtgtcgtcccaatggttgagcatccacgcgccctggccgaaatagcagagcacaagggcgatcttgatgaacggccacgtgaagtagatgttgccgcggccgacgtggcccatgtcggaatacagcgcttcggcgccggtggtggacaggaacacggtgcccatgacggcgaggcctgccgcattgtggtggctgaagaggaactccacgccgtacaccggattcagcgcttcaagcacgctccaatcggagctcaggttcaccaagccgacgacggcgaggaacgagaaccagatcatgaccactgtgccgaacgtgcggccgatgcgttcggtaccgcgcgactgcactgcgaacaggcagacgatgatcacaatggtgatcatcagcgtcagttctttgttttcgctcatgatcggttccagcagcggcagtgtttccaagccttccactgccgagctgatcgagacggccggcgtaagcacggaatcggcgaggaacgcggcgccgcccagcatggcgggaatcgcaagccatgccccatatttgcggatcagcgaatacaacgcgaagatgccgccttcgccgttgttgtcgatgcgcatggcgatgaacacgtatttgacggtggtgatcagcgtgatcgaccagaagaccagcgacaggatgcccagcaccgcggcgcgatccgtatgcgccaaaccgccttggccgttgaggaacgtctgcatggtgtacagcggcgaggtaccgatgtcgccgtataccacgccaagcgccacgatggccatggccggcgtgattttgtccgggccggactggagacggctccaccagcggccgatgcggcccttgctggcggcctcgtcaagtttcgcggcttcctgctgctgcgcctcgtgctccttgatgagcgtctggcgctcctccttggtcaggaccttgtgcgagacctttggcgcctgcgtgtacgtcgctgcgtgaagcagcggctgttcttcttcgttcggctcgttagccataacgcttcctccaagtggcgggccttccaacccgctccccaaaataaaacgcaaggtgtgacactaggagcttggcaaaccattgtcaaatcttcacacgtgattcggcacgtcacgcatgaaattcacatatgcttgattgtttgtattttgcttattttctggcgattacgcaactgttacgttgaggcccatgcgaccgtcacggaaccgccacgggattaccgcgaaatcgccattctttttagatgccgtacacttcgcgcgtcgtttcacgcgtggctttggcgatttcagccaacggtctgtcaagatagtcggcgagcgcctgcagggtgtacgggatcatatacggcgcgttggtgcggccgcggtagggcatcggacttaagtagggggcatcggtttcgaccatgacgtggctcatgccgacgagtttcgccgattcgcggattccgtcgttgcctttgtagctggatgtgccggaaaggctgagataccaaccgttttcgcgggcgatttcgcccatttcggcgtcgccggagtagctgtggaacacggtacgttcgggggctccgtcggcgagcaacgtttcgatgacttccttgtgcgagtcgcggtcatggatttgcatgggcaggttgagttccttggcaagggcaatatgcgcgcggaacgcctcgcgttgcagttccttggcgccttcgccggtgcggaacaggtccatgccggtttcgccgatggcgacgacctggttggggtaggtggtggcgaggcggtgcacttcggccatggcttcgtcgaaggggatgtcgtgccagggcttgtatttgatgggcaggccgtcggggccgggtgcgccgcggtggccgtgcagcacggcttcgttggggtgtatggcgattgcggcgtgcacggttccgggatgctcgcgggccatgtcgatggcggtcatgaggttgggcagctcgcaaccgcagtcgattacgccttcgacgccgactttctgggcttgttccagcagttcgtcgacgctgtagacgggtacttcgccttggcctttttccatggcttcgtgactcatggcttgggagaagggcacgacggatgcgacgtgggtgtggttgtcgatgacgtgcgcgtcttcgggcagcggctgcggggccggggcccaattgcgattgcggtggtgcttgctcatgttttccagattagtcccgattggccctgcactgcgggcgaactctcgttcgagggttcaaacgagggtccgcccgtttcgcggcatacacgtcacttaatcgtgatggtggtgaacgaccatgccggtgccgtgtagtcgccgtctgtcagatcaatcgcggtctgccgcggcctggtcggtgattcctcaccgacctgtcccgcatacggattgtctccggctaggacggtggccgtggcggatgccgccgatgctgtggaaatattcaactcggcaagaatctgacgtaggtcgacgcttattggcgcgtccatggcattgaccacgcgcacgtaggtctctccggctttgtcattacgtgatacggtgacggtacgccttggctcgtccttgacctccgtgccatccgcaatcagcgttccatcgatgtacagcttcatggcttggccgcggtcggtgatgtcggcgtgcacctgccacgtggtgcccggccgcacttcgttcatggagacttcggtgccggcaagcgcataggcggtgccgtcgcggacgacgcgcacgctgtgcccacgaccgagcgaaacgatgttgtggtttttgccgtcgatgtcgccacagatgaggtccatgccccatcgtccctcgtaatagacgacggtagtgtcgatactgtaggaatcagcgtgcagatcgagggcggtgtcgatggttctgccatcgtaggccacgttgccgagattaatcgtctccccggatgcggtggtgatgacaagattgttgaggtcggctttggcgttgcccgcgatgcgtagtctcacggcgtccggcagggtgcgacgcagcgtggacgggccttcgacggtgacgggccacgcagtgtcggccgtggtggtggcgtacatctgctgcacccaatagctgtagggatggtaggcgcgttcgttgtcgaagtagatgaggtccggattccagctatggtgcccattcttggcgaacagcggggcgtaggaggccatggccaccacatcgccgttgagttccatgcgtcccatgaaggccgcttcggacaggccgttgatcagttgggtgttccaggaaccgtattcgccgaggtagaccttcggtcccttgcggtccgtgtggtcgtagtggtcgaggttgtggaaccaccagctggacgactggtaggaatgttcgtcgacgattggcagacccgcttcgcgcgcgtacttccagccttcctcataatcctgaccgctaggagcgggaccgacggtgccgacgacgacgatgtccggatatgcggctttgacggcgtcgaaaatctgctggaagcggttcttgaacacgtcgtcgataagatcctcgttgccgatgccgaggtattcgaggccgaacggctccggatggcccatggcggcacgcttggcaccccattcggtggcggtgctgccgttgcagaattcgatgaggtggagcacttcatcgatgtaagcgggcatatcctcctgcgccaccggcaccgggccttggctggtgttttggcagctcacgccggcgggcagcaccggcagcggcttggcgccgattgtttcgcacaggcacaggtattcgtagtagccgatgcggaatgactggtggtagccccagaggttgaagttgtgcggacgatgctcgaccggtccaatggtgcggtcccagtggtacatgttgtccatgccgaggccgtgggtgatgcagccgccggggaatcgcatgaatcgtggtttgaggtcggcgagcgcctccaccaaatccgggcggaagtgcttgaggccgcggtagatggtgcgtggctccaaggtgacgaagtcgaggtcgatgacgccttcgccgtcgaaggtcaggcgcaatgtgccctgtgtggccacgctcgagccggcatcgccgtgctcaggaacggtcagcgaggcttggtatgtcgtccatgccgaggctgagacggtgatggtgttttcggcgatgatgctgccgtcgtctccgcgcagcgagaccgtcaccggcatcgcgctttccgatcgcacgcgcatccaggcggtgaaatcgtaggtttctccggcgcggaacaccatgccgtcccagccggtgttgtccagcgcggcaggggcgtgttcgacttccaccgtcgcgtaatgcgggttttcggtggcgaccgggtcgttgtcatggatgcagaacgcggcgaacgagccttccggcacgattttgcgccagaagctgtagttgctccaatcgatggagtcggcgcggttgtattcgaaggcgccgttctgcacgaggtcggcgttgaggccgccgtcgccggagtagctaatgtcttcgaagaagatgccccacaggtcggtgctgatggcgcgcacgcccgctttgtcgagtgtggcggtgagtttgtcggtcatggtgtggccgtcagccggatattcgtcagccggggcgacggaaacggtggttgggatcgtcatcgaacctctcttttcgttcgggatcgctatgggggctgtgtcgcggaaagcaggacgccgtcatgcgaaccgtatatgtatcgttacatatactagcgcaaatccaatcatccgcaatggaggcaatatatcggtgagtctttgtatttgcaacgattttacagaatcaagagaatataatatcgttacatatcaatcataagttttcaaggagcggcatatgaccagcagcacaccgacgctacgcgacgtggccgcggaagcgggcgtctcccccatgaccgcgtcgaacgcgctgcgcggcaagccaggcgtcaaggaatcgacccgcgccaaagtgatcgccgcagcgaagaaactcaattaccgcatcaatctgacggccagcatgctcaaatcgggccgcagcaacatcatccacattatcgtcaacgaattcgattcgccgttctattcgaagctcacacaagcgttgagcaacgagatcgtgtcccgcgggcttattccattcattgagcagacgcagtattcgccggacgctgccgagcacgcgctgagcagcaatccgttctccggacagctgttcgatggcgagatcctgcacgccacgggcctgggcacgaacgtgccgctggccaaactcaatggcggcagaccattcgtgctgctggacgcttgcgaggagacgccgaccgtcgatgccgtgaacttccccaacgaggaggccgaacgcgcggcgatgcagcatctcatcgaccgcggatgccgcaatatcgcgatcgtcggccaccggttcgccccccgcgccgatctggcgcatgcccagaacgcgttcgctctgcgattgcgcggcgcatgcggagcgctgtccgacgccggactgccctatgacgagtcgatggtgttcgaagccggggatgtggccaatggcatcatcaccgggcatgcgattgcggaacgtattctcgccgcacggagcggacatggtggcaccgagttcgacggcgcgtgctgcgccaacgatttcgcggcgttcggcgtgatacgcgggctcgcggaccgcggactgcgcgtgccgcaggacgtgaaggtgatcggtttcgacggcgtgacctccgggtcgtacacgacgccggcgttgagcaccatccaggtcgatttcatgcagctcgcgaaattctcggtcgatatgctgtccgaacgtatcgatcatggaacagacgaggcgttaccgccaagacgggccatcatcggctaccagctggtggaccgggaatcgaccgcggtctgaggatgacgccccgatggcaggcaatccgccataggcagcagccttcgcggccaatcccactcaatcggaatcactcaatcggaatcaatcgccatcattcatcaaggaatctctaggagcatcatgagcatcgatacccaggcctatctgttcgtgcatttcatcggcgaggagcgcaatcccaccgacgagcagctgtatttcgcgctgagccgcgacggcgtgcattggagggacctgcgcccggccggcagtccggcgttgacgtggctaggcggcgagaagggcgtgcgcgacccgcatattgtgcgcgacccacgtggtggattccacattgtggccaccgatttgagcatctattaccgtggcggctgggggccgaacgatggcgccaccacgaatggatcgaccggcctggtgatctgggactcccctgacctggtccattggagcgagccgcgcctggtggacgtggcctcgaagattccggacgctggcatggcttgggctccggaggcgaattgggatccggatcgcgggcagtggatcgtgttctggtccacgaagagcaacgccgaaagctccgcggatccgttggccaacgagctcggcgatccgacgaatgtgtattatgcgacgaccgttgatttcagggtgttctccgatccggtcaagtggatcgatcgtaagaatgtgatcatcgattcgaccatgctgcgcgacgatgacggctggtggtaccgcgcgtccaaggactcggaaatcaccatcgaacgcacccgtaacccgtatgcgacgacctacgaggtgctgcgcaccgacgacccgaatgagtggtcgtatgtgggcacgctcaccgacatcttcggcaatggccggtattccatgcactacttggaagggccggaactgttccgttacaacgacgaggacgtgaaggtggtcaacggcaggaccatgccattcggcctgatgtgcgaccagtacgcggagtccaagggctacctgtcgttccgcgccgcctcgctcgcctcgcatgatccggccgattggcagcgcgcagacgatatcgatttcggcgcgctgaagaagcgtcacggcgcgattctgccgatcacggccgccgaatacgacgccatcgaaaccgccttcgccctgtaggcggcgcgattgcccatccgtcgcaaccgctcaggcgcggcggatggcgaagatgcgggcggacggctgcttggaggtggccgcgttgagccggaccgtctcggggtccatgcgctcgacggtccacggcttggcgtcgggcgcatgctcgggaacggccggattcgggaagatctgctcgatatggcagtcctcggacagcggcacgttcacggaaggcgtgccgccacgtcgccagacgatgatgtaatcgcacggatcgtcgtcctccgacgggaggaatgacggatggcgcagaccgacgacgagccaatcgccatcgaaatcaggcagacgggccggccagaacggcaccaattcctgctgctcggtcagcacacggcggtgcaaggccaccgcatcccgcaccaaggcaagccgatgctcgtccatgcggtcaatgaatccggacaggtacaacctgccgagtatgcccgtggccagcgtgaagacggcggtctcatcgtccatctcctgctgggcgtaaccccagttgccttgctgttccggcaggatcgtcagtccggcgccggcggcgatcgcggcgtaaatcagcggatcacactggtcggaggtggattgcaggtccaatcgttgcaactgcgcgtaatcggcgcgcatcgcaccggaaccgcagttttcgatcataacgtccggatggcggcggcgcaggtcgtccagccaatccaaataggcacggcagtggccgagcaggccagcgccggcggattcggcgtcgagatcagtgccgacgccggggacggtgttgtagtcgaatttgaagaagaccgcgccgaaatcgtcaatcagccggtcgacggtgcgagtgacgtgctcgcgtgcggcgggcgagcggaagtcaagcaggtaccggcccgaatcgcagacgcgcacaccgtggcgctggaagaacgcgtcatcgggcagactttgggcgagcggcgatttcacaccgatcacctcaggctcgagccacaatcccaagcccatgccatgcgcgcggatggtgtcggccaaacccttgagtccagcttcgccgaaacggttcgtggaggcctgccattctccgaccatgtcccaccaaccgccgtccgtgctgtcgtaccagccggcgtcgatgcagaagatgtccgcgccgacgcgtgccgcgccctcgacgagcggcagctccttctccaagcgcgggtcgccgaacagggtgttcatgtaatcgttgtagatgacgagtccctgcgtgcgttcgaactgctcggaacgacccaattcgcgagccttggcggcacgcaacgcacggcgctgcaatgtcatttcggcgacggactgctgccaatcgccggccgagatcgcgaaggagaccggcaccgattcgaaatcgtggccttcacccagctccgtataccaatggtggtcctgatattccggtccgaacgcgctgatgtgcaaaccgggatcatcctcgccgatctcccattcccatgggccgttgtgctcgatctgccacattacggagaagtcgcgcgattggcggcgcgagccctcgacctgtacgatgccggccggctcatgcacgccggtgctccatgtggaggcggagctcatggcgaatcgcgagctggattggccgggattgatgacttgattgcgattgcgcaccgatacgtcgcgcagtggacggctgcgccaatcgttttccaccgcccacgcggagtctccccagaatacgcgggaatggtcgattttgccgcagttgacgcgcatcggcaccgtcagattcaacgacgacaccgcctcgataggcagcgggcgcgcggagctcaaccgcgtgtaggtgcgcactgcggacagacccgggaacgcttcgaatacggaagtgactaccagcccagccgtggcgtcggcatggcggacggtttccggcgagggctgcgcggcggcttcggcccgttcgtcggcggtcggttcgaacgcgcgcccgtgcggctccagttccgcatacgaagcgaattggacgatctccaaacgatatggttcggcggacccttcctccggctcggaagcggcggccgagacgaatcgcaatacgctgcccgccaccgtggcgatcaaggtgaggcgattgtcctgcgatccggtgttggcggcacgcacttcgacgattggacgcggatcacgttccagcacggttcttccatcgtcggcaacacggccgccgatgggacccatgccgcggcctgcaacgttgcacaatcggacgggggaatcgcctgccgtgtcgaacagcatggaaaccacgccattgccccattcgagacgcccgtcctcacggggacatacggggttcattgcaccggcaccgcttatcatcttcgactcctcaaccgtgttcagataccgcctgatcattgacgtgcatcgattgacgtacctggtactagcttaagcggtaaatggggcaaatcgcacgtgcgtgtctactcgaagcggagatatgcgatgaacttgactggcgcatccttggttttggtgatgttgccgaaaccaaggacagcccctttgtcgggcagtcccttcgtcactcgtcatgctcacccgcgtaggaacaccgtcatctcgttctcgccacggttggcccatgcgaagtatggaatcagcgtggccgtcgtcgtcttgcgttcggcgggacgccaatcatggtacaacgcggaggtttgcgcggagtcttccacttcacgccaagcgggaatcgtcagcgtggtcatcggcatatcgacggcgtccacctcgccgagcccctgctcgtcctgtgcggcggcgccggcatggaagacgatgctatcaacagacacgcaggatggatcggatgcgatgcgcgcggtatcggcgtgcagcagatgcaggttcgcgccattatcgacaccttccgcgcagtaggccagcggtccgcgcacgaacgccacctttccggcgtcctcgcgcacgagcggattcgcggcgaccatgtggaccggcatcgggaaatcgaaatcgacgacgtcgccgtcatgccatgcgccggtcagatacaggtatccgtctctgatgacgcgggagatgtcgtcgcggccgcgcacggtgaccgcatcggaagcggtttcgccaccggcccaggcgggcagacggaaggcgatcgtgaaaaccgcgtccttggatgcatcggaagcagaatcgcctgcatcaaagcccaccgcgacggatcccttgccggaccagggcatatcggacatgacgtcaaggcgcacatcggtgccggaaagcctggcatggacgccgccgcccatatacagatgcacatacagggtggatgagtcgtctccgatcgtgtaggcgtactgctgcacgtcctccacgatgcgtgcgatgttcggcgggcagcaggcgcatccgaaccacttctggcgcaccggcttgacgcgcgccttgcgttcatcgcgatggcatgcctcgggcaccacttcgagcgggttcacgtagaagaagcttttgccatcgagtgccatgccggcgagcgtggtgttgtacagcgccgattccatgacgtccgcatattcggatttcggctggatttccagcatgcggcgggcgaagaacgcgagcgcgatggcggcgcagctttccgaataggcggtgtcgttcggcagatcatagtcgaaggagaaggcctcccccatgtgtgtggcgccgataccgccggtgatgtagatctttcggtcgacgatgttgcgccatagtcgttcgcaggatgccagcaggtcggagtcgccggtcaggcgtgccacgtcggcggctccggcgtagaagtaggcggcgcggacggcgtggccgagggcttccgtttgttccgtgattggcttatcggcctggtagtaggcgtagttctgttcgcgcggctcgtagtcgcggccgccctcatgggcacggcggcgatcttcgagctcgaagtagagcggctgctggccgcgttggcgcacgaagtattcggcgaggtcggcgtagcgctgttcgccggtggtctcggcgagtttgacgagtgccatttcggcgatttcgtgcccgggatagccgtgcagcttgccgtcggcggtgccgaatcggaaatcgatgtaatcagcgaaacggcaggccgcgtcgagcagcttgcgtttgccggtggcttgatagtaggcaatcgcgccttcggtcaggtggccgaagcagtacagctcatggtggtccttcaggttggtgaagtgccggtccatgccgttgaggatgtagtaggtgtccaggtagccgttgccgagctgcgccgcgcagacgatatcgatggcggtgtcggcggtcgcttcaaggtcagcgtccgggtggtgggtcagcgagtagccgaccgcttcgatccatttggagaaatcagtgtcttggaacacgaagccgtagaacttgtcgggatcggggtgcgccgggtcgtccggcagggcttcgaagccgcggaacgtgtatttcggcggcacgaaggccttgccttccttgtggtgttctgcgttctgcgcggcggcggccttgaagttgtgcatgcagtagctgggtgcggcgccgggaacgttgtcgttcagcgcgttccactggtagggaatcacctgggtgcgcacgagttcctgccgcgatgcccagaacggatcggtgacggtggcgtcgcgcaatgcgattggatggctggtgcgattggtggtagtcatgagtgcaagcgctccttagtgcatcgttgtcttgttaacgctcacaatccattattccacgggttgctccaaagcacattccgcatggcggcatgtccgacgggaatcccaccgcggcagccggcccaagatggccgcgcattggctgcgcgaccgttggacaggcatttcggattgcggatatacgggctaaggggcagagcagctagccgccggggctggcggtcggctgctcagaccttgatcatggcgtactgcgattcgtagagccggtagtaggcgccatggcgggcgagcagctcggcatggttgccctgctccacgatctgcccgtggtcgatgtagcagatctcatccgcattctcgatcgtggacaggcggtgcgcgatgatgaagctcgtgcgtcccttgagcagatggttcagaccggcctgcagcgcctcctcggtacgcgtgtcgatattcgacgtggcctcgtcgaggatcaggatgcgcgggtcggcgagcagcacgcgcgcgaacgcgatgagctggcgttggcccgcggacagggtcgagccgcgctcctccaccacggtgtcgtagccgtctggcagttccatgatgaattcgtgcgcatgcaccgctttggccgcggccacgatctcctcgtcggtggcgtccagtttgccgtagcggatgttctcacgcacgttgccggagaagatgaacgtgtcctgcagcatgacgcccatctgccggcgcaggctttccaacgtgacggaacgcacgtcgtggccgtcgatcgtcaccgagccttcggcgacgtcgtagaaacgcgacagcaggttgatgatcgtggttttgccggcgcccgtaggaccgaccagcgcaatcgtcttgcctggctcgacgtgcaggtcgaccaggttcaggatgttgcggccgtccggctcgtagcggaagacgacgtcgttgaagtcgacgcggccctcgatctgcggcagatcgacggcgtccggcgcgttgcggatctccggctgcacatccagcgtctcgaagatgcgttcaagatacgcggagcaggtgatgagctggttgtagaagttgccgatgctgattaccgggttccagaagttgttcgcgtagccgacgaacgcgatcagcacacccgtggtcacgtccacaccgccgaaaccggtgacgcccacataatagatgaacgcgatcgtcatgacggaaatcgtctggatgcccggccacataagcgtctggatatgcaccgtacgcatccacgcggaacgcacagcgccctgctgttcctggaatgtgcggaactgcgtgtcctcgcgcgcgaacgtctgggtggtcttcacaccggcgatcgattcgtggatgaacgcgttgagattgctctgcttattggatagcacctggtacgcgcgacgctggaaatgctgtaatcccagcacccacgcgatgagcagcgggaacaacgcgagactgtacagcgcgagacgccaatccacgacgaacatgaccactagcgtgatgaagaacgtgaacacgtcggaaatcacgttgaccagaccggagctcagggtgtccgaaagcgtgttcacatagttgaccacgcggatgaggattttgccatgcggacgcgagtcgaaatagctgaacggcaacgtctgaatgtgcgtaaacaggtcgcggcgcatgtctttaagcatgagctggccgacgcgcgtgatttccacagtacggtagcgcaaaccgaattcgtaaatgacgatgagcaccgccagcagtgccaccagctcgccaagcagcgcaaggtttttcgccggaatgacactgtcgatcatgattttcgtcagatacggttccacgacgttgatgcagcccattgccgccacgacgatgaggatccagaccacgcgggccatgtacggtttcaggtagacgccgacgcgcgcgaggtcgcgcatattgatcttctcttcaaggtcttcatcgtcacggaaggtgttgcgttgtgccatgatgttatcctcccccgcgtcttacgcttcgaatccctgcgagcggccggcatccacgcccaactgcttgctgtaaatctgccaatatcggccgtgcgaggccaccaattcgtcgtgcgtgccacgttccacaatgcgcccatgctccagcacgagaatcaagtcggaatccttgaccgacgaaatgcggtgggcgattgtgacaatcgtcttcttctcgtccaaatcgcgcaagtgccgctgaatctctgcttccgtttccatatcgacggcgctggtcgtatcgtccataatcagaatcgacggattgtcggcgagagcacgcgccaagctcagtcgctgcttctgtccgccggacaggccgacgccgcgttcgccgacgacggtatcgtagccgtccggcatgctgctgatgaagccatccgcgccggcaatggcggccatgcggcgcacgtactgttcgtcgtaaccacgtcgtctgcgctggccgtcgtactgaccgttgtactcaagtcggttgcctcggtcgcccgcgccaaagctgatgttgctgccgatcgtatcggaaaacaggaacgtatcctgcgcgacgatgcagacttgcgatcgcaacgtggcgagcggccagtcgcgcgcgtcgatgccgtcgatgagcacacgaccggcggttgggtcgtagaaacgggagataaggttgacgagagtcgatttgccggagccggtttcgccgaggattccgagtttcgcgcctgcgggaacgtggaagtcgatgtcgctgagcacaggcgtccccagatcgtcggggaaggcgaagtcgacgtgctggaagtcgatggttcctgcgattctagccgatttatcggcggcttgcgccccttgcgtaccttgcgtaccgactcgcgtagtgctttgcgtggctttccccgcaaactccggcttttcgcgaatacgcgattcggcggtgagcagcttacggatttttatgcatgccgcgttgaaacgttgccagtcgttggtaagccatccggattggcggattgggctgtcaagcatccacaggtatgagttgaacgccacaaggttgccaagagtcatgtaccctttgatgacgagaaagccgccgaaaccgagtgtgataagttgcagcgaaaagccgagaccgtcaagccagggcatgtatttgcggctgttgtatgcctgggccatgttgcgttgcatatagtcgtcgttgcgttcgtcaaatttttcggtttcgtacgattcgcgcacaaacgctttgacgacgcggttgccttcgatgttttcctcgaccatcgaattcatttcggcgagcgagtttcggatatcgaagaacaggggtcgtgcatgcttcgacagaccgcgtgtcaaaatgaacagtggtggcgtgacgcaagcgagcgcaagagcaagtcgccaatcaatcgaaaacatcatggcgagcgcgccgatgaacatgaccacgcagtcaagcgcttgcaggctcacccagctcagtgcgtggcggatggcgtcggtgtcggacgtcatgcggctcatgacgtcgccagtgcgagtgtggttgaagtaggtgaagtcaagttcgtggagtttttcgaattcgtcgctgacgagacgatagatggagttctgtccgaagcgttccatccacatttggcagccgtaacgggagccgacacgcaccacggtgagcacgagcatcatgacgcacagtcgggtcagttcgctcacgtggccttgcgtaatgacacggtccacaataagccctgacagcagcgggatgatgagggccatcgtgttgttcaggcagaacagtacgaccgcgccggccacgcgcggcaggtcgggtttgcagtacggcaggatccatgcaaggttgcccgcctgctggttgcgtttcggatcgacatacatacgtagcgttccttcgaattgtttgcttgggtcttggttgggttgttgttgggttgtggtgttgcggccattcgttgccgccacgattcacgtccgtcgtgtgtcgagcgtcccgtcaccggcatgccgccgccggccgaaacccctgttcggattcgcaaactcgacttattttaaacgaaccgtacgccgatgcaacagatgcgttttcggcgtgtcgcaatcataataaaatcaacatatatatcgttacataccactggtttgcgggtgctgcgaaaaccgtcatcggagcctggctcgccggaatcggagcatcgcatcggaacatcgcacgataatggaatcaagctcgaactatcgatacaagcatcggcgacgcacgtcgaggaaaggacggcaaggatgacggacttggagcacatccgcgcgaagttcgctgcggaatatggcctgtcggaggacatgctcaggaacgcggaacgttggacggagaccacgggcgacctcgaaggggttcccgagaacctgctgccgggcattctgggaatgcgatttggcgcgatcgccatcgatacgccgcgttccgaacgctggagcacgccggaagacatcgatgtaatcgccgacctcgcctacctgccggatggcgggtacgatacggccgcgggagcgtgccgcggccatttgctcgacctgtatctgccgcatgacgcggtattgcgcggtgggcacaccctgccggtgtacatcgatatccatggcggcggattcacttacggatacaaggagctgaaccggaatttcaacgtgcatctcgcggaacagggcttcgcggtgttttcattgaactatcgtccggcgccgcagaccgacttgcgtgggcaattggccgatatccaggcggcattgcgttggatcgcagcccatatggccgattatccggtcaatccgaacgcggtgttcctcaccggcgattccgcaggtggcgcgttgacgctactgaccttggccattgaaaacaatgcggaagccgcggctgcgtttggcgtcaacaagccgtccggcatccgattcgcgggtgccgctccggtgtgcggcgcgtacagttcggcgtcgttggagaccatgggccgcaagctgacggtcgggtatgacccgaaccgccgtatcggtcttgagcagatgttgggcgtcgatttctttgcggggctcgaagccgccgatccgaagttcctcaccgctgagggtctggcgttcaacgtcgatctgccacccttgctcatcatcacctgcggcgacgatttccttgaagccgacaatctggcgttggccgccgccttgtcgcgcaaaggcgccgattttgaattgttcgacccgaagccgcgccgccatgagacgttggggcatgtgttcgtcatcggcatgccatggcttgaggaaagccgggaatgccttgatcgaatccgccgcttctcatacgaacgctgttgaataacgtgaatggggtgaacactccttcggagtgcccgccccattcaatggccgtcgatgccgcgacgccgtatcagcggcggaccatttcctcttcgatctgttcgagcgacttgcccttggtctcaggcacgaaacgcagcacgaacgggatggacagcgcggagaacacgccaaagatggtgaacgggccgccgacgttgttgccgaacatggccagcagcatgaggaagaactgggagaccacgaaattgcccagccagttggcagcggaaccgaaggagctgccgatgccgcgcacgctcaacgggaagatctcgccgatgagcacccatgcgatcggaccccatgacagcgcgaagccgaggatatagcaggcgatcagcaccatggtcggcacggccagcgtggccacatcgccggtgaagttaagcacggccagcaccgcgagggcgatggtcatcgtcaccgatccgaagatcagcagcttcttgcgggggaatttgtccatgataagcgtggccgcgatagtggccacgaagttgaccacgccaatgccgaccgacacccagatggcatggttttcggggaatccgaagcctttgatgaacacctgcggcaggaaatagatcacggagttgatgccgacgagctgctggaacagcatgatgccgatcgcggcgacgagcgcaggacgggcgatacggaacagctcgcggacaccgcccttggtgttctgcgcggcgacggccttgatctcgtcgagctcgagctgcacctgcgtctgatcgacgtccttgcgaataagggtaagtactttgaacgcctcacgatccttgcctcgactcaccagatatcgcggcgattccggcagcagcaggccgccgatcagcagcagggccgccggcacgagcgccgaccccagcatccaccgccaatcgcggatgccggcgatattgtggccgaggaagccgagattggacgcgtatgccagcaggatgccgaaagtgatcatcagctggaatagcgtggacagcgatccacgacgttccttcggcgcaagctcggcaagatatgccggagtcagcgaggaagccgcgccgacggcgagaccgaggatgatgcgggccacgaccatcatcaggaatcccgtggatcccgcgcacatgcccgaaccgagcaggaacagtatcgccgccagaatcagcagcttcttgcggccgaaacgatcggacagcgcgccgatggacagggctcccgcgcaggaaccaatcaacacggatgatgtgatgaacccggtctgagccacggacaggccgaaatcggattcgatgagcggcgaggctccggagatgatgccggtgtcgaagccgaacagcatgcctcccagcgcgccgaacgtgaagatgaacgcgctgttgagcgggaaacgtgtggaaacgccacgccccacctcccgctcgacggcgtcgatcgtcgcgccgacctcatggatgccggcttccaccgcaccttcggcgtcgtgtactggattggacgtctgcaccgcagtcatgattccaccttccattcccatcgatcctcatcgatatgagatgcagcaatcgcagcaaacaaaaaagacctggaacgacgtatagtgacgtcgttccaggtcttgcctcgcattgagtagcaaccctgccgcgcttgtatgctgcgtatattgcattcaagtgtaggtcatggcgacatgcgacactccgattttttagaaaacgtttaccggttatttttcagtgcaggaaagcgtgaagcacaggccagcggcacatgcttttccctcgtgcggagagcctcctcggatatccacgagcaagcggaccgaatcaagccgtcaaaccatccacaagcaagccggcaaaaagaaagccggcggagagaaggccgccggctgagagagaagagagaagaagggttcagttatgggattcttgaaagaacctcgccaacagccgtaaccgttgacatgttctatataaccgcccgacccttggaggaacgatgtgtgttcctgtcaattccctgagaatttcgtagcggaaatgtcacgacggtgcgaattcgggggtttatcctactgaatatcgccccaacggccttcctgcagcttgttcagcgcggcaacagacgattgcacggcatctgccgacaccgtcatgaaacgccgctatacaacaccgccgctcaacgacgccgtgcactcacacgcaatcgcgcatctcactcagcgaatttgtcgacgcggcgatcgtaggtcagcaggccgttgagctcctcctccacgtcggaaacctgcgtatacacgtatcccgcaagtccgcgcgattccagtgcggccgcggaggcgagcacggaacgcacggcggcccgccaatcgtcgatcgaatcgtattcaccgtaaccgtaggcgcgcgacaccgccgcatgctccggtacgagctgcgccaatccgccgaattccgaaatcacgaacgcgcgtacgccgtgtcgtgcgaccggcagcaccacgtaatgcgcggccctgcggcgacggcggtgcttcttctcgaattcggccacgtatccgcgcaacggacccttgtccgggtagatttccagcggacggaaatagttgtgcacgctgtggtaatcgccgcaatgctggtcgtaccagccgctggtcgcgtcaatcggacgggtcgggtcgagcgcgtggatgcgttcggctgcgtcgcacgcgtcgaattggccccagccttcgttgaacagcgtccacgtcacgatggaggggtgcccgccgagcatgtgcaccatcgcgtcgcacgtacgcgaccaatcacgccggtagatcgggtcgtccgcgccgagcgccgtgaaatgtttggcggtgtcgtcgcggaatttgttccatgtggagcggatgagcgtcggcttacgattcgtggtccacgcattgtattcgccgtccgtgccgccgccggacaccgcgtcctgccagacgagcatgccgaggcggtcgcaatggtagtaccagcgggccgactcgattttgatgtgcttgcgcagcatgttgaagccggcgtttttcatggccgtgatgtcatgcgtcagcgcctcgtcgtcgggcgcggtcatgaggccgtccggccagtagccttggtcgagcacgcctttgacgaagagcggcttgccgttgagatggaagcgcgccacccccttcgtatccggtttgatttcgacggaacggaacgcgcagtaggaacttacgacatccatcggctgcgattgcgcgaccgccgcatcacccgccgtttccgcgggtttcgccgacccgtatcgcaattcggcccgcacgtcatacagatacggatcggccggcgaccacagatgttcggcagctgttgcgatttccgcacgcaccttgcgcacgcccgccggcagcgtctcatccgccaccaccgtgccgtccgcagggtcggtgacgacgatgtgcagtttcgcgttcggcttgtcgccgccgatttccgcacggacgaacaacttgccgtcggatgcccccttgagtgtcagcgtgcgcaggtaggcttccggcacgatttccagccagacgctttgccaaatgccgctttgcgcggtgtaccagatgccttcgcgctcgattttctgcttgccgcgcaactgcgtgcccgaatcgttcggatcgtagacgcacagcgcgatttcaaacgcgtcatcagggtcgataaatgccgaaatatcgacgtcgaacggcaggtagccgccgacgtgcgtgcccgcgagctggccgttgacatagcaggcgcagacataatcgaccgcttcgaaatgcaggatgaggcgattcgcgtcgccgatctgccggaccgtttcctctccgccgagcgtgacgggatgcacgacggtgcggtaccacagcaggttgtcggggtaaatggtctggtgcacgccggacagcgcggattccggcgagaacggtacgaggatcttgccgtcgaacgtttgcggaatggcggtttccttgactgcgcggaccgcttcgtcgcgggtcagcatcgccgccgttttgcgccatttcggcgcggtctcatcttccggaatggacgcgatcgcgtaatcccaccagccattgagcatggtgcagttgtcgcgtaccatggtcgggcgcgggtgctcgccgagtatgggggtacgaccctcgtccagcgtgcgttcgccttcctcggcgggattgaacgccttgttgccggcgcgcgcggacagccattcatggtcgattcgttcaccccacggtgtccacaactgctgcagcggctcacgggaacgcattttcgtaggagcggccttcagtacgcgtttgatatccagcatggagagccccttcctgcagctttgcatatctccgctctcattgtaaatggcggtcgcgttaaatggcagatgaatggcaagcgatttttgcaggaaagtgcgcgaatgtgccggaaggcataggaaagcagaagaatggcgattcaaaagccacgcgatatgtcacgatttgaaaaagtgctgtaattttcaaatcgtgacacatgtagggggttgcgtgttgaaatcagccttccagcttggccttttcggcggcgagacgggcggcctcggcttcgcggcgggccttcagctcggtatcgaagcgggcgagctcctcttcgacggcctccggcggaatcttcgcgaagatcgggtgcggcttcggcaccgaggtgccggccacgatcggctcggaagcccacggatgcacggtttcgcccagcttgtagtcgcccgtgatgatcgggtacgtgaagcccggcttgtcgagatcctcaacctcttccagatgaggcagcggcgagaagacgccggttccgccgagggcctcccacaccttctgtgcggagtgcggcaggaacggggccagcaggtggttggcgtcggacacggcctgggcggcggtgtgcagcacggtgccgaggcgggccggattgtccttgatcttccacggttcggtggcggagatgtacttgttgatgtcgccgaccacgcgcatcgcttcggacagcgcgttcttctggcggtgattctcgatgagtccgccgacggtttcgaacgcggccttggtttcggccagcagcgcacggtcctcgtcggtggcggaagcctcgtcgaacgccggaatctcgccgaagttcttgttgatgaggttggccacgcggttcaccaggttgccccaggatgcggcgagctcctcattgttgtggcgcacgaactcggcccaagtgaagtcggaatcggagctttccggtccggccacggagatgtagtaacgcacggcgtccacggggtaacgggcgaggatgtccttcacgtagatgacgatgccgcgggaggacgagaacttcttgccttccatggtcatgaactcggaggccacgacctgctccggcatgttcagcggaccgagcttgccggtttcgcctcccttggagccctggccgttgtaggccagcatttcggacggccagatctgggagtggaacgtgatgttgtccttgcccatgaagtagtagcccggggtggtcggatcgttccaccatgcgcgccatgcctccgggtcgcccttgcggcgggcccattcgatggatgcggacaagtagccgatcacagcgtcgaaccacacgtacagcttcttgttcgggttgtcgatccagcccttgaccggcaccggaatgccccagtcgatgtcacgcgtgatggcgcgcggcttgacttccttgaacaggccgatggagaagttgatgacgttggtgcgccagccttcgcgggtcttgagccacgcgagattggcttcggcgagcgccggcaggtcgaggaagaagtgttcggtctcctcgaagcgcggggtttcgccgttgatcttggatacggggttgagcagctcgtccgggtcgagttcgttgccgcaggcgtcgcactggtcgccacgggctccgtcggcgccgcagatcgggcaggtgccttcgatgtagcggtccggcagggtgcgtccggtggacggggagatggcgactttctgggtgcccttgtagatgtagccgttttcgaggcactgtttgaacagttcctgcacgaccttttcgtgattgccagtggtggtgcgggtgaacagatcgtagctcaggccgagatcgcataggtccttggcgatcacgcggttgtagcggttggcgagctcctgcgcgctcacgccttccttgtcggcttccaccaggattggggtgccgtgctcgtcggtgccggacaccatcagcacgtcattgcccttcatgcgctcgtagcgcgcgtacacgtcggacggcacgccgaagccggcgacgtggccgatatgacgggggccgttggcatacggccatgcaacattcaccaaaatatgactcatggtgcccgattatacaaagcgccatatcccgtgttttcggcgcattccgattggcggaagacgggcggatggggtcgatgacgttctcgcagaccggcctgcgtcaggctacggtagtccacaaggttatccacattgttgtattacgcaacaatcatcgtccacttatccacttttttcgcgaagccggtggcacgccgctttccgtatcagctacggtaccccgcatggatacctcccctccccttttgggcgacgccgacctgcccggccccatttgtttgaatcgtttgcattccctaggcgtggtatgcaaacttgacaacgacaacgcctactcgtatcacgattcgcgcacgctgtacggccgcgccagcatcatctcaacgctgatgccgagccgttccgtggcgtgcgccggcaccgctgcgtgggtgtggttgggtggcatgtttcccaacacgatcgacatcatttcaaaagcgcattaccgaacggcgaggtacggtcgcaaagtcagcgttttcaaccgacaggcgcccgacgaacatgtcaccgacgtcggcccgatcaccgtcaccacgcccacacgcaccgcatgcgaccttgccatgaactgcactccggaaacgcagtcgccggtcacggaaatcgtatgcatgctcatgcaggaattccggttccgccccgacgattgcctgcaggtcatgcaggaggccacccatattcgcaacgcgccacgggcacgccagtttttccggacgattgacggaaagcagtgacggatatgcgcgaatcgcaacggccgtcggaaaaaccacggcagacgagacagacgggacagacacggcaagcgtctgcacagtcgcggcgcacggcaagcaagagatatgaagagcgcgcgaaacgtagcaaacgtcatgggcaacgacatgaacagcatggacaccatggcaaacgccacgaacgacgtcgcgcgccgccgaaatatcagccgcacgcgcggcagcgggcattggtcgaaccgcctgcgccgccgatcgaattgacgccgttggtggcgtgcagcgccgacaccgcgcaagatgtgctgtggcatatcgcggaatatgcgccgcgattgcgcaagtggctggtcgccaatccttcggcgacgcctgcgatgctggaatatcttgcgcaggtcggcgggccaggtgttcccgaagcgctgcggatattgctgaaatcattggaaatgaacggttccggaagcgatcagcccttcatcgcaagcacggcattgtagacctgcttgcgattggcgagcgagccgtcagacagcggatgttcggcgacaacctgggagatcgcgtccttgatacgcaggttgtcttcctgcgcgcggtcgactgacagcaccgccagatcctcaatggacagcgttgcgggcgcggcagcgtcggcctcctcctcggaagcgccggcgatgacgagcaccatttcgccacgcggcggatcgtcgacgacgctttggcggatttcggcgatggttccgcggcggatctgctcgtaatccttggtcagctcgcgacacaacgccattttgcgattcggcccgaacacgtcaagcaggtccgccatggactcgtcgatgcgatgcagggtttcgtagaagacgatggtgcgacgttccgatttgagcgcgcgcagatgctgcacacgttcgctgtgcttgcgcggcaggaagccttcgtagcagaagcggtcggtcggcaggccggacaggcacagcgcgtcgagtacggcggacgggccgggagcgcaggtgacgggcaggccgcgttcgatggcgcggcggacgatcgccagtcccggatcgttgatggtgggcatgcccgcgtcggatacgacgagcacggtggcgccttgttcgacctggtcgagcaggccgtcggccttgtcgcgttcgttgtggtcgtggtaggcgacgacgcggccgggcacgcggatgccaaggcggttcgcgagcgcgtacaggcggcgcgtatcctcggctgccacgatgtcggcgccttccatgagggcgatcaggcgggcggacgcgtctccggtgttgccgatcggcgtggcggcgagtacgaccgttccgcgcggaatgttgacgtcggcgaccagtccgtcgagcccgaattcggcacgttccgtagcttgcgcggtttcctcggcattttccgcgttctcgccgatttcggcaatctgaccaatatttgttttcacggtttgtttcacggcgttaccagccttctcggcatcagtctgttcgctcaagttctccatatttccagtatcgcccacagcgtccccaaaccatcagcccccgccatttctccgcctttcgcaaccgaccaatcgaaacccgaccaaaccaccgacgacgccacacgccctcaccggtaaatcaaaatgcacccctcacacatccgggtttccacccgccacgcattcggatttttcttcgtacgacattcggattttcctttgcgtaggattcggattttctcagacgggggtgagacgacgattcaacacgactttggacatgccatcgatagcatggaatcatgcgttattttgaagatgaaatttccggaatcgacggcagcacggccacgttcgtcggctactgccttgacaacagcagcgaaatcgacccgaatcgcaagcgcccgtccgtgctggtgattcccggcggcggctacgaaatgacgtccgaccgcgaagccgaaccaatcgccatgcaattccttgcagccggcttcaacgcgttcgtgctgcgctattccgtgaaaccgtccatcttcccggtcgcgttgctggaagcggccgaagcgatgcggcggatccgcacgcatgccgacgaatggcattgcgatgccgacgcgatcgcggtgatcggcttctccgccggcggccaccttgccgccaatcttgcgacttccgccagcgacgacgtgctcgcggcacatggttacgatgcggatgcggtgcgcccgaacggcctgatgctcgcctacccggtggtcacgtccggcccgctcgcccaccgcggcagtttcgatgcgctgctcggcgaccgcaaggccgatccggaagcactcgacgccgtttcgatcgaaaagcatatcgacgcgaagacgccgccggtgttcgtctggcataccgttccggacgattgcgtgccgtatgagaacacgctgatgctcgtcgacgcctgcaagaaggcgagcgtgagcgtcgaggcgcacctgttccccagcggcggccacggtctgtcgctcggcaccgccgaaaccgcatggcagggggtcaacggcgtcgagccgtgcgtgcaggtctggccgaaacttgcgatcgcgtggatgcgtcgtacatttgcggataccgacgctgccacgaccggctctgccacagccgacgcgattgccgaataatcgccattcctgcgtttttttccgcgtcttttcacgtcttttttgtcgcacgacttcgcttttcggaccaaaaaatcaagtcgtgcgacatttaatcgagtaaaaataccctctaaccggcattttccggtcgaaaacgacacttagggggtattcagcgtcgcacgacttgaaaataaccgccaaaaatcaaagtcgtgcgacgttttgcgccacctaatcgccaaaatcagatgggacgcgactcgtgcaccatctgacgatcgccgtaatacaacgagttcaggccaggattcgccggcgtgccccacgcggacgccggacgcgccggacgcaccggacagccgctgagcacgctggacagctgccggacaaccattgaacaaccaccgggcaccaccggccgaacaccacctacaagcacacgcacataggctcccataggcacatattgacgatttgtgcagatttgccacccgtcgtcgcactgcgacgcacactgcatagacccgttggtagtctgtgattggttcgcaacggcacattcgttgcgcacgatggaaaagcaagccacacgaaccgaccccgcgcaaccgcgcaaaaccacacagagagacctatgaatatcatcaatttcttcgtcaacctcatcaaggacccccgtaccgcgatcgccagctggatcgcgatgggcgtcgccccgaccctcggcttcatcttcctcatcgtcttcatcgagaccggtgtggtcttcttcccgttcctgccgggcgattccctgctgttcgcggccggcttcttcgccgcgcccgacgcgaagaccggcgtgtccgcgctgccgctgttcgcgctactgccggtggtctggtgcgcgccgatcatcggcgaccagtgcaactactggatcggccatttcttcggccgtcgcatccttgaatccggcaaagtcaaggccatgaccccggagcgcatcgagaaaaccgagaagatgattgagaagtggggcccgctggccgtgttccttggccgtttcttcccgttcatccgcacgttcatgccgttcatttccggtatttccggcatgcgttggagccgtttcacgccgttctcggtgctcggcggcctgtgctggtcgacgctgttcacgctgctcggctatttcttcggtggcattccggccgtgcagaagcattttgaattggtgatcattgcgattcttgtgctgtcgctgattccaacgatcgtcggcctgctcaaggccaagttcggcaagaagaagccggctgccgaggacactgcggaaaccgccgacgccgaataagcagcgttcaatcgtcgtaaaaatatcggcgaatacaacgcaagcacaacacgcggagtgtggaattgcatttttccacactccgtactaatatttcgagagttgtcttgctaaacaaggtgacgcacatggggctgtagctcagttggtagagcgcttcgttcgcatcgaagaggtcgcggtttcgactaccgtcagctccacgaagcccgctgcattcattccaccgcagcgggctttttcttttgctttccgccgtttccggtatttcttgcgattcccatacgcactttccagcgctcttcgcaccgtgcatacgcccgtccgcacgcacgcaccgcgccgtccgcaccggccacgcaaacgcaacccagccgaatcgccatacatgtcgacttctaaaaagccatttaacggggttattttcgcgatttttacgattttaaccccgttaaaatcgcatttttcgcaaaacccgtacgatagtccacgtcaaacagtccacacaaacccaaaaatacgttaaactagcgttttaacggggtcaattttgcgattttcgcaattttgaccccgttaaaccacatctcagggattatcggtatctaaaaagtcacaaggagcaccacatgagcacctatcgcagagagcactatttggccaagctccgtcctttctacaacgattccggtctcatcaaagtaatcaccggcatccgcagatgcggcaaatccagcctgctcatcacagttctcaacgagctctttgagcagggaatccctgaaaccaatctcatctacctcaacctcgatcgccgcgaataccgcaacgtgaccactccggaccaactcgatcaactcatcgaacaagccatgtcgaatgcctacggtgcaggactgcgttatctgttcatcgatgaagtacagaacgtgaaaggcttcgaaaccgtcatcaacggctggcgggaggaaggtaattgctccattttcatcactggctcaaattcctatctgctgtccggagagcttgccacgaaacttaccggccgctatatcaagctggaaatgttcaccctttcctttcaggaatacctcggcatgcggaatttcctaaacaaaccggaaattccggtatcgcaagccttccgcgactatctcacatacggcgggttcccgaaatcgctggaatatgacgatcccgacgcaaaagccgcatatattcaagacgtcatcgggcagatcttcaacaaggacatcaccgcccacaaaaaagtacgcaatcgcgatactttcacccgtgtgcaggactatctcatcaataatttcgcagcgcccacgaatctttccggcattatcgcgtatctgaaacacagcgaaggcatcagcatcaaacgcgaaacgcttgccagctacgtccgtttgctggaaagcgccaaaatcctctacaagtgtcctcgcttcgatctgaaatcccgcaagtcgctcaggggcggggaaaaatactatcttgccgatcccggtatccggttcgcccgtaataccgatacgcgagtcagctacggtccgtcactggagaacgcgctatatacgcatctgcggtcgaaaggctatgacgtcagcgtcggcaccatcggcaaacttgaatgtgacttcattgtccgaaagcgcaaccagtacgcctatatccaagtgtctatgagcgttcaggatccgcaggtcgaggaacgcgaatatcgcccgttcagcaaattggcggacgggtatccgaaatacctgttcacattggatccgctaccattgcagcgcgacggcgtacgtcacctcaatctcatggaatttctgcaaaacgacggcgatatcgacttcgattaaacattaataatggcgattatgtcgtgtggcgcgccggttgtgcaaacgcaccacacgcattgcggaggcgtcaggcgttgcggctacgtacgtaggcgtcgagcgtggcggcggtgatgccgtcgtagccgttgattgaggcgaattgcgggccgttggaattgtcgatgcgcatgaagccggtctggccgagcgtggtggcaccggatgcggccgcggagcgcaggccggacatggaatcctccaccgcgatgcaatacttcatgtcttcgggcgcgatgccaagcttgcggcccgccgcaagatacggtgcgggcgacggcttcttctcgacatcgtcatcgccgcacacgtaaccggcgaacgtgccgtccggcgcctgcgcgatcaggttttccgccagatgacgcggcgatgtggtgacaagcatcgacggcacgcccgcctccttcagcgacagcagcacgtcttcgacgccatcgatccacggaatgcgttcgaattccttccgcgccacgtaatcgatcatgcccttgacgatttcttcgatcgacagcttgcagccgtgctccaccatgcggcgggccacgtccggaaccggcgttccggaaccctgccaagcgaggtcctcatcccagtatccgccgtggtcggctgcgattttcagctcgccttcgtgccaatacggttcggaatcgatcagcgtgccgtccatgtcccagaacacggctttgagcatcagcttcgaaacttcctgggcgccgttctggataccgttgttcagctcggtcattacgtttcctcgcaatcgttacgcttcgttctccgatagctacattcttcgtcagctacgaccatttcagcagagcggcacgacggaagcgcttcagcgcgcagaaaaaacaggacggttccatcaagccggtccgccaatcggttcataccaatcggctcgcaccaatcggttcacgcaaaccgactcatgcacaagccaattcgcgcaagccaacgcagcaaccaacccatagcaacggaggcacttggaaatcccccaagtgcctccgcaacgaacaacgcatccgacgaaatcggtcggtcgcaatcgcagcaatccgtcatagaccccttttagacgaatcgcaagacttgcgtgcgactactcctgagcctcctgctcctgagcggccttctcggcattctccgccttccagcgggcgatgcaacgctcgacgcgcttgtagccgatgatcttcggatccaagccggcctcgcggaaaatcgcggcaggcgagccaccctcggcatacctgcgcatgcagtcgtcacggaattccttggaatagcaaattcgatactgagtgactgattccacagcatcgagagaccccaggtatttgcgggtctttgcggtgaacgcaactcttggcactgtacgctcctaacctttctgtatccaccgcatgccctcccccgattcttcgcggaaataagcagtcatatttcatcgaagctgtgggccagccggaagaaatacgaacttcaacgcggatacgtaatattattcctcacaatagagacatcattgcgagacagatgcggcgttatgagtagttgcataccaaaaatcgggcatacccccgcgatatatgcccgattttgctgtttttttagatttttttagggttttccagcgcttttcaggaaagtcagcgaatgggctgtcagcgaattccccaaactaccactgacctggagcccatatcgtccccctcttccgcacgttccgcccgtacggattcgcgcgacggaagctgccgtgcatcggctcgcagctgcctgcgccacatgcgcgcgcgctgggaccgctcgacttccacgatgccaccgtccgcgtccgcggcgaacacgctggaaccggccggcttgcgcagccgctccacttggcggcgcagctcgcggttctcttcctcaagttcgaggatgcgcgtgattccagccaggttgatgccctcctcctggctgagttgctgcgcctgcgcgaggcgggagatgtcgcgcagcgaatagcgtcgcgcgccaccttccgtacgttgcggtacgaccaagccaaggcgatcgtactggcgcagcgtctgcggatgcacgttggcgagctcgccggccgcaccgaccgagaagacgggcagctcgatgtcgaaaccgacttcggcggcaccgtccaggtcggcccggccggccacgatcgccatggcgcacatttcatacagccgcttgatctgccgtgcggcgcgcgcttgggaggcttgggaagtccgcgatgagcgtgccatggcggtcagcgctcccgagcgagctcgtcggcgaagtcaccgcatgccttgtcgaattccttcgccgcatgcttggcaacgaggttcggatgctccggaacgcggatctccacacgaccgaccaaatcgccgttctcgtgcggattcaccacgcccttgcccgaaatgcgcacttccgcgccgctggacgagccggcgggcactttgaaggtgatttcgttgccgtcgatgtccttcgccgtcactttcgcgccgttcacggcctggctgacggtgatgggcagcggcatgatgatgtcacgtccgcgcagggtgaatttcgggtcttcggcgacggtgatatgcaggtacagatcgccgtttttgccgccattgcggcccggcttgcccttgccggtgagacggatcttctgcccgtcgtgcacgccggcggggatgtgcgtcttgaacttcttgccgtccgcggacagcgaaaccgtggctcccttgacggcctggcggaaggtcaggcggatcttggagttgcggtcctcgccgttttccggctgcggctgctcgtaatcgtcagtgccgtagcgttcgtaggcggagcctgcgcccgggccgcccgcaccgccgccgaacatcgagaagatgtcgttgaggttcggattgccgccgccattggtctggaagcggatacgcgagccattgccgcccatgcctgcgccgccgccgaacatcgagccgaagatgtcggagaacgcgcccgcgtcgaagccgccctggccggaaccgccggcgaaacgcgcgccgcccatgccgaactggcgaatcgcatcgtatttctgacgattctccttgttgctcagcacgtcgtacgcttcggagatgtccttgaacttctcctccgcttccttcgtcttgttcaggtcgggatggtatttgcgcgccagcttgcggtacgctttggtgatttcggcgtcggtggcgtctttggagacaccgaggaccttatagaaatccttgctcagccattcattctcagccatgatgtgcctcctttcgtgaggttttcatgcagtaaaaagtacagtttttcaaactttcaaacagttgtcgttgaaccgttgtttcaggtaatcgaaggcccctcgtttttcagaggggcccgattactcgtcacatgcgtttcgcgcggatacgcggattgtgcgaatgcgcgatcagttctgcggagaagccacgaccacacgggccgcgcggatcacgcggtcgccgatgcggtagccggcttccaccacggtgtcgacggtttccttctcggcattcggatccggcttatgcaggatcgcgtcatgcttcgtcgggtcgaaatcctcgcccttttcgccgaacttctcaacgccgaacttctcgaacgccttgtcgatcttgttggcgacggccttgaacgaatcgtccatttcgctgtgttcgcgaatgcggtcgatgtcgtcgagggccggcagcagggcggtcagcacgtcgatgatgccgtgctgacggaagcgttcctgctccttctgcgcgcggttgcggaagttgatgaactccgcgcgttcgcgctgcagcgcctccagatattcggcggcttccttcttggcctggccaaggggggtcagcgtatcgtcggccttgccgtcggcagcgtctgccttgtcagcaccgtcagcggcagcggaatcgccattttcttgcgattgcgcggcagccggctgagctgcaccttcctgcgttgcgccagcggcggcagcggcggaatcggcggaagcgccgtcagcagcggaagcggcggccggggcggcctgcccggacaggtcatccatgtcgggcaggtcgttcaggtactcgtccttgttgaaatcggacatgattacttgttgtccttgtcgtcatcgtccacgacttcggcgtcaaccacgtcgtcgtcggagccgttggaagcggagccagcagcgcctgcgccagcagcgccggccgcaccggcggcgtcggcggcaccctgctgtgcgtagagggcctggccgatcttctgggcggaggtcatcagctcgctctgggcggacttgatcttctcaatgtcctcacccttcagggcttccttgagctcgttgaccttgtcggtgacttccttggccacatcgtcggagagcttgtccttgttgtcattgacgagcttctcggtctgataggcgaaggactcggcctggttgcgggtctcggcgtcttccttacgcttcttgtcctcggcctcgtgggcttcggcttccttgaccatgcggtcgatctcgtccttcggcaggccggaaccaccggtgatggtcatggactgttccttgccggtgcccttgtccttggcggacacgtgcacgatgccgttggcgtcgatatcgaaggtgacttcgatctgcgggacaccacgcggagccggagcgatgccggtcagctcgaaggtacccagcggcttgttgtcgcgagcgaactcacgctcgccctggtagacctggatgagcacggacggctggttgtcttcagcggtggagaagacttcggaacgcttcgtcgggatggcggtgttgcgctcgatcagcttggtcatgatgccacccttggtttcgatgccgagggacagcggggtcacgtcgataagcaggacgtccttacggtcgcccttgatgacgccggactgcacggctgcgccgacggccacgacttcatccgggttcacggactggttggcttccttaccgccggtgagctccttgacgagctccttgacggccggcatacgggtggagccaccgacgaggaccacgtggtcgatgtcggagacgccgatgccagcgtcgcgcagcacgttgttgaacggggtgcggcagcggcccagcaggtcggaggtcatttcctcgaagtgcgcacgggtcagggtctcgtccagatgcaccggggtgccgtcaggggtcatggccaggtactgcatggagatggaggtgctggtggagctggacagttccttcttggcctgctcggcagcttccttcagacgctgcagggcgatcttgtccttgctcaggtcaacgccgtacttgttcttgacttcgccgacgagccagtcgatgatcttctggtcccaatcgtcgccgcccaggtggttgtcgccgttggtggcctgcacctgaatggtggagaagccgtcgtcgtccttgccgatttccagcagagacacatcgaaggtgccgccgccgagatcgaagaccaggatgcgctcgtcttccttgcccttctcaaggccgtaagccagtgccgcagcggtcggctcgttgatgatacgcaggacgttcaggcccgcgatggtgccggcgtccttggtggcctgacgctgggcatcgttgaagtatgccgggcaggtgatgacggcgtcggtgaccggttcgccaaggtaggcttcggcgtcgcgcttcagcttcatcaggacctgggcggaaatctcctgcggggtccacttcttgccgtcgatctcaacggtccagtcggtgcccatgtggcgcttgacggagctgatggtgcggtcgacgttggtgacggcctgacgcttggcgacttcgccgaccagaatctcgccggacttgctgaatgccacgaccgacggtgtggtgcgagcgccttcggcgttcacgataacggtgggctggccaccttcaagagttgcgatgcaggaattggtagtacccagatcgatgccaactgcgcgtcccatatttggtctcctttgcaataggttcgctatacgttcttttcgttcttcgctcgagtttcggatcgccgtttccggattgccgtctctcatgctttccaaaacttgagcctacaccactcaactttgaatcgcaagttattattcccgaaatcgcaaaaattcttgagtacacctcactcaactttgcgcaaaacccaaaaccgccggcgctggggagcatctcagcggcggcggttttggggattatcggaggttattcagccaatcagcggtcgttcttggcggtcttcgcggtcttgatgagcatcgcgacggcaaccagcatggcgatcgcaacagccgcagccagcaccgcggtgccggtcttgccgagcagtgcggcgccaaacgggccggccttcgtatcgttgttgaccttgccggaagcgatcacgccgttcttgtcagcgttgtcagcgcccggcttgccgttgttcttgtcggcggagttggcggccggagcctggaagtcgacggtcacggccttgccggactggcggccggtgacggtgagcttgtattcggagccttcggtcacgccgtcgagcgcgatcggagtggtctgtgcggtcttgacgcgcacgccggagagcggagtggaggaatcggacgcggccacggtcttgtcgttcttgtccttcagctcgtagctgagcacagcgtcgccgttgaagccgtcgacgtccgcggtgaacttgccgtcggcagcggagaccttcacagtgccgttgtcagacagtgccttctgcgattcggcggaagtggccagtcccagagcgccggcgatcgtgtagaagttgtcggtctggtcggtcaggccgatgacgcgctgtgcgccaggaccggaagccgcgatacgcagctgggtgccggtgtgctccatgtcgccgccgttgtagccgccgtctgcatcgcgagaatcgtcctgggcggtgccgtaggagacgaccatgttgttgccatcagcggtcttcagcacggtggacagtgcgtaagccggctgggcgttgaggatctgggaggtgtgcgcgtggtcggcggtgacgatcaccagcgtgttcgtgaggtccacgttctgcatggcgtaggcaatggcctggtcgaagtcgtcggtctcgccgatctggccgcaggcattgcctgcgtggtcctgcttatcgatcgaggcgccctcgacctgcaggaagaagccgttcttctggccgttcgggttgtcattcagcaaatcgagcgccttcttggtcatgtccttgagcgaggagccctgattgccgagccagtcggcgttcggggtgcacacggtcgggttggcgtccttagctggatccttggcggtggccttggacgggttgaacttggtcggcatgttaccgtcgctcatcagggcgagcactggctggccgtccttgtactgcagggcgttcatcgcggccggatcgttctcgacggtctggaagcccatttccttggcctgctcccacacagtcttgcccttgtattcaccgccctgcacggtctgacggaagtacttggaaccaccgccgatggttacgtcggcgcgggtgtcgagcagctgctcggagatggagccgatgccgccgttttccttaagctggttgatgaggcactgcttggaggcattgttggacgtaccgtcggtcttgccctgtgggccgtagcaggcacgttcggacgaatgcgattccagcacggccggggtagcatcctggatttcggcggtggtcacattgccggtggctttgccggccgccttggccagctcgaagaggttcagctgcggattgccgtaaatatcaacgtcaacggcgttgttgtaggtcttggtaccggtggcccatgcggaaccggatgcggaggaatcagtgacggaggtaagcttgcccggattggggttggcgaccagcttgccgtcgccatccttgccgacggcgctgtccttgctgccgttgccgacggagaaggtcgtgtactgaccggtgccggcctgcacgtcgtcaagcgcgctcggctggccgaccgcgtcaagtccgtcgaagtggccgttggcgcccttcagatagtcgcgggcgacggtgatttccgaatcgcccatgccgtcgccgaggaacaggatgacgttcttcgcgttcttgttgccgatggtggcgatgcgctgcgcgccgccatgcttggcgagttccgcgaccggcttgccgttggggctgtaggtggtgtcagctgcgagcgccggtgcggcgagcgcgccgagcgttgcgacggaggcgagtgctgcgattgcgcccgtgagagccttgtgcttgctcatgtttcttctttcttccatgcagtttcttccgtgccgtccaacctgccatttcggttgcgcccgttaggtaacgcccgtttcgaccatgttttccggctgcgcggaacctttccgcggctgcattgcttggatctttcgatgccaccgcccacgctatgcgccgcaagccaacgcacaccgcactacagaagaacggcagatgaacactcatcgccatatgatgaccgcaacatatccaccgcatgaacagggggaatacggccaataaaatcgccatattccgtcaaacaacaccccccaccgcaccccacaagccaaaatcccccactggctggataaatccaacctctcagaccccactcacacgccaaaaatcccagtgactggataaaaaccacctctgacgcaccactcacgcgactaaatcatccagccactgggaaaaatgcccgcgccactcagccccgcgcaacccgcgccgcgcgcgtggcctttacggccacgaacacggaccgcaccagcagcacgcacagatagcaggcgaacataatcgccccaactcgtggcgaaacctcccccgcaatccacgtgccgagcggcgcggtcacagccgccgtcacgccaataatcagcgcggttttcacatgcgctagcctgcgcttcaagttcgccgcgctggtcgtgatcgaattcggaaacattgccaacagcgaagtgccgcgcgcaaccaggtcggacgcgccaaacagcatcgacagcgacggcaccgcaagcgcaccacccccaatgcccagcagccccgccagcgtgccgatgaccacacccagcaacgccaagccaatgccggtcaccaccgtcatgacgatctggtggtcgcgcgacggaacaaaactcacctgattgatcaccacgaacacgagaaacgctacgaaaatccaccgcagcaccaattccggcagccgtgacagcagccaactgccgatctgtccgccaatgaacatgccgcagaacagcagagctgcggcgagccagtcgacgtgcccgccggtcgcgtacgaaacgacaccggaaatggaggtcggcacgatcgccagcgtggacgtggcggccgcgttgcgttgcgacagaccgagccagacgagcgcgggcacgatcaccgtgccgccgccgatgccgaacgtgcccgacagcacccccaccaacatgccgaccacaatcagcacgatgatgctgcgcgccgacccatcaagcgccgtctcccccgctcgcgattccatcttttgcgattccgttcgtacggcatccgcccgatccgcagtttccccttcatcacacatggcagctccttccacgtcttccgcgcccgatactacccacctgccgcgcgcagtaatcagccgattccataattttgcgatttcgccgccgcagcgcccggttcacgcgctttctcgcttatagatggcggattcgcaggatcgacggatggtatctcgcttatagatggcggccccttgcggaaacaagacatctagggggcatgcatgctaccctctaacgacctattgcccaaaccgacccgccacctataagcgagataccaccggacgcccggccaaatccgccatctataagccagatatccagccaaaaccacgaccgcacgcctacacccacgcctacaccggcacacccgcgcgcctacacccacgcaagacccattgcacacacccccgtacgcacacgaccgcgcgcggaccggcaaaatcgcaagtcatgagcgaaaaggggcatcaaaagcgtccgaaacaggccgaatcacacccccatccgctcacagacaagcaaaaccagcccaactcacaagtcgtgagcaaaaggggaggccacccaacatcaaaacagcccgaaacatccagaatcgtacccccatccgctcacaacccatgcttcagcacgattcaggccatatgcgcaccgcaacaacacccctgcgcaacatcagacatgcacacgcacgcaaacacaagtacacacactgaaacgcaacacgtaccacaagcacacaaacaccacgcaccacataccgagcacgaccagacgcacacccccgaacaccggagaagcgatgtcaccggcctgcggcggcgctaggctagacactacccccgaacaccagacgaatggcgcgcgccggccccggcgcacaacccgtgccgcacaatccaggagcgtcgccatagccgcgcgagccccacaaaagcgcagccagccacaaacacgagcagtccgatcaccgcagccgccacggctgtcatttcgcccggctcgtcgtattgcgtcttgtctggcactttcggattcggaatccggtgcccgcgcacgagcagcctgtgtgagttgacaccgtacggcgtgcaggtgatcagcgtcgcgtaatcggccccggactcaatattcagcttgctgatttcgctcggcagcaccactgagatctggtccacttggtacgtgtaggtttcgtcgagcacgtggaatgcgaacgtgtcgccttttttcagttcgtcgaggccggtgagcaaccgggcggacggcaggccggtgtgtccggagaccaccgcgtgcgtggtcgctccgcctacgggcagcgatgtgccggccaaatgtccggcggcgatctgcagtacgccgtcgctggtgccgtggtagacgggcagtttcactttgatgcgcgggatggtcacgtatcccatgatgccggtgccggtcacgtcgagcgtttcatcatattcgcgcttctgcgcgtcggtcatgtgccaccgatcgccgttcgcggcgagtcgttcattgtattcgtgcgccgctttcagcatggctttgcgttcggcgccggacatgtctttggtttgttccacgtagcctgctacggcgtatgactggtgcatgcggttccaccagtcgctgaatgtcggatacgcgatgaggcccagcgcaccgatcatggcgattgtggaaatggcaatcatcacattgagcagcgcattcgatttcttatgcttggcagccggtttaacctgcgcacccggtttaacctgcgcatccaattcgacttgcgcagctggcttggcgtccgattcatccgtcacgttatttatgctacgcccgcttccgcaaagccgtcttggcaacgatcagcagcaccaaacccgcgcccaagatggccacggcaatccaagcggcctgctgcacgtcggcgccggtgtgcggctggtccggcgtggtgggtggcgtgtgcgtgttggtgatttcagtggagtcgccttccacatcggagatggtggtgtagccgtcgggcaccgccgcttcgaccacggtccattcgtggtccgcgtcgagcgccgtccacgaatgcgtccacttgttggactcgttcagcttcacgttttccacgggctcgccgtcgcgcaggagtttcacggtgatggattcggggcgcttgccgtcagaattgttccggtcattccagattttgcgcacggtgcgttccacggttttcggcggttgcgccacacattcggttttcggttcgatactcagcacacgcgacccgccggagacgccgtcttcgggcactgcgacgagcatgctgccggaagagcacgtccatgtctggttctttccggaggcgttggtgaccttcacgtcaacgctgtcggacacggccaagtacaggccgtcggacagtccggtgaaggtcagatgcccggaggtgttggtgacgccggttgccgtggcgtcgggtttgttcactgcgatgagtccggcgagcgtgttggccatgtctcgccacacttgcgcgtccttgccggtcatcttcgaccagtcgacggggtaggcggtggagtcggtgaacggtgcgacgggttcgaaggtggcgccgccgcttgccgggatctgcccgactttgtagaggttgaagctggcgtccgaaatggcgaagttggtagaatcgtcgccagtttcggagtccgagcttttatgttggtacgaaatggcgatgctgccgctggcagagtctgttgttggcgccgcgacggcatcgcgagtagtgaatgcacaggctgccgcggcgaatgtggcggcgattgcgcagcatgcggcgatgacgcggcttgcgatcgtgcgttccttcattgccgacccctcttctgtggattggaaagtaagcatgtttgattcgcccccaacggcaaaccggaaaatatatggagccaggctggatactcaagaaaattaggcagtgtacaagggattgaggtggtccagcccagcatatgtgggttcagttattatttaatttttagtttttaaattatgtattgcgattcccgtaagccgatgctgacttgcgtcaacgcggctcacgggtttcgcatggttacttcagattcttatggaatccggaggatcaggcgttgcggcgacgcagagccatcaccagggtcgcgccagcaagcacgaacacggcgataccagccacgtacagcagcacggtgcccatgccaccggtggacggcaggttggagcccttcttatccacgatcttgttatcaagggtggaatcagaagacagagtcacctgcggattaccggactcgttaatagagtgcgtggcatcaatcttgatggtcttgactgcggcagtggtgtagcccttcggagtggtggtttccttcaggtagtaagtaccggcatcaaggcccttgatcgggaaagtgccgtccgtagcggaccgcatctccactgcggtctcatcagcctttgccggacggtaagcacccagagtgtcatccttcacgagcttatactcctgagtgcagccttcatccgtatacagcttgaagcctgctcctgcaagagcatcaccgtccacgctgtcaataaccttcttgttggtgataccaaaggtaaaggcgtaaacagtcttgtcttcggtcttgccagtgccttcagcgttcggattgttggagtactcaaggttgacggagttcttgttgtccgtagtgccggaagcgttgttgatagtggccttctcattaaggtgcgcattatagatcacttcaacggtgaagccttgggcaatcttgatgccttcgcacttggcgatgacatcatcgatggtcaaagaccaagactgtgtgccatcttccgcagctgcgggaatagttgcagtgtaatcagtattagcaagggtccaagtcttagcggcagtgccattgttgccgttcaccttgacggatgcgatggattcgaaggtgacgcccttgctcatcgtatcgttgaacttaaccttgtaggtcttgtaatcagcgagattggcttctgccggaatagtggcgtcgagcttgaactggaaggactcattaatatcgtggtcagcagtattgccccaaccttcagttgcaccagcctcagcatcaccagtctcatcctggatcttcttgtcgacggtcggctgggtgctcttcggcgcaaccgttacatccgcgccaataatcttcagaatgaaggaagtataggcatcgttcttctcgttcagagttccggccttatcctgaataaggtagtaaccgtcactcaggccagagatggtgtaggaaccaacaccagtcgagacaaaatcactggaatcagtatgagtggtggagagcacgccactgaacgccgtggcatatgccttagcatccgtggaatcactgctcttagcagccaaattctgggaaacagttgcagcatccttgtccttaatcagagcatcagtgccttcagcagcaagcttgctctggtcaatgccagaaccccatacaacattgcccaaggaaccgtctgcgccaaggttgccagtgaaaatctggtatgcctcgtacgtgtgtccagacttggccgggctgatagtgacagtatgtgtaccctcagccgccatggcggtggaggcaccggcgaaaccggcgacggccattgccgcggtggctgccacggctacgaggcctttgagaaccttgttcattgttctccctttctttcttgtttgaaatttttggaatcttgagttattcgtattcagttattgcctagagggcagcgagttcgctacgctacggaccactcccccttctcctagacgcttccatcattgccgcctcctgaggctcaaggccagaccgaccacggcaatcgccactgcgaggaatcccgcagcgtacatcttgtttactccctcgccgcctgtaccaggcagaacgacgccgggggtgttggtaatggaaccaccgtcaacggtgaatgcggcagacttctgatagccggcggtagtctccggcttgaaaccggaagacgtataccactcgcccttcacgttcgcgccttcggccggcccgatgcggaacacgtgcggagtcgtatcgatgttgtacccgtcaggagccttggactcgaccaactggtattcgccccactcaaggccgacgatggagaacttgccggcttcgccgtcacgatccgtgtactgtcccgtctgcgcggagcaggtcttctcgctgctgttcacgcaatccttgatggttgcgaccggatcagtactgccggtctcggtataaaccgcgttgccgttatcccacgagaagttcctagtcttgtacagcttccattcggaaccggccagcagcttgctggtgtcagtctcgtcggttttcttccagttcaccgtaccggtaagacgcgagttctcaatgttgcccgcgctaggaagaccggaactcgtgacttgcccattctcaataacgatggtgtaagtcttcgtcttactgacatcgaaaccgttcggggcgctggtttccttcagcgtgtaggtgccatccgtaaggtcggacaccttgaactggccgcccttcggatcctcatcctgccgcgtgtcagctgccttggcagtcgtattggtaatagcgcggaccaccggctggtcatagaacaccgcgttcttcaccgtggaacgatgggagcgattctccacatatgcgctggtcaccgtgcagccggaaggtgcgctgtaatacacgttagtgttgctttccagcgtcaccacgtctccaccgttgaacgagtatccgccatcggtattcgggcgatagaaggattgaggagtggtccagttagccttatccctgcgaattcggaagatggcatcagatggcatcaccgaattgatggtgtaggagacgtattcgccacacccacttgcggtggtcatttgctttcggttcggttgatcgcccttgtctgcaggccaacttccattggcgtacttccattccagaaatagcttctgaccgttattttggttgaagtcatcctgcatcttgaaatacacagtggtggtggtcgcagcaggctttgtcaccttaattttcagggtggctttcttctggcgctgctcggtggcagtgatggtcacatagcctgaagtcgcgttcttagcggttaccgtaacagcagtaccggttgaggggcttacggaaacctcatccgtattgctcgaagaccagttcaccgtgttgccttcaggtgccacggtagccgtcagcgtcatggtcttaccttgttccaggctgattttctggccttcggtatagttaccgatgctcacggagctttccacggttacaccgcttaccgtaacggggaatgtcacggtcttgtcgcctgccgtgaacacgatgttcgtgaagccgctgctgttcggctgcagctgcgtgccattattggcaatggtggcaatggccagatcctcggacctccactgcaccttcgtggcgagctccttgccatccttatccacggcaacgtaggtgatgcttgcaggagtcgaattggtaaagcgccacgaagtgacttcctgcccattaaccgtgaccttgatgcccgcaacctcgctgcctgaatcatcgtccgtaatggtccacgactggtcgggatcgcccttcttggtcaattcccaagtggaacccgcgagcaacgtgcttccgtcagtgccatcgaccttcgaccatgcgatggacgtacctgaattcttgttgacaatagcgccattgttcagctgcttggcggtgtcatcggtgatttcagtgccgtcggcatcgtacaccttgtcgatggttgaaacagtatccgtactgtcgtgcgtgacgatgcgatagatgttcgtgttcaacgcatactggctgctgccagtgccgctttccctcacataatatgtggcgttcttcgccaagctacccagggtgacgctaccgttatccgcatcatccgcatcattccagccgccatcagcaaccgtggtgatggagttcgtgccattcatggcattattcctcgtgccgtacacggtccacgaagtacccttcagcgtcttgccctcggcatcgaccttatcccacttgatcgcggcgcaggaggtggtcatctgcccgtaccaagacaggctatgccgttcctggtccatatccactgcagaggtggaatatttaccttcggagttgacaaaattaccgttgcctgtggtaacaacatccttgttgtacatttcgaaatcgccggtagtccacacacgaccgttggtggaaacatgcgactggaagttacctgcagcaccggaatcgttgcccgttaccataacggaacccatccatgcggcagacggatcatcggttacgttgacgttgtaccagtcttccttatcaccatggttctgatccttgtaccagccggtgttgatgcgccccgaccccttaccaccaagaatcgtaagggtattggtgttatagaagttccacatcagctggcttgcgcgcttgacgtactcctgcccatgcgtattgttgtagcggtttgtgcccgtcgaattcatcatgacgtagccgtcggagatatcaatgtcgttccatttgaactgccagccattgcggaacttcacatcgttgccattaccattgatattgacggcaaccgaagcattgtcggaaatgttcttgaagttgaacaccacgccggcatcaccaatgttattcagccttgatgcgtccaaattgaacacctgcaactcgtctttgccgttgccagtcagcgtgatttccgtctgcctggaattgttctgaatatcgaaccgatagacgttgtgttcgtaggtgttgtagctgtacgagtaacgagaacctgtgtaattatcctcattgcctttcgcaacagtgttgctggaagaaatcttcgcgagcttgccggacagcgtagccacataattcttatagtcggaatacgtgtaatccgaacccgtcgaaggattcttcactccggaaataacggtgttgctgtgattccagttgactttgccgttgccgcccatggcatatacggaatactgttcaccgttcgtccaagtgttgcggctttgcactgtggtctgattaccagcaatgttcgcgctaaagttatggtcattcgtctcgccggtagcgccattccccgctccggttccaagccagctggatccctgattagcgtcatccgtccagccctgagcaccaccgaaccaattcaactcggaattggtgctattgccaccgaccgaaagcacggtcgagccgtcctttggacggaactgcgaaccaaaaccgacgatgccccaacgaaaaccacgcgaacgattgaatgagccatccttattccagatgttccaagcctgcttcattggatgaagcaaaagctttccgttcacagcggtcaagccttcggcctcaacagcgtaagaaccctcaggcgcattgttgttattggcagaagtaatgcccgacttcttgccacctacatacatgtcaccgccaacgaaagtagcgataccttcatcgttaccgctgccggaggtctgatcgcctaacggttctgtggtaggtgtgcagattgcgccgtccttgcgactttcgtcagctttggcattataggtgggaatgagggaagtgacggcgacggtggccatcatggctaccgctatggcggcggcggtcagggagcgggtacgcgaaagcgcgcaaccggttgccggtcgcgttcctgcatagtgtcgtggtgcgttgccggcaccattacgccattgcctcatcttgtcccctatccgcaaagtgttcacccttctgagcccctcaactcgagggttgatatcctttgcataatgccgttatcacttctgttttacgtatagcttctgcgctgttcccatctccggcaacacagccggaaacctctgttttccctttttctctgacctacggtttactatgataacctttgcagttatgaaaacaaaatgaaacagaaagaacccacaccccctcccccgatacgttttttcgtcccctctcacggggacaacgctttaaagcctgatattcaacggtttgtcaacgattgcaaaatcaaaaaacacatgctgatcattgaatgaaattcatcattcatcagcccccgattggcgtgtcatgaaacacatcactgcaaattgtttcattttttttcctgaaaacgtatgccacacaccgtgactacagtgggggtatcccttatcaatccaccccaggccatcacaatcagcccgtcggcattgacgggctgcggaagggtaatgagactcggctctcagcggccagtgccgtacacggaatcggtgccgcgcagcacgagctgtgcacgcacaatctcatgcgcgttctcaagcggctcgccttcgataagcttcatggccttctgcgcggccgcgcgacccatcgcatacggatcctggcgcatggtggtcaggctcacagtgtcggcgtacggcgaatcgtcgaagccgataatcgaatagtcactcggcgtgtggtggccgtaacgttccaaacgcaacaccagcggaatcgccatcatatccatctggcagcagatcgcgtccgggaactcgtccaacgcaagcagcgcggtcaacgccgagtcggcgaaggtcttgccacgcggcacagagacgacgcgccacttgaagtcatgggaggcctccatcgtcttgcaggcgcggatgaagccctgtcctcgcgcatcgatggaggaattaatggaatcgaccgcatcggagcacacgtacacgatattcttgtgccccagattgatcagatgctgggcggcggtgaacatgccgtcctcatcgtcgatggagatggtggcgtcgaagccgttttgcgtcggcgtattgatgccgatgatcggcacgtggatgcgcttgagctgctggatttccttcggatccacgccgaacgacgtcacgaatacggcgtccacgttgcggcggaccggcagattcgtgaagaagtcgcggcggttttcggcggtgtcgacgtgctggaacagcgatacgtcatacccggcattatgcatgacggattcgattccagcgaacacttccgtattgaaccagctagtgatctcttcattcatcagcatcgccacacggtacgtttgacccgatttcaacgatgtcgcggaacgtgagatgttgaaatcaagcttgtcggcagtttccagcaccttgcgacgtgtacgttcggacaccagttccggccgcgtgaacgcgcgcgataccgtggaaatcgacacacccgcggccttggccacctcgcgaatgcctgctctatccatctctcaacccctttgcggtttctgcatcataatcacaaacgttcccagccttggaaacacttgcccgagcggcaatgctctcccacattgctactattatactgcgaacgttgtcaaaaatcacgctaatgttgcaccaatagcacaaaatatcaaaataactggataagccgcgtaaaaagcccacttcgtccactgccgcttataacccaactcgccgttgtaataatgcacgaatgcaacgccaatgccaggcataatcatcatcaccgcgccaaacaggccggcagtgaacatcatcgaattctcatgctggcgcatcaacgtgaaaatcagcacgaaaccaagcgtcaccgcgccgacgctcatcatatgctggcgcaggccgacgcgcagcagcagatcccacaacagtccgatcaacaccagaccgaccgacaacacaatcttcattgacttctggtagcgcgccgccacccaatccaacacgacaagcacaacgaacgcgatgaacagaccgaaaacagggttctgcgagccaaaatcgaaagccttatgcgacgtgcagaggtcgtacggcacctcacacaccacggcgagaatgaacagccgtagaccatacgcgacgcgactatgtgtttcacggaaaccctgcaccagtagccacgcgtaaatcggaatagcaaaccaagatacgacctcgcttaagaccatcgccgtgagcgacgtcatattattgacgtcggaaccgaaaaacagcggcacaatggtggtgctaccagctgacagagccaacgccacagcgccgatgaccttgagctggaacaccgtcagtccgcggtgcttcttcttggtacggcgagcgccgccgaatccgatctgttcaatcgaatcagctccagcaccctgctcggcatagctttccatatgtcctcctcagttccgcatacggcctttcgtgcgcccaagacgcccagtacacccaagacgcaacctacacgcgtttcacgcgttcagcacgaatttcagcagaccgtcgtagtcggcaccggtaaacgaacataccgcatgctccgacttgggcgggtcgctcatcggcgaaatttccgtacggaagtatgctgcgtcgagaccggcggaattggctccgataatatcgtttgcttcatcgttgcccaccatgagcgcgttttttgcgattacgaactcgcggtcgagagccagcatgtacaagtcgcgggcaggcttgcggattttctcttcgctggagataatcacgtcgtccagtacgttcgccaagccggtcatttccagttcggggcgagtatagcaggcttgtgcgttgcttagcagcgccacgacgacgccggcctcctgcaatgcttcgatcatgtcgagtgcgcccggatacaggcggatcatgctggtgctgccctgccggaacgcccatgcggctttcagcgcggcttgcggcagtgccagtttcttttcagcctcctcactacggttcatcagcagcgaccggtagaccggcaggatatcgaattcatcccatccgttacggacgattgcacgatcggcttgatggaccatttcgcgggcctcaagtttttcgaagcgttcgcgcatttcgtcgaccgattcgtagtcggcacccagttcgcaaacgcagtcatatagcgcctgccaggcggtttcgctctgttcgtctgtacgaatgtcgatcaacgtcccgtagaggtcgaaaaataccacttcatatcgtggattatgagctccggctcccacttctcgtatcctttctggttttccggccccattgccgtatcggttacggcgaccgcagctttgcggtcgccgttttgtagcttccctactgagagtattactgcaaccgccagattgcaaacgtatgcggtggaacaatcaaataatcgccatcacctgcgctcacattgccttccaccggactgacggacgagccgagaccacaccagtatctccgtattccgccaatcggttccaaacccgttacggccacgtcaataacgccgacgtgtctgcctggattggcggccatcagataatcgccgacgcggaacacgagttcgtcgccttccgtatcgacgatattgcgattgccgtcgaaccactgtggatcagacttgcgcaatgcaatcaacttcgcgtaatactcaatcaaatcgcgcttctgccatgcacggttccaatcgagccagttaagctctttggcggaatcgtaagaatcagagctgccgaatttggtacgtgcgaactcctcgccggacagcatgaacgggatgccagcggaggtaagcgtgatacccacagccagcttgttggcgtccatcacgtcggtcagcgcggccgcaatctgcggaccgacaccggccaacccttccgccgagaaatcggcgtcatacatgacttttggcacatccacggtattttcgttaacaccttcggccacggtgctgcccaacgaaccagccgcaaagctcgcgcacaacttgtcccacagcgtgaggtcgtcgtgcgcggacacgtattgaatgacctggcctgccactccttccgaatgtttgccgcgacgccacgcgtccacggcctcacgcgcagccgctacgttctcgtgcatgccaccgttcacataacccgggcggtccgagaagaacacatggcccttgatggtgtctcgcgtggtgtcgcagaagtggccgatgcgactgtcaagcttcgacaggcctgacttgtcagccagcacggtgtcgctgggcagcggcgcggtggcgcccgcggaccacggttcgccgtacatgagaatgtcgcgtccacggccgggaatctcatccagagcagcacgcacggcattcatggtgtccacgtcgatcagacccatcaggtcgaaacggaagccgtccatgtggtattcgcgcgcccagaacgtcacggattccacgatgaaccggcggaacatcttgcgttcggtggccatatcgcagccgcagccggatccgttggccagcgcgccgttgggcttacggcgcaggaaatagtccggcaccgaccgctcaaaccaattatcgggcgagaacatgtggttgtagaccacgtccatgatcactttgatgccggcgttgtgcagcgcctgcaccatctgcttcacttcgcggatgcgcaccgacccgtcgaacggattggtggaatacgagccttccggcacgttgtaattgaccggatcgtacccccagttgtagcgatcgcaggtctcttcgtccacggaaccgaaatcgtaaatcggcatgagctgcaccgcggtgacgccaagtttcttgagatatgcgatgcccgtgggaaagtcgggatgcccgtccagagacgtaccgtcgtcggtgaacgccagatacttgccgcggtgcgattcggggaaaccgccggcgggatcattgctgaaatcgcccacatgggtttcccagaccaccgtctgcgcaagcggcacgtccggcatatggtcgcggtaccaaccatccggattggtgcggctgaagtccacgaccatgctgcgccggccgttcacaccggccccgcgcgcccacggatcggcgacgcggtccacggaaccgcaatcgcgttcaatcaaaaagtcgtaatacacgccgtgcttgttgtcggcgaaatcgtacgtccaggaaccgtcggtttcaggacgcatcaggtactgtccgatcaaagcgtcgccgctttcccccatggagccacgcgagaacagtctcagggtcaccttctgtgcggaaggagcccagagagcgaactgggtgccggtttcagtaacaacggcacccagcggccgttccagacacagcgggaacggttcggcgacgctcgtgttcggctgtgcgaagctgtctacgagcgtcatatcctttgcctttctttagcccttcacggagcccgacatggactcctgatagaagcgctgcatcacaatgaacaggatggcgatcggaacggagatcacgaccgcggccgcggcgaagcgggcaaaccagttctggatatattccttctgcagcatgagccacaggcccaatgccacggtgtagttggattgcgtacggcagatcaccttggccatgacaaagtcgagccacggggtcaggaagccgatgatggcctggtagacgatcatgggcttgcagatcgggatgatgatcttatggaacacctggaaacgggtgcaaccgtcgagcagggcggcttcgtccagcgaggtcggaatggtgtccatatagcccttcatcacgtagaagccagcgccggaaccggcggagtacacgagaatcaacgccacggtagtcatggtgccgcttgacaggcccaaggccttcaagatgaagtagatggcggtgacggccatgatacccgggaacatgccaagaatcagcacaacgttcatgaaagtcttgcgcacacggaaacgcatacggctcatgcagtatgccacagagagcacgaagatcagagaaatcgcacaggtgaagcaggcgatgatgaacgtggtgccgaacatcttcgggaagtccaacacgttgcggtcggtgaacagcaccctatagttgtccagagtccactccttcgggaagaaggagctggtgtacggggcggtgttcttattgaacgactccgcgaacacccatacgattgggacgagccagatgacggccagaatggccaggaacaagtgggcgaacacgtcgccggtgatacggcggatcttctggtcgtgcagaaggccgtggctttccactttggttgcggaatgcttgttgctcatcggaatgcctcctcattcttataggagccggaattgcggtaggtgatcagcgaaacgatggccaacacgacgaaggtcatgatgccgatcacggcaccgagattgtaatcctgcttgtccacggtcagcttgtacagccaggtgataagcaaatcagtggagcctgcggaatcgcccaatggcgtaggatcgccgccggacagcaggtaaatgacgttgaagttgttcacattgcccgtgaaggtggtgatcagatacggggtgagcacgaagataatgtacggcatggtgatcttagtaaagatctgccaccagttggcaccgtcgatcttcgccgcctcatactgatcggccggaatgttctgcagaataccagtgatctgcatgatggtgtacggaataccgacccacaggttgatgacgattacggtgacacgggcccaagtggcgtcggtgaagaacggcagcgggccgtcaatccaaccccacgtctgcagcatgcggttcaccgcaccctgcggctggagcatggtgtgcatgaccagcagggacacgaactgcggaacggcgatggacatggagaagcaggcacgccagaaacccttgaaatgggtggtcttgcggttgatgatcatggccacgaacatgccgaagaagaagttcaggaaggtggcgaagaaggcccagaccaaggtccacaccagcacgcgtccgaacagtgcggcgttaacggtgccgccgctgttggagaagaccttggcgaagttctcaaagccgacccagtggaacagcacgaggtgcttgtggtcatagctggtgaatgccatggaaatcatgaagatcaacggaagcacagtgaacacggcaatgcccagcgtgggcaggaacatcagcaggacgtgagccttggcatcgagcagctcgcggacatcgtccatgaagctcggagccttgccgttctcctcgagcagcacctgggacttgtatgcagagcgcacggacatgacccacaggccgatgaaggcagcggtgataaccagagtggcgacaccgtacaacaggatgaccacggaacggtcaggttcggtgtagacccagaagccgtcgaccagcttcttgccgcctgcattggtgcccaaggtcggcaacttggaaagatagtccacaccattgattgccatgaacacgaagtatgcgatttccagcgccagcatggcaatgcccttgacatactgcttgcgcacgatatcgccaagaccaaacaccactgcggaaagcttagtgaacaggtcaccacgccggaacgccgcccttaccgtgtaaggcgacggagaaacataatcagcaccctgcttccgaaggcgcttcatctcccgcggggaaagagttgttgctgtcatttcgactgccctctcatatggatattgaaagataaaaaaagctttgctcccggacaaggggaaggagaatttaaaaaccttgcccgggaatgcaaagctcggaggaggagtgagccactatgcaaagtggagagagacaccgcgactcgaagcgtctctcaaagctgcaggatggctggggggatttggcagtgccaaccacctgcattcttcagttattggatttttagaattactgatttcactcagcgatcttgccaccggcctgcttgacccaatcctggtacttggcggcagcgttgtccttggtgatttccttgttgaccagggccttgccgaaggtttcggccggagtccaccaatcgttcatgccagacagaccggactgcaggagggcggtgttggccatggtgtcggcctgggccttggctgcgacgtcgtcggtggtcagatcagacagggacttgtcggtcggcgggatggcgcgcatctcgtagtgcagcttctgagcttcggtggagccgaggtaagccgcgaactgagcggcggccttcgggttcttggcgttcgggttgtaagcagcggccttggtggcggcgaaggacttcatctgcttcttctggccgttcacggtgaaggtcggcagagaggtggcggcgtagttgtcacccagggcctccttcacgtccttagcggaccaggtaccggagaacagcacgtcggcggagccatccttgatggctgcgaggccggaagcgccatcgtcgttggagaagttcgggttggcgaccacatcaaccagataagaggtgatatcggcgccgtccttcgggaagaccatgcctgcgtcagcatcattgcccttctcgccgaacaggctcaggccatcatagaagccgttgatgtaccaagaattctgcagggagaacgcgaccttggccttggaaaggatggtatcgaagtccttggcctcatcctcggtgatcttggacttgttgtagtacatgaaccacgtgttgtcggtgtacggcacgccatagagcttgccatcggtgccggtgacggagttgacttcgaggtcgccgttctgttccttcacctgcttctcagcgtcggtgcccagctggccaatggccttggcgtccattagaacacccaactgatcggaagcgaacatatagacatcggccgccgcggacggatcagtgctgacctgcttggaagcatcgccttcggagaccacgtcattcttccacgtgatattgtattccggatgcgccttggcgaagttctcttcgaccttgcccagccagttggtgtccttggcctggtcttcctgcggggcccacacgctcagcgtgacggcctcggtggagccggaagcgttcttatcgccaccgtcggaggagccaccgcacgcagcgagcggaaccagcatagaaacggcagcagtaagtccgattgccttcttccaatcgatcttcattgatcttcctttcctcacataaccttgtgttcctcaacatctccggttaaatggtacggaccaaaaccctgcatacgttcacatcatcgttcttggatgattaccaacaacactggggccaccaaaaatgtatcagtgattgttagtgtagcacgtttctgccaacgtttgcaattcagcgttatgattgtttcaaagaaacaccgcaaaccgcgaaatatcaaggagacacaccctcatgcttccccccgcgaaacacccccaccccaaatggcttgccgacgcaattttttatgaaatctatccacagtccttcgtcgactccaatggcgacggcatcggagacatccccggaatcactttaaaactggactacatcaaggatctcggatgcaacgcgatctggctcaatccctgtttcgactcgccattcaaagacgccggctacgacgtgcgcgactacaaaaaggtggcatcacgctacggcaccaacgacgatctcattgcgttgttcgacgccgcccaccggcgcgacatgcacgtgatcctcgatctcgtgccaggccacaccagcgaggaacacgagtggttccaccgcagttgcaaggtcgagcgaaacaattattccgaccgctacatctggacagactcatggatctccggtggcgacggactgccattcatcggcggcgaatcgccccgcaacggtacctacatcttgaacttcttcaaatgccagccggcgctcaactacggtttcgcgcaccccgaacgtagctggcagaagccagcccttggtccggacgcgaaggccacttgcgacgcgatggtggacgtcatgcggttctggctttcccgtggcgcagacggcttccgcgtggatatggccgacagcctcgtcaaaaaggacgatgagggcaagccttacaccatccgcacctggcagtacatgttcgcccggatccgcccggccttccccgaagccgcgttcgtttcggaatggggacggccagaggagtcgatggccgccggcttcgacatggatttctatctcgattggcgttgggacggcgttcccaacggctacaacatgctgttgcgcaacgtggacgacccgttgagccgcaagggcgacaagagctatttcaacgccgattccggcacgccgatcagcgaattcctggacgagtacgagccgcgtctgcgcgaagcggaaacggccgacggaaattttaatttcatcacctgcaaccacgacaccgcacgcgtggcgccgcgactgtcgcagcgcgaaatcgccctggcatactgcacgctgttcgcgatgccgggcgtgccgttcctgtattacggcgacgaaatcggcatgcgataccgcgcactgcccggcaaagaaggcggctacgtgcgcaccggttcgcgcacaccgatgcagtggggtgcgaacgacgcatccggagcacttcacgtgtccgattctgcagaatcggacactcgggctggcgatgtgaccggtggcagctacctgcccaccgacccgtccgccgacgccccgaccgtcgccgcacagcaggccgacgccgaatcactgtggcatacggtgcgctccatactccacgtcaaggggaaatgcgacgccttgcggtcgggggctacgttccatgcaatcgaacgcgatagagtgttcgttttcgagcgttccacccacctgcagaagctgatcatagccgtcaatccaagccgcgattgcaaagctttgcagttaccagatggtagttatcggacgattttcagcatcggcgaaaacgaaattagcggcacttcgctgcgtctaggtctgcaaagctttgcaattctcgaagccgagtagcagacgagcaatgccccgttggaataatcgtttgcaatgcggagcgctgcgccttcgtattgcaaacgatagtcaatatggaaaaacaattccggttatctatattcctgaaattagagcaaaatcgcaatatagcaacactctcttaccgcaaaacacgctttgaaaacgatatcataccgtgatatagttatctttggtgcgaatgccaccagcatcgaagctgcggcaatcgcaagcaatgtagcatgtcagccgtcacaaacggcgcggaaagaagggacctatgacacagacccagcagaccgaaagcgcagaacgcatcgcacggcctcttatccagctcgccaagctcaatggcatttccacgtcgtatatcgaccagctcggcacctatgtggaaatccgcgacgaagtgctcgtctccgtattggccgcactcggcgtggacgcatccagcgacgaagcgatcaccgcctcctatgcggcgacccagcagcgcatcgcagacacacttgttgagccgaccgtcgtgaagttcatcggcaaggaagccgtcacgccaatccgcgcgaaaggaaacgacgtggcgctgaagctgacgttggaagacggcacggaatatgcgggcgatctgaccgcgtatctgacgggctcgaacgcagatgacggctcgctgcaactgacgctgccggacgatattcccgccggctaccacacgctggccgtcgatgccggcccgctgcacgccgaagccgcgctgatctgcgcaccggcacgcatcgaactgccgccagcagtagcggaaaagcaacgttggggctggatggcacagatgtattccatccgttccgctgaatcctggggcgtgggcgactatggcgatctgaagctgctgctgtccgacgcggcaacgaaatcgcatgccgatttcatgcttatcaacccgattcacgccaccgcgccggtgccgccgctggagccgtcgccgtatcttcccgaatcgcgtcgttttctcaatgtgacgtacatccgtccgcaggatatcgctgaatatgcggaactcaacgaggcagaccaggccgaagtggcgcgtctgcacgcggaagtctcgccagccaacgacagtatcgagccgctcgacatcaattccgcttggtggcacaagcgccaggcgctgcagcttgtgtacaacgtgccgcgttccgtcgagcgtcaggccgcgttcgacgcgttcaaggaggccgcgggtccggatctgcgcgcgttcgccgcatggtcggtggcgttccaggtgtggggcgcgccgtgggaaggcacgtggttcaaggacacgaaccgcgattcgcctgaagtggtgaagctcatgcgcgagcacgccgatatggttgatttcgaatgctggctgcagtggatcgccgacgagcaggtgacagccgcgcagaacgccgcccgtgacagcggtatggcactcggcctcatgcaggatatggccgtgggcgtgcactcgctcggcgcggacgtgtggtggaatccggaacgtttcgcagtaggcagcgtaaccgtgggctgcccaccggacttctacaaccagcagggtcaggattggggccagccgccgttcaatccgaattatctggccaaaactggttatggcgtgtaccgcgagatggtgcacaacatgttctcgcacgcgggcgcggtgcgcatcgaccatgtactcggcctattccgtctgtggtggattccgcagggcgaaggcgcgcgcggtggcgcgtacgttacgtacgactatgaggcgatgatcgcgatcctgaccattgaagcgtcccgcgtgaacggtttggtggtcggcgaggatctgggcaccgtgcctgattacgtacgcacggtactcggcgagcacggcctgctgggctgcatggtggaatggttcgcccgcgtggacgactcccccaacgccggcgacccgtacgccgatccgtccacgtaccgcaagtacgcgctggcttccgtcaccacgcacgacctgccgccgaccgccggctacctgcagttcgagcacgtcaagctgcgcgaacagctgcacctgctgtccggcccggtcgaggagttccaggcttccgccaccgccgaacgcgacgcgatgatggaccgtctcgtggagtccggcctgatcacgccggaagtggcgggcgatgtggaaggccacatccaggaaatcgtcgaggcgatgcacaagatgctgctcaagtcgccgtccgtgctgctgcaggccgcgctggtggatggcgtgggcgagacgcgcacgcagaaccagccgggcacgtccagtgaatactccaactggcgtgtgccgctggcaggcccggacctcaaggtggtgcacaccgatgaagtgttcgatctgccgcgtgtgcaatcgcttgccgccatcatgaacggcgagaagtagcgtttagacttaccattcccctttccttacaaaccaaaattccggtcctccttgtggagggccggaatttttcatatacgcaaggcgatttgggagcggccaggttcagcggtcgatcagcccagcagcagccagactgaggcgtcgctatccagcttgccgtcatccgtcaacggcacggaatttgcgatggcgaccgcatcgtccggcagggcgatcggctcgtcgccgaaattggtgacggacaggaatcgacggccttccgtggccggacgcgagtaggcgaccaccgtatcgcccatgtccagcaggtcggcggacgtgtctccggttgccgtcagcaccgtctgtcgcaactgcaacagcttgcggtacaagtgcagcatggaaccgttgtcatcggcctcgacgtcggccgcgaaatccttgaaccaggccggctgcggcaggtgcgcgtcggcggaatcgccctgctccgggccgaaaccgaacgtgccgccggtgatgaagtccgggctccacgaagccggttcgccgcaatcggcagccttccacggcatcggcacacggcacccgtcacgacccttgtcggtgaagttgcgacgggtgttgaacggcgtcggatcctcaagacgatcccacggaatgttcgccacttcgaacaggcccagttcctcgccctgatacacgtaggcggaacccggcaggcccagttccatcagcgcggctgcgcgggcgcgacgggtgccgagctcacgattctcgcggtaggtctctccgtcacgcaacagccaatcgtgcgccagctggtggtacggagcgtccttcacctgcggcagaccgaaacgcgacggactgcgcggcacatcgtggttgttcataacccacgtcgtggtggaaccgtgcgtttcctcggcggcgcgcaagccgtcagcaatggccgtacggaactcgtcggcgaaccagttggcttcggcgaactcgaaattgaacacctggccaagctcgtcggtggacgcgtacagatgctgcgattcggccttcacccacgcctcgccgacggcgaaacgcggcggattgtactcgttgaacacctgacgccattcgcggtagatgtcgtgcacttccggacggtcccacagcgggctgaacgcgccgtccgccggcagcacatgctgcaccgcggccggatccatgtcggccagcggcacggaatcgaggtccttggccaagccgtgcgccacgtcgatgcggaagccgtcggtgccgtggtcggaccagaatctcaacgttttcttgaattcctcgtgcacgtccggattcttccaattcagatccggctgctccttggcgaacatgtgcaggtaccactgtccgtcatcgacctgctgccacgccgggccgccgaacagcgactgccagtcgttcggcggcagctcgccgtgctcgccgcggccttcgcggaagatgtagcggtcgcgtgcggccgaacctcggccggcggcgagcgcctcgatgaacatcttgtgcttgttggacgtgtggttcggcacgatgtcgacgatcaccttgatgccggcttcatgcgcggcggcggccatcgcgtcgaaatcggccatggtgccgaggcgcgggtccacgttgcggtagtcgatcacgtcgtaaccgccatcggccaggtcggacgggtagaacgggctcagccagatcgcgtcgatgccgagattcttcaggtaatccattttctcggtgacgccggcgatgtctcccaacccgtcgccgttcacgtctttgaagctgcgcgggtagatctggtagacgacggcttgcttccaccaatcgtcacgcatgttgttcgcggtcattatgcccctttcgtctgtgcctgcaaccgttgtaccgctgacaacgatagcattgcagggcgtctgctgcgggggcgcgcgggcaatcgcgtttccgtttgcgcagaccggccggcggtgcgatcgttcgtgccgtcgttcgcgctgcgcaaaccatcagatcgtgtcgccgaccgcacgaccgaccgcgccacacaaaccggtcagccgcatcgccgttcgtacagccgaacgcgccgcacaaaccgaccgaccacacgatcgaccgcacggcgcaaaccggccaatcgcaagatggcgtgcgtcgagtagaatcgcaagaagatccgacttgcatacgttgctatacggatgccatacgaaaggcgattatgaagttcctctcccccgattccggctttatgcgcggcctgagcgacgccgtcgacgcgatctggatcaacattctgatgctcgtcaccagtattccgatcattacgatcggcgcggcgctgaccgccggccacgacgccacccgccgcacgctgtccggcgaaggcacggcgacgcgcaactatttcgccgccttccgctcgaatttcgcgaaatcaaccggctactggctgattttcggcacgaccggcgcgctgtgcgtctactcgtggatcgtgctgcagatcacgccgctgctgattccgaaattcgcgctgacgatcgtatggctgatcggttttgaatgggtttgggcattgcaggcacgtttcgaaaactcgttttggcgcacgctcggcaacgcttttgtgttcggcgtgagcaacatcgggcatacgttggcattgattgcgattgacgcggtgtacgtcgcgctgctcgtggccagctggttctacatgccgcagggcctgttcctgctgctcgtgctcggctacggcaccatgctgatgctgcattcgccgatcctcgagcatgtcttccgcaagtacatcagcaaataattaggcacgaaaaaagggactgattcgcatcagtcccttaaatttttctgggtgaaaatcagcccttcaccgcgccgccttcggccctgcaattaaggaccgcgctacgcgcgggctcaacgttaccctcgcggcatagccgctcgggctggagcctgggaacagcgcactgcgctgttccctaagagctgatcgaagatcagcccttaacggctccagccataacacccttgacgatgtacttctggcagatcaggtagaagatgatgatcgggatgatggccatgaccaggcatgccatcatggcgcccatatccacggaaccataaccgcccttcagatactgcaccgccacggaaatggtcttgtacttgcccaggtcgagcgtcaggtacggcagcaggtagtcgttccagatccacatggcctgcagaatagccacggacacaatggacggcttcatgatcggcacaacgatctggaagaagatacgcggcacggaagcaccatcgatcatggcggattcttccagcgattccggaatgcccttaaccacaccggtgaagatgaacacggccagaccagcgccgaagcccagatacacgaagcacagaccccacggggtgttgagcttgagcatatcggccagcttggagagggtgaacatgaccatctggaacggtacaatcatgttgaacaggaacaacgtgtacagcagctttgcagcccagttgttcacgcggacgatccaccatgcgcacatcgaagtgcacaccagaatcagcgccacggaaccgacagtgatgagcagggtccagccgaaactggcaaagaagttcgtggtatcgaggccacgcgtatagttttcaagtccaacgaacgccttaccggtcggcagggagaacgcgttacgagaaatatacgccttctgcttgaaagagttgatgatcaccagcacgatcgggaagatccacgccagcgaaaccaccgcgaacagtacggaccacagtgcgccgtgcttgactttttctccggagttcatgcctccacctccttgctcgtggtgagcttgttctggatgagcgccacgatggccaccagaatgaagaacagcactgccttcgcttggccgacgccttcccagcccatacggccgtagaacgtgcgggtaatgttcattgccagaccttcagacatgttcgacggagcgccgttggtcaatgcaaggttctgatcgtacagcttgaagccgttggtgacgcacaggaacgagcatacggtgatcgacggcatcatcagcggaatgatgatcttgaacatggtctgggtgccgtttgcgccgtccacggaagccgcttcgagcacgtcggtcggcagcgactgcatgcctgcgatgtagataatcatcatatagccgatctgctgccagcacaccaagatgaccaagccccagaagccgtaggttgcgctatacgtcaacgcgcggccccagtgagcgagaatgccgttgagcagcagcatccagatgtagcccaggataatgccaccgatgaggttcggcatgaagaacaccgaacggaagatgttggagcccttgatggccttggtaagcatatatgcgatggcaaacgcaaccacattgatcacaaccgtagtgacaatggtcagcgccgtcgagaaacctaacgcatgcaggaattccttatccgcaagtgccttctgatagtttttaagtccaatgaattccgagtcagtcacagttgtgaacttgcagaaactcaaatacacacccatgatgaacgggattacaaacccgatgataaatgcagcgaacgtcggtagcgcaaacagagcccaccactttcgtatcgctttgccggccatgctgatcatagcttgcctgctttctttcctctccattccaacaccgcagcaacgcggcatggaaaaccaactgccccaaatcggcgaatcactgcattgtttttcgcctttttagtttttacagttgttataataaacagcgcgacgcgaaatgtcaaacgttgtcatttttacatgtcataaatcatatattctgcatcgttgtcatagtattgacagcctgaaagcattgtaaatatcagccccgcaacaactgtggcacaaatgaaaacgtttgtaatccaacttttgcaagagtgtttcaatacagtatgctgaatatccagtagttctactatacaaggggtcaccatgaaaagcagcattcaagacgtggcacaacttgcgcacgtctccatttcaacggtttctcgctccttcacacgtcccgaccttgtgtcgaaagccacgcgtgacaaagtcatgaaagccgccgacgaattaaatttttccatctcgcgctccgctgcagcactcaaaaccggccgcgcgctacgaatcgcggtgctgatttccggccgactcaatctgtggttcagttcgtccatcatggaaggactgaacgaatccttccatgatgaaggctacgacatctcaatctatcagatgtccagcgccgaggaacgccgcgcgttcttcgacatgctgccggtacgccgcaatgtcgacgccgtaatcgtcatttccttcgacatcgacagcaacgaaatcagacaactcaggtcagtcgatgtgccaatcatcggcatcaattcgagcttgccggaagagcgcggcttcaacgccgccgtgcgcatcgatgacaagcagggatccgaattggccgcacgccacttgataacgcttggccatcgcgatatcgcttacatccgtaccgaccgtgaagtgacgctgcacttcagcgtgcagggccgtttcgattcgttcatgacgtgctgcaagtccaatggcgtcgaaccgcgcgtgttcgttaccgacgaaggcaagaacaacatcagcaaagtcgtcacgcagctgctcagctcggaccacatgcccacggcgattgcctgtcaggaagacggcatcgcaattccgctactgttccagctggaacgcaacggtttcacaataccgaacgacatctccatcattggctacgacgacagcacctacgctcgcgatctcggtttgaccaccatccgtcagacaccggtcgagatggcacacgaggcggcccgtatgacgcttgccctgattgacaagcagccgcttgacgagccgttcaagacgtttcccgcacagctaatcgtccgatcgaccaccgccagactgcgtcactgacgtttgccgcacattgcgcacacggcaaacgtacgaaacacagaaaggccgtcatcgcagaacattgcgatgacggccttccgttgtctccacaaccggctggggcgaagagaggaaaggaaaaatcctcgacctcagctagcttattcagttattgaattgcgatttgcaactcatggtgcaacacaatctcagtgaacagcgtcgtactcagtcttccaaccgtcaacaaacgcggtcttgacggcatcccagtcaccggtaccctgagcgtattcgaggagggcggaaccaagcttgttcttccactcttcggacggcatcatggtgaagttccaagagactgcggtcttgccggagttctgatcatcaacagcagcctggaccagcggattgtcggacttgacgtcgctgaaggacttgaacggggtggtgaagcccatgtcgctggacagagacttgatgccggtcttgctggtgacgacccacttcaggaagtccttggtggccttcttgtcagcgtcggaagccttggagttgatgcaccagtagttctcggaaccggtggccagaccctgcttctcttcgcccttggcaccgatgtagatcgggatcatgccaacgctgtcagccttcatgccggccttctgcagatcggaccatgcccaggtgccgttctgatagaacacagcctcgccgagggagaactcggaggtagaatcatcaccggtcttggagctcagctgggtcggctcggtggtggagtccttcagatacaaatcgaagatgttcttatattccggcaggtaggtgcccttgatggtctccggctgcttggtgacgttgtcatccttgaactcatagtaaagcggcaggttagccaaatgggtcttgaaacgccagtcggagctggagtcgaagccggcggaggtgaacgcgcccttgacaccaagctggtccttcttagcctggatgtcatcggccacggccttcaaggtatcgaagttgtcgatgtcatcgacgctcttgatcttggcgccgtcagtggcaatgtacttggccagcagatccttgttgtagatcaggccataagtctccatggcatacggaacaccgacgaccttatccccatccttgagggcgacatccttgttgataagctgcttgtacggctcagtatcggacatgtcttcggtgtaggacgaccagttctggtagccgacagggccgttgacctggaacaaggtcggagcctcggacttggcaatctcggacttcaaagtctgttcgtatgtaccggaagcagcggtctggaccttgacctcaacaccagtttccttggtgtaatccttggccagcttcttccattcgtcgctggattccggcttgaagttaaggaagtacaccttgcccttgccgttatcggaacttgagctagaaccaccgcaagcagccaacgtgccaacagacattgccgcgatagcgaccattccaactgctgccttaatagtacgattcatcatcgaacctttctcttccattcctgttcccagcttctcgttgggaaacaatttgcggtatcgcgtcatcacgattcctaacaaccactattatgccgcattcccccgatttttgcaaacgtaggcaaaatgaattcaaaagtcagacgtcataccatcgaaagaaatcccgaaaatcatttattttcaatacttttagagagcatacttttatgcaagcgtttgcgacacgccgcagcaaagtggcaagtcatgcatgcaataaagaggcggttccaaggagggaccgccataatattcagcgatatcaaacagttccgttcaataattcagcaattccaatgttcgatgacattgtcacctttatattggcttaatacacaataatgcgcagtgtccaatcgcagcaaccgcgcgaaatgcggatcaacaccgagccattgcgacgtcaagatacgaagaacgtgcgcatgcgccaccagcagcacatcgtttccagcgtcgagcaacggtttgaccgtggcgatcgcctcacgtgtgcgcgccgcagcttcctccaccgtctcacccggaccgttgtgcacgggcacctgctcgccgttcggcaaagtttcaatccaatcgccttccaacgattcgggaagtgcctgcggaccgtcgcgccacacatcccaagcgaaaccgcccaccgcactcacttcctggcgcgtacgcccttcggcacggccgtaatcccattccgcgatttcagggagcacatcgaaatcgccatatccggccagctgcgccgtctgctgggctctgcgcaacggactggcgaacatgcacccctgcgcgaaaccctggggaaacgcctcacgcaaccgttcgccggcggcacgagcctgatcgcagccaatgtcagtcaacggaatattggtgcggccggtgtgctgtccggattcgctccacacggtctgcccgtgacgcagcagcaccaagcggccaggggtgattgcggaagcggcattgcctcccagttgagtttcagtcatgtctctactctagccgacgcaagctgcgttttcatcccattccgccacgtgtcccgcacatattccggcatgttttccgacgcgttacactggtttcatgagtgaaatgccgaatatggaatccagtgcggaccgcgtggtggcggccctgcacaccgtcgacgagaaggtgaatgcgatgcgcgaccagagactgaacgatcccgattcatttggcgataagattttcaagtccgtcgtgcccacgttggccggactggtgctcggcaaggcgttcgagatggtgtggaagaaaagcgtcggtcgcaaggccgtccgtgccgacggtaccaagaacgaagctgcggaagcggcgctcggcatcgtattcgccgtggtttccgccggtttcggcgcgctcgtatcgcaactgtccggtcgcgggtcgaaggcgattgtggacaggcggcacgcacggcaggcgcatcgcaagtaaatacgtcgcaaatatcgcaaagcagtctcaagtagatatgttctcacagggagacggatttagcccgattcccttgcaaaatcgcgccgcgcggacaacaatggcggtatgagcaacattcttcataacgcaaccgtcgacactctgctggagcgtcgttccatccgcaaattcaagccgaagccactgccggacgacgtcgtcgaaacgttggagaccgtggcgcagcatgcggcgagcagccagttcctgaacgactggtccgccatccgcgtcaccgagccagccgccaagaagcgtcttgccgaaatcggcgggcagccgtatatcgcgaccgcgccgctgctgtacgtgttcgtgctggacgagcatcgcaatgccgcgatcgccgcgcgcaagggcgtggaagtggcgtccgacgcgttcacgctcaatggcagctatcgtttcacgcaggcgcagaacgacgcggttctggcactgcacgcgatggagacggccgcgtactcgctcggcttgggttgcgtgattctcggctcgctgctcaacgatgttcccgcgctgatcgacctgctgaatctgcccgaatacacgtacccggtgctgggcattgcaatcggcaagcccgatcaggagccggccgtcaagccgcgtatgccgcgttccatgcagttcttcgagaacgagtatccaagtagcgatgagaagctgctgtccggcttggattcgttcgacgtcgaagtacacaagtattacgatttgcgcgatactgaacggccggtggacgcgttcagcgaccagattgcggcaaatgcgatcgacgagggcgtgaacgccaaggccgttgccgtgcaggcgaagcgacagggcttccgtttggagcggtagatacatggcagcgctcgtatcattgatacgaagctgatacaacacaaggcccggtggattgcaatgaatccgccgggccttggttttatatgttgccttgttctcggtattgtcctgttatgccctgctattgctctgctattaccttctgcggggcttgtagcccttcttgcgggaatgtggcttgagctgctggttaagcggaacatgcatgtagctggattgtggatcgcgatgcgtgagatgccaagtaccgcagaaatcgcaacggtatacccaaagctcagtgccgcgttcgcgccaactctggtcggcggcctgctgagccgttgccttgtcgtgatacatgatcttgttcgactcggtgcaacgtttgggtacgaagtaatgcatagttgcccagtctataaacccattgcgataaaacgcttgcgccctacttgtgttcagggataaaaaaatggggttcccggagcgtaagctcgacgggaacccccaacatgtgaagcggcggcgtgctactctcccacaccctctcgagtgcagtaccatcgcccgccatcggacaggtccacgctgtaatccgactgatcaatcctcacagacttggtcggggtgaccacgcaattgcgggcctcccaggtgccggacgaagtgttgccgtcccaagcgtaattgccgtcgatcttgaggccagcggcatctacgccttcggtggtgtcggcaggatacttcttggtattcgtggcattgccatcgttgaagatgatgcgcgtattgcttccctcaagatcgtcgggaatctcatacttgtactcgtcatccttgccgcaagtgtctcccgaagcgacctgtgtcatcggctcgcccggccacttcgcgttttccttcaaagtggtggcgctcgaatcgtctacatacacataggcgtacaggttgctccacgcactcggcttcttcgcataagccgtgctggtggcggccggatccttcttcgtgtacttgtatgttgcggagaccgtttggccatccgcatccttgccctgcagtttcacggtgatggtgtcaccgattgccgtggaagcgccgatggtgatggtgtcgccatcctgatacgagccggacttgccctccgaagtggtgtaggtggcatcggtgacattgttcgcattcagggtaacggtagtggtgtctgtcttgaacgagctgtcgcccggggttgcggagaccgaaccggaattgtcggtgaagaacacactgatcttgccgccgggagcagagccggaagtgatcttgccgccggaaacggtgatggtaccgccggagacctggtccttgtaggtgccgtcgtcaaggttggtggcagtgccggacagttcttgcgtatcacccatgttggtgatggtcacgccgtcgttcttgaagttgccgtccttgatgtagcgttccaccatgaggcaggaattcgcgccacagttgcgcagatactccgaagccttgttgttgttcatggtattgcggaagtggttcaccgccacaacctgcgcatccttccaagaatccgcaccggcatcgccgagcttgcttttctcggcgaactgcggctggctgccgccggagccgaccgggcggtcgaagtacagcggcatggtctgggagcgggaaccgatcacgccccagcccatggtcatctgccactcgctcatgccggtggattccctatcgctattggaatagttatcatgcgattccacccaagagacaagattgctcgggctggcggagttgctccaatcggacagggtgccggcgttcaggttcttcgaattcagggctccgcgcagcttgctgccgtaggaggatgcggtgacgccgccgccgttcttgctgtggctggagaacagctttgcatagtcgctatcgcgggagatggaatcctgcaacacttcgccgtattggaactgcgcgccattgttaagaatgatgttccaatactgggagccgttatactcgtccggcagttcgatgtgcttggccgcatcgaaacggaacccgtccacaccgtcgttgaccgcttgcacgaggaaatcgtgcatcatgttggcggtttcggtgttctcagtgttgatgtcatacaggccgagcagcttgcagtgggtcacctgatagcggttgttccaatcctgcacatcaccgtcattgcagtcgtggtggtagtactcggacttcttccaacgatcggcgatggcgccccaagtcgcggtcatatggttggctaccacatcgacgatgatacgcacgccgtacttgtgagccgtgttgcacaggctcttcagatcatcttcggtacccatcacccagttgccgatggtggtgtcggtcggctgatacacgtagtaccagttctcggtgaagatcatgcccttgccgccgttatgaatagcggaaatcggctcggtctgcacggaggtgtaaccggcttcggcaatagcggggatgttttcctcaatggttttgaagctccactcccatgcatgcagggtggcgccctcgctcatttgctgcgccagtccgtaatgcttgcgcgcctgttcgaacgtggtgttttcaacggtgtcggcgtagctgtcgcgatcggtgctggcctgtgctgcggtgctggcgattgccagtccgccgaaggcggtcgccgcggcggtgatgccgaccaccactttcttgctaatcttcagccccagcctatgccaggccggtgcgggtttccgatgtttcatggctcctttattccttttcttcaatccctttaacgggggttcatcttctttgatagcgtttgcactattgcgaacgtatgctgtttattttataccttttctagggtgctaaagtgcgaaaagccttggaaaaaacaatgaaaatcgttgctgaaacaactctttcatttgtgaaaatgtttgcaaaggtggtacttaattgatggtgttttgtaccaccctaacttgttgtgtggtgggagtatattcggcgatgccctgaaaatgcaatccagttgttgtcgatgcgtcaaccctgcaaatctttctcatttgcgcaagtaggggtacgggggtgctgctggatgtgggcttgtatatgctctatccaatttgatggggtggtggtttgtttaagtggcctatgaagagttgcgtttaattgaatttgccgtgcattgcggtatttctgtatatttcggaatacttgatgatgtgactgactgaaacaatctagtatttgttttcagggaaaggggaatgatggttgagtacattgacacaattgctaactgtgttatggccctgttggctgtggtggcattcatagtggctttctctgagtactgcttgcataagcgcgagttaattgatgtttatctggaacggagtattgcttgttgtcagaaaatgctggaacattcgtctagattttggggatatgctcctattttttgtggtaatgctgaacttgccgctgcccagtattatttatctcggaatccggagttaaagggaagcgaagaggatgtaattgcttctttaacgtataatgaatgtctacttcaagcgcaagaagaacttttctttattgcaaacagaaatggaagaaatgcgaacatttcagcgtttacttgcttcgtatctaaaaattatttgttctctgcaaaatgagtcgcataggaaaaaacgagaaaaagtgcagattcgtaagatttgcattgctttgaatgaaatttctgagagctacgtaggcagtgtttttgtggcttactttgatttctccaatgctgataatcgccatattttcaaaaaaagacataattcgaatggctcctcagataaagaaattcgactttgggaaaatgaagttatcggtcaaagtgaaagcggaactgttcctttgaaaacattgctggactgtaagatggaagtgttaaatagcgcaaatggcgatggtcgctatacgctcaatctttccgatgaacttttccatagcgtggaaaagcgattcatcgattgtcttgctgagctgacaaagctgatgtgaagaaagtctgatgaattttcatgtaatcatgggtaggggctgcggacgttttttggagatgatcatacagccattcctcggctttgcctgtattgtaccgggcccatccaaccaagcgaccgtttgatacgctcgtggttataccagtagatgtattcttcgacaagggcgagcacctcgccgcggttgcgctcctcctaatgctcggggtagaaggcctcgacctttatacgcccgaagaagccctccgctgctttgacgagcatcctgttggcgagctccgcgttggggctgaacccggtgtctttcgtcaaataaatttgcgtgtcgggggccggtaacattttgttggactcgtcattgattccatcaccaccaatcatgccacaagacgagcccgtgtcgacgatccatgatgcccgtgtccgaactccgtcttgatccgcttgtcccgataccagaccatgtagccgtccagcatgtttatgaacccgtccatcgaaacgcccgcgaagctgcgtttgtggaagaactcctgcttgagacggccgaagaacccctccgcggccgcgttgtccggactgcatcccttcgcgctcatcgaacgcgtcagaccatgctccttgcagacgcggatccactcgggccaccggtagtggcagccgcgatcggaatggatgatcggcttctccccgtccttgagtgtggagcacgcgtcggcgagcatgccgttggccaacgccgcgttcgggctcgtgccgatcgtccgcgcgaccggaagcccgtcgtagcagtggattggctacaatgtattagacagtccgatgagggacgaatgacatgagattcgccatcggacaggtccacgctgtaatccgactgatcaatcctcacagacttggtttcgaccggaggctcttcgccgccgatgttggccatcttcacgctgaacatgtcgtcatcggacttctcgaaggagttattcacctgagaaccggtgtccggcagatcagcattgtcgttcattgccagatcgtacggcagggaatccatggcggacagaccgaaggtggctgccagttcgatgccgatgccgctcgaggcaatgcggtcagcggtggtgccgatctcttccagcgggatggcgatctcgtagtgatcatccatctgagcggaattgtggcccttctcgttgaagttgacccacttggccttgttctggttctcggccttcatatcgccgatgaaacgaccgttgttttcaccccagccaccgtcgatgccgatgacatccttgcttagaatgccattgccatagccgaacttgatgttcgacttcttggtgttggtggcggcgttagcagccggaccatacgcagccttggagttcagaccagtctcgtcgcccttgtagatccacggaccgttggagccgttggtggaaatggtcaccacgttattgagcttctgctcgccgccccaagtgatgttggatgcccacagggaaccgccggtctgcagaccgccgttgttgccgatgcgggtgctgtcatccttggtgtcgatggcgatgtggaacggcaggttctgggtctgccacaggtggccttggctcagggggtagtcgtcgccagtgtcgacgacatcctgcacgttagtcatttcccacatgaggtagaggttgtcgtcatcgtaggcgccatacaacgcatacagatcgatcggaacctcatacatggaattcgggcggtacacgcgcggatcgtcgttggcggcgccctgcgcgatcagcatggagctgtcccagtcagcgatgctcgcgtcctttccggcgttgaagttgatggtcttcttgacgcccatgcccaccttgttggtactgtactgcgcggcaaggttctgcttcgggacctccaccttcttcacggtcacggaagcgctcagcgcctgacccttcttgaccttcttgccatccttggcggcggtgccggtcaccttgacggtagcggtctcgccgatggaaagagttttaccaacggaaatgacctttccgtcagtgaaggagccgctctcgccctcggtggtggtgtacttcagattgtcggcatcctgcgcgcgcagcgtgaccttgacattgtcggaggagaattccttggaagccgcttccacggacacgttcggatcggattcgcccttcacgtagaagacgctgaccgcgccgcccttggcggtaccggaaacgatcttatggttggagaccacaagctggccgccattgacctcatccgggtaggcgccatcgtcaagtgtggtgtccatgccggaaaggctcttgtcgccacccatgttggcaatgaccacaccatcgttctgaatgccatcagacgtggagcgctcaatcatcaggcaggacttgtcgccgcagttctgcaggttctcgcccttgccatccatggcgttacggaagtggttgactgccgcgacggacttgttcttccacatgtcgtcaccggcgtcacccagctgggactgctcggcgaactgcgggttggtgccgccagagcccttcggacgattgaagtacagcggagcgccggccctacgggaaccaacgaccgcccagcccatcatgatctgatagtcggtgaggccggtggattccttgtcgccgttggcgtagttatcgtgggactcaacccaggtgaccagctggtcttcgcttgcgccgccggtatcgatgttcttcaccatcttgacgtcaaggttgttcgagccgacagcggcgcgaatggtcttgccgtagttggaagcggtgttgccgccgccatcggaggaattgtcgcggaacatgttggcgtatgccttgtagtcaaggccggaatcgccctgcagcacctcgccgtactggaactgggacccattcttcagaatggtgttccagtagttcgactgcttattgtcgaagacttcggtcggcagctcgacgtgcttggcggcatcgtaacggaagccgtcaacaccgtccgccacagcggtcttcaggaacttctgcatacgatcggcaacagcctggttctgcgtattcagatcccacaagccaagcaggtggcactgcgtcaccttgtaacggttggaataatctttgatctcgccgttggggccgtcacaaccggtgcgcttgtggaagtagtccttgttttgccaatcggggtcgatggcgttccaatcggaggtgaagtggttggcgaccacatcgacgatcacacgcacaccatacttatgggcggtggcggtcatttccttcaggtcggcttcggtgccgaccacgaagttgccgatggaggtgtttgccggctggtacacgtagtaccagttctcggtgaacttcttgccgttggcggcgacttccttgatcttgctcatcggttcggtctgcacggaagtgtagcccgccgcggcaatttcaggcatatgctgcgtgatggtcttgaacgaccacatccatgcgtgcaggatggcgccgttcttcatgtgcttggtcagaccgtactggttacgggccgactcgaaagaaggatttccgatggtgtcctgatagctgtcacgatcggcggcaagtgcggtggatgccacacccataccgccgaacagcgtggcgaccgccaccgttcccgccgctactttcttccaggttttggccgcacgagccttgcgggccgcgcgcctacgctctgcacgggtcatcaactccggttgatcgtcgtgcggaggctcttttctggtgagtgcgttcgccatacccgcgaacgtatgagtgctgagtcgcaccttaccctccctgcttccttgcatctaactttgacaacgtttgccactagcagacgttgcgtcaaaaataccacatttttcctttgaaaaatgaatgatttttattgaaaaatggcggttaaaacgcaattgttttctgctctgttgcaaacgctgtcagcaacagatacactcataccagcaccccgtagcacccactatcgttgcaaattcacatatgcaaacgtttcagaaaattttccaaccaataccaccttgcgacgcaaagcaccctcgccccatcccacgccaccgacagcccacccccaacaatcctgaaattaatctttcaagagatgctcaaaaagggcttctttacctcttatggcatgcaacatgccaatcaaatcaaaatatcaataataaaaaatgggtgaatatcacaaacacgctcggactcaaaaaaatagagtagggccaagctatggtgaatcaatccatggacctaaaagaattatcaggcaacgatttgggagcggatgggggcgggggttaccgtacggtgcttgcgcatgcttttcaggattttacggatcgcaccgttcgtctgttcggcggcgacgcagaacatgctgaattcgcggccatgcgggtcggcgatgtccttcggctggggaatcatcggacgaatcatcgaggacttcttgattaccgactgaagacgttcctggatggtcagtccggcaatcatattgttgcgagcgcagtaatcgcacatattcgcgaaatcgtcaagcaggaacgtgtatcgtacggcggctggcgccaacgtgacgatttccttgcgctgctgcttttcgaagcagaggatcaggtcggcttcgtcggccatctgtcgggtcagtcgtcgggaacggaagccgctcgactcaatgccgacgctttgcataaggcggccgctcgacggatcgatcggatgcatcggcaaaccacgcgtgccggcgcttgacacctgcacggtggtgccgttcagatagtgggtcatcagaagctcgcccataggggaacggcaaatgttgcccgtgcagacgaacatgatgtgcatgcctaaaccccttaaccgttcttccaacgtttcgtgttgcggttttgcgaaatccaccatggcttccgcaacccgccaaacggaaattttagcgcgaggcgttccccgcatgcggcaaatcgtccaatacgcgcagaatcattgcagaaattcggcgcgggcggtggcggtcagcgaatagcggatcgggcgggagccgtggaactcgagcaggttcctgttcaccagttccgcgagcgcggtgttggtcttccgctcccccacgccaagccattcgcgcattaggcggcgcgatatgggtttcggagcatcgtcgaaaagctcctcctgcagcaggaagtacagcatgttccgctgcagttccgtaatgccctgcgttcgcgcataatgttcaagcctcttccgcgcggtgtcaagcagggttttcttctcgccgagcacagagatgatgttcttctgggcggtggcgataaaacggatcatccgatatgagaacagcgagacgtcagaacagttcagcggatgctgcgcatcatcaaacgccttgtaataccggcctttcgcgtcggcgataaccggactcaggctgatcgccgtcggtatggacaggtgcttgctcagctgcagagcaagcaggaaccggcccgtcctgccattgccgtcatagaacgggtgaatgcattcgaaggcgtaatggcacatcacagcccgcagcagcggaggaatcgcctcatccgaaagcaacgccagccatttggtcaattgcacttggatttccgattccggccatgcgccttgatgaatctcccggtcaaagccgtcacacacagagacttgcttggctctgaataccattccgtcaggcttgtcttcctcccgtagttccccagccatcacctgatcgtaaatattacgtatgtcatgcaacgttttcggtagttccaacgttgcggaattttcgccggagagtccgagaaagagtttggcaagctcactcaaccgcttgtgcggcccgtccgcgaccgccgcatccaacgcgtctgagatttccttgcgcgtggtgtgcacggcttctatggagttcgtgctctgcatttccgcgccgatgagttccatcagatacgccctgcgggcaatcggcggcaatgcggcccacagcgattcgacctgcacttccatgccacggaccgaatccatgacgttcaacagttccctgaacgccacggcgaacatctcatgaccttcgaattcaatacctgaccggtatgttgaatagccgttgagtcttttttggtattcctcctcagccgcatccttcggcttggccgtggatgatgacattgccaatgtctgccgtatgcttttgtactccataaccatcatccttataaccgtcatttgtgcagaatatgcaggttcggggtgaatatagactattcccatacctacataatgtcaaaaatgtcggtatagcagcaggcgtgtttgcggctattggtacgttgaggggcatatgtggggatacgtgcggatatgtttgctatgcgcagatatgttcaagcgcagattaggtgcggatcaggcgacttcgagcgtggcgaggagggcgcggtggtcggagccggggatgtatgcggttttgaggttgcctacggtcacgcctttgtcatgcacgatgtggtcgatttcggcgattggcatcatggccgggtacgtcatgtgcaggccttcgcccgcctgctggccggaatccaggaagcggctgccgagcaggtatcggaagctggcgtggtcccatgtggagttgaaatcgcccatcagcacgtacagattgtcgtaatgctgcagttgggcgagcgagtcgagactacggttccacagaccttggttgcgggggcgcggcgagaacgggtggacggagccgaagcgcaccttgctgccgccgaaatcgatcgtcgcggcggaaacgctgcttgattccacgggaatgaggctctgtttggcgttttccatcggcgcggcgctgtacagcacgttcacaccgccgttgtcatgccacgtttgctgcgcggccacggaatacggcagataattggcgattccggcgccgttgagccggttgagcaggtcccatgacacttcctgcagcgcgagcacttccacatgctcgtttttgacgatttcgacgatccgattggcgtcggcatgcccttccttggtgttgaaggtcatgatgcgggcgtaccggtcggacgtgttgggcaagccgtcggacgagacctgcgtgactgcggtgctggccgcgtcggaaatcgtttgctgcggcctgatataaccccaatgccagccgatttgcacaaccacgcacaccacgctgacggtggcgagcaggacgcgtccgcctattgcacggacggctatcgcggtgatcgcaataatcaaagacagcatgcccagccacggcatcagcgcgacgataagcggcacgtaccgtttgccgtcgaggttgttgggcagcatgcgcagcagcatggccagcaggatgacggcggtggccagccagagcaccgcggtcagaaggtgtgtcgctgcggtacggcgggtcatgccatgttgcgcgcggtcgaggggacgactggcgcatgctttgtcgagccgcgcgcccagatcctcgatttcgctttcgcttgtgcgttcgcgttcggcatcgttattgccgccgctctcacgctcgctttcgccggtttgccgcatggttgcctttcattacgctcccgttcaccatacgcaacacggcacgggtgcgccacctccttcccgcgaggttcacagtgcttttacgtgcacccgtaccgcatgccactatgcggacatttctctctcatttcctgctgcggggaatggcggcacttgagcgaaccacgctcaggacatgcctacgggacggcgaaaatacgggtatgggcgagtaggtcaggctaggcggcgtgggggtggacgcgattgagtgcacgctggacggtgtcgcgggtggagccggcgccgttgccgcggacgccgaagaagaccatgaccaccatgatgaagcagatggtggcgctcacgcgcagcgcccactggatgccgaacacgttcgccacggcatacatgcctttcgagccgccgagcgcggcccaacgcacagacgtgaacgtttccatcagaatcaccagcacgggagcgccaatggcaccggcgatctggcggaccgtattcgtcacggccgaaccggcgctcacctcctcgggctccaggcagttcagcgaccatgtggtgatcggcataagcacgaatcccataccgatctggcgcacgaactgccagatggacacccaccagatccatgaggtcatggaaatcagactcatcatgatggtgccgaacagcagggtgatcgagccgatcagcgccaccggacgcgcgccgaaacggtcgagtgccttgcctccgaagaactgcgcgatgcactggccgaacgcgccgggcagcatcaccagaccgctgatcgtggcggaatagccgcggcaatcctgaatgtagagcggcatgatcaccatgatcgagctgaaggcgaagaacgacagcgcggcggtgacggtgccgacggtgaagctcttgtttttcagcacgctcaggttgagcagcggaggctgcttggacgggtcggccgactgccggcgagcgccgtggatctggcgcagcacgaaccagacgatgccgaccacaccgatgagcatggcaagccacaccatcggatgcgtgaacggatacgattcgatgttcgtgaagccgaacataaggccgccgaagccgaaaatcgacaggccgacggagaagaagtcggcttttgcggacgcgtcgcgcgtgccgaaattacgcaagccgaaaatcgccaaaaacagtgaaatcacgccgatgaccgtcagcgtgaggaagatcgatcgccaaccgttcaaatcggtttgcacaccacccaacgtggggccgatcgcgggcgcgacgctcatggccatgccgacggtgcccatcgccataccacggcgcgaaagggggtaaatcgaaaataccgtgatctgcaggaccggccacatcacgccggtgccgacggcttccagcagacggccgatcaaaaccagtacgaacgatgagccgagccaggcgaacaccgagccgagcgtgaacaccgccatcgatgcaatcacgatctggcgggtggagaatcggcgggtcaggtaggcggtgagcggcaccataacgcccatgacgagctggaaaatcgacgtcagccattggccggtcgtcacggaaatgccgaaatcggacacgatggtgggcagtgcggcgctcaactgcagctgcgtgaagttgccgacgaacgtgataaaggtgagaatggcgatcgatacgaacgcggcatgcgtcagatggtcgtttttatacgattcctcgccggtaagtggctgggacaggccgtgggtgcggccctgtttcgcgtttattttcttttccggcttcacttccgacctcttctccggtttcgacggcaaaccgaccgccctccatcactcatccgcgcatactcgcagcgtattgcgcaactcctgcaaaagcagactcaaaaagtctagtactgcgggtggtcgaacgcgagatgaaactattcgaacacgttcaattccaattcaaccgagaaaaattggcaaaacttcgtatttgttcatctcggggtggtatacatatgcgttggcagtaacggcacgatacagggaaggaatacgccgcgcagggggttaggaagtatgaccgtagtcacgttattcaacatagcgatggagctatggggcgttctcatctgcatcgtttgcgcaggtggcgtctacgtgggcgcgatacgtaggacgcggcgtacctatacgaaagtttccatgcagcttctatgtgcgctgatgctgctggccgacgtgtccgcctggtatcacaacggcggctgcgacaagcttgacttctacatgacgcgcatcggcaatcttggtgaatacctgatcaatttcatcttcatcgcactgttcgccaactatatctggcaaaccgtcagcggcgacgacatgcttgaaaacgtcagcccgcacgagtggagggccagaatgagcggcggagccaagcgtaatcgtaagaaccaacgttcggccaatgcccgatccaagccgaaaaagccgcgttcgaagaagcttgacgtcatctacgcagcgtccgcgctcggcatcgtactgacgattgccacgcagttcaaccatatggtctactacatcgacagccagaactactaccgccgcggaccactgttcgctatcccgcagatactgggtctggtagagctcgcgctgattgtgatgctgatcatcgaaaaccgcaaaaacctcagccgaccgctgttcgtcacgtcgctgtcgttcttcgtgctgccgattgtgacaaccatcgttcagattctccattacggactggcgttgcaggccatcgcgatcacgatttcaatccagttcacgttcgtggtcgacaccatcgaaatgaacaagaagatccgctcgcaggacgatgcttatcagaaggtcagctacgaagcgcagcatgacggtctgaccgatttgtggagcaaaagcgccggccgcgaacagattgagaattatttcgcgcacatgcaggaagacgaccaggctgttctgattttcgttgacatcgacgatttcaagcagatcaacgatacgtacggccataaagtgggcgatttctggattcgtgaagtggcgcagacgttgaagcggctgtaccggcatgatgacatcatcgtccgtttcggtggcgatgagtatgtggcgctgataaagaacaccgcgaacgagcgcgtgatcgaaagcacgctggacctgttccgccgccagttggcgcaggcgtccgcgcaatacgggcaggacgtgcattgcagtatcggcgcatgccgcgtgctgtccggcaagaacgtcgatctgagcctctgcttgggattcgccgaccatgcgttgtaccagtccaagcgtgaggggaagggcatgtacaccgtggtcgattatgacagcgggaaagtgcaggcagcgtaggtttcgtggaaaaatccgcgggaaatctgcgggaaaaaccctagagaatcagctgagaaactacgaaaaaagcaccgcaaatccgccggagatcggcgtaaaaatcgcggaaaatcaggctttgccgagcattgtcagcacaatcagcaccacgttcagagcgacgatcagcgcggcgaccgcgatattgacgatgtgcttgaccggaccgtccacgtgctcccccatcagcgtgcggtcgtgcgtgtaacgcatcagcggaataatcgcaaatggaatgccgaccgacagcacgacctggccgacgatcagcgcttccgtcggattgttggcgaaccacagcaccaccagcgcgggtaccagcgtcaccactcggcacgcccacatcggcgctttgatgcgtagcaggccgtgcatgatttcgctgccggcgtaagtgccgaccgacgtggagctcaggctcgacgcaagcagaccaatcgagaaaatcgtgccgatcaccgggccgagcacatgctggatggcccgttgcgcgccttcgatggtgtcggtgccggtcatgccgtacagcgagttcgcggcgaggatgagcagcgcgaggttcaccgagccggcaagtatcagcgcccaggcaacgtcgattttgctgccgtgaagcagcttcttcacgctcggcttcgcttcgccgggggcgtaatggtcgttgacgagcgtggaatgcaggtagatggcgtgcggcatgaccgtggcgcccagcatggacgtggccataagcacggtatcagtgcctttgaagcgtggaatcaagccggcgacgacttctttcggatttggcggggcgatgaacagaccggcgatgaaaccgaacgtgatcaccagcagcaggccgatgatcagtttttcgaaaatgcgatgcgtgacgcctttttcgaaaatcagcagcaccgtcgacaccgcgccgatgatgcagccgccgacgaacagcggcagaccgaacagcagtttcagcgagatcgcaccgccgatcacttccgccagatcggtggcgatggcgattacctcagcctgcatgaaaaacatgaaacggcccgcgtcgccgaggcgctcgcccaggatttccggcaggcttttgcccgtgacgatgccgagtttcgcggactggtattggataagcacgctcatgcagttggccagtaccagcacccacaccagcaggtagccgtagcgcgcgcccgacgtgatgttcgccgccacgttgcccggatccacgtatgcgaccgccgccacgaacgcggggccgaggatgccggcgagcgcgtggccgtggtggtacggccgggcggatcggtcatgctgcgcagtgatcgtcatattcttcgaatccatatcgttcttcatatccacgcaacgttatagtgcgttttccgcgcagaattgttacgtctgttacggaaagctgaacagctgccgaacatgcgccgattgtggggcggacaggccgcgatcacggaagccgctaaactggtgcagagaacatcgcatttcgactcaaggggttgttccatggctgttttccacactccgatgatcacgctttccgacggcaatctgattccgcagatcggcttgggcgtgctgcgtatcgacgatgagggcgttacccccgtggtggagagcgcgctggaagccggctatcgtcatatcgacggtgccgcggggtacaacaacgaggcgggcgtgggacgcgcgctaaaaaacgcggggttcacgcaaggcgaaaatcgcaaaaatctgtgggtgacgacgaagctgcgcgattcggaacaggggtacgattccgcacgcaaggcgttcgaccgtcagcttgacctgctgcagctcgattatgtggacatgtatatgctgcattggccgaccccgtttgactggcgttccggcgaaacgtggaaggcgttcgacgagttccgcgcggagggtcgcgtgcgtacgcttggcgtgtgcaatttcctgccggagcatcttgagcggctgcataaggaaacgggcgaatatccggccgtcaaccagatcgaactgcatcccacgtggcagcagcgcgaggtggtggcgtattgcaaggcgcacaatatcgcggtcgaggcgtattcgccgatggcgcgtggcgcggatctcaatgccggcgatggtgtgatcgaacgcatcgcgcgggcgcatggcgtcacgcccgcgcaggtgattctgcggtggcacatcgaaaacggcacgatcatcattcccaagtcggtgcatgcggaccggcagcggcagaatctcgacctgttcggtttcgtgcttgacccggacgagcatgcggccatcgacgcgttggatgggccgacgcgtgcgggacatgatccgatgacgtttacgtatgcgtgactcgcgtttccgcaggcagcgtttcaatgccaacgggctagcggaacgtattgcgattctgctggtcgtggcggtggtcgccggcatttcgatcggtctgctcatgccgaaggtcaacccgaccgtcggcgagatgacgggcgagtatgtggcgactggcagcgcggcggaaacattgcaatcgttgacaatcgacgaccagcccagccgggccgggtacgaccgcgattcattcggtttccggcagaccgatgacgatggcaacggttgcgatgtgcgcgaggacgtgttggcgcgcgatttgacggatgtgcggtatatagcgggttctggttctagctctgattctggttccgggtccggcgccggctgcaaggtgaagtcgggtgtgctgtccgacccgtacaccggtacgacgatccggttcacgcgcggagtgaaaacgtcgtcagcagtgcagatcgaccatgtggtggcgttggagaatgcctggcggtcgggcgcgagcacgtggaaccaagccaagcggtaccggttcggcaacgatatgtacaacctgctcgcggtggacgggcccgccaatcaggagaagggatccgcgtcggccgcgtactggctgccgacgaacggcgcataccgttgcgattacgtggcccgtcagatcggcgtgaaagccaagtacgggctgaccgtcacgacgaaggagaagcgggcgatgctgtccgtactgcatggctgcccggcgcaaagcgtgccggagcggtgaggcgcgtggcaggtggcggagcgtaggtgcgcggtgaagcgtaggtgagtggcggagtctcccgaaatgtgtcacgattcgaaatctcggctgttttttcgaatcgtgacacatttttccttccaaaaaaacaatacgggggtataaaacgacatattcccaaggaaaatgcctcaaaaacatacccccgaaccgaaagtgatgtgtcacgatccaaaattttggtctttttttcgaatcgtgacacaaaaaacaagcctcctatatcctgtgcgcaaccaaacgcatcggaatgacgcgcgacgaacacgattatcagcggctttcaaggattccagcgccgatcgccacaaaagaggcacaacaccgaggagtcgcgatcatgcggaaagcgggcggcctcacgcgcgcacccaacgaaaccgcatcagtcaagcagcctaagcttgcgggctttccgataacgcagcaccactttgcgccatggcaagggcgtggtcaccccaatcggccgaccgacgatcgaagacaacgcatgggcgacgttcatggcgaacgcggcgcgatgcaattcgtcggacaaatccagctgcgtgaccgaaaacacagtccaaccagcggccgcaagacgcgacagcttgttctgatcgcgccgatattgcgcacggtcagtacgatgatggtcaccctgatagtccaggccaaaacgatgctcggcatcgacaagatccaacgtcaccgcagcgccattcgcaaaattcacgccggggaccacacagttcggttgcataatcggcaggccataacgcacaagagtcagcctcatttcggtctccttgggggaatcgctgcctgactgcacgagcgccaacgcatccagacacttgctccggtatgggacgttctcagttttaacaaactcaatcagccccttgcgagtggcgaatcgatggcgaatcaacgactccgcaaccatgacgatgtcctggataccccaccggccggcagccaaagaccacgccggaacgggcataagcaccggaactccagcaacctcacgcacgtgtcgcgcggacaagcccttccagacatgcacggtcacatcggccgacaccgatgtgcttttcttcacacggccgcgacgagccggcgattgggcgaccgtatgaagtttcgccggggattgcgggaattgggaaggctgagaagccgactgccgaagacctggaatctgattccgagaaacagcctgggaatccgggaaatattgaaaatccgaatccgggaaatcctgccctaagcggatagagtgctcggaatggccgaaagccggactttctccactccatccatagtccacgtccgtcccagcgtaaccgccttgcgacgaacgcagcgaaacaacggagcaatcactatctgcgggcagctcgacgccccaaatcgcgagcgcggtctcgtgacttacgggatgccgcaactccacggactgggcaatgcggagaatacgccagctggcttcggacagggtcgcccgctggatcggcttgtatgcatcatcagcattcatggcgtgcaatataaacgatggcaacggtttgatgtgcgtttttccaaagttgtggtcggagaacatgcgatttggggcagttcagcatggcatggccgtaattccaacgatttggagcgcaacagcctgtggataaccaatggagatggttccagctaccaccgcagcctttacaagggacgcggcctggcacttccggaagtgcggcaaaccggtatttcttttcgcttggggaatcggggatggatcagcctcagcccagccttcaaggcaattcggaccaattcatcacgaaccagcacaaactagtctcaagcgagccttgaaccagctttggagcggaatcttccgctataaatgtgtcacgattcgaaatttcggctgtttttttcgaatcgtgacacatttttccttccccaaaaacaatacgggggtataaatcggcgcatttccaaggaaaatgcctcaaaaaacatacccccgaaccgaaagcgatatgtcacgatccaaaattttggccattttttcgaatcgtgacacaaaacaagcgacacgggcagtaccggaagagtaggtccaaggcctgctctggaaagggcggagctggcgcacagatagcgtgggcagtgccggaagagcggcattggtgacgaacgtgttgatgatctgtgttccaagccctgatccggaagagcgagccatgccatcatgctcctcatccgccaagccggtgccatcatcctccaccaccacgttgaggttattgccaccgcggcccacggaaatcgtgatatgtccttccttacgtccttcgaaaccgtgttccaccgaattggtgatcagttcggtaagcaccaacgatagcggcgtggcatcctgtgccggcatcatgccgaatttgcctacgaaatcgacatcgatgtgctggtcgcgcatcgtagccaaatcgacggccatcttaagcaggttggaaatgaccttgtcatagtcgacgatctcatcggcggtctggctcaatccctcatgcaccatggcgatggtctgcacgcggcgctgtgcttccttgagctcctttttgacctcttcggacttggtcttgcgcgcctgcaagcgcagcaacgcggataccgcctgaagattgttcttcacacgatggtgaatctcggaaatggtggcgtccttggtctgcaattccttctcgcggcggcgcaattcgctgacgtcacggcacagcacgataccacccacgcgaccattggcgtccatcaacggcagagagcgcatggacaccgcggctttgttggcgtccaattcggaatccaccgcggctttgccgctcagtaccaatggcagcgtttccagcaccggatcgttctcatgcagcagtttggtgccgatctcgctcagatactccccctgcatggtgctgaccgatcccaaacgacggaaacagctgatggcgttcggagacgcgtatcggacgatgccgtcgacggtgagcacgatgaagccatccgccacacgtgcgttatggcgctggttcataaccgggttacggtacgggaactggccgcgcggaatcatctcatacagctgtttgccggcgctgatgctttcggactcataacggccgttcgattcgcgtgtggccatgttggtctcgcggaccaccaagccaagcgtcttgccattatgacgcaccggggcgtacacgttgcagaccttggccttgccgaccgtacgcagtttcgaggagcggaacaccgattcggagtccatggccgcgtcaagctcggcgcacagggattccgggacgacgttgccgaccacatcctcggctctcagactcatcaccgtggacggacggcattgctcggcaatgatgtacttgccctcgccgttctgcaggattagcagcaagtcggcgaaactcaaatcggcaatcacctgccaatcggccaccaactggtgcaaccattcacgatcgtcgtcaccgaaatccggacgggtcatcaggatatgtgagaaatcagccatgcaaccataatacgcatcaatggcgaggttgcataccatatgcccacgtataatgcggaaacgccgattgacatatccgacggttacgctaacgtaggttacggttccgtaacttatagtggaggcatccgatggcgaaacctacaaacgcagaaatcgaggcgaaacgcgcggtcatcgccgaagcacgcgagcaggccctgcaggcgaaagctgagaccattcgcgtgaaggcgcacaataaggccgagaacattcgacgcaaggcggatgcaaaagccaaacgtgccatcgccaaaggcgaagcccatgccgcaaaaatcgaaggcatcgtccccgccgaaatcgaacgcaaaatcagactcgacgtgcatggcaggccaaagccgctcctgcgtggctggatccacgccatcgccactcccctggctcttgccgcgggcatcgtgctgatctgcctcgctcatggcaccgggctcaaatgggcgtgcgccgtgttcatgacctgctcgctggtactgttcggcaattccgcctgttatcatctgggagattggtcaccacgggttaccgatgtgctccgtcgcatcgaccatatgaacatctttttgctgatcgccggcacttatacgcccgtttccttcgcgctcacgccattctggcgtgattccatcatcgcgggcatgtggatctgcaccacggtggcgctcatcatccatgtcatctggatcagcgcgcctcgctggctttatgttcttgtctatattattttcggcgtgtccggcgtcgcgttcatgggattgttctggatgtccccctatgccggacctaccgtggtgatactgctgtgtgccggcggcgcctgctatatcgccggagccatcgtgtatgcgctacgcaagcccgacccctggccgaaggtgttcggcttccatgagatcttccataccggaaccgtggcgggatacgcctgccacatggtggccatctacatggtgatcgtgcaattgtggccctaaggcgtaatcaaccccacatggacaaaacaaaataagcccgtcccctcatcgtacgaatgcgatggaggaacgggctgttgttttcgtcacacgtatgtcaggcgagcggcttggcttccttgatggtcacggaaatctcacggccgttcggagcggtataggtcaccgtatctccggcatgagcgccattgatggcggcgccaatcggcgattcaggactgatgatgctgtaatccgtggcgatggacaggtctcgcgtgccaagcacgtacaccatttcacgtccgttgacttcaagggtcactagggatccgtcaccgacctcaccggccttgggcgcagtcagaatcttcgcattgcgcagtttgacggtcagttcgtcgatgcgtccctgattcacgcgctgcgcctcacgggcagcctgatagccgccgttctcgctcaaatcgccttcggcacgcgccgcggagaccttggacagaatctcgtcacggtactcgccctcacgccaggcgagttcttctttcatcttgtcgtacgcctcctgcgtcagcaggatcgtcttttcttcggccatgttatcctccttgaccttggaagaatgatacccgtcaatcagcgggtggagatgatgtcgatcacgaacaccagcgtgtcctcgccgccgatgccggcctgcggaacaccacgggagccataaccgtactccggcggaatggacaccaccaggcgggaaccgacgttgtgtcccggaacggtctgatcccagcccttgatgacctgtcccacaccgatgccgaacgtggccggctggtgacggtcgaagctggagtcgaacggggtgtccttgccccagaccacaccatggtagttgacggtgacggtgtctccacggcggaccatcgggccattgccttcaaagagctccacgaccttcaggccggcgggagcgatctcagtcgggaattcgatggtcgggcgatcgccgaattcggcattgacaacaggcatttcagatgccatggtgaacctccttgaaaaaacacagtgtcaccaagattagcaccatccatcgctagcattcaacaacattgaccgcaagaccgcctttcgacgtctccttgtacttggccatcatgtcctcgccggtgtccttcatggttttgatggcttggtcaagactcacgatatgcgtgccgtcgcccagcatggccatacggaccgcgttgatggcggtattggccgccatggcgttgcgttcgatgcagggaatctgcaccagaccaccgaccggatcgcaggtcagtcccagattgtgctcgataccgatttccgcggcattctccacttggtgaggcgtgccgcccatcacggcgcacagccccgccgcggccatggaacaggctgtgccgacctcgccttgacatccgacttcggcaccggaaatggacgcgttgcgtttgaacaagtatccaatcgcccctgcggtcagcaggaacgtcaccacaccatcctcatccgcatgatccacgaaatgccaataatagtggagcaccgccggaatgacgccagccgcaccgttggtaggcgcggtgacgatgcgtccgcctgccgcgttctcctcggaaaccgccaatgcgaacaggtcgacccatgcggcgtccgatgattcgagtacggcgtcggagcgcctgccgtcccgtttgagcacgtcgctgttggatgcgagccttgcatacatttttggcgccctgcggggcacgtcaaggccgccaggcagaacggtttggttggtattgcaaccgtgctgcacgcagcggcgcatcacatgccatacagtgtccaaatcgctgcgcacctgcacgtcggaccgcatggccgtctcattggcccacaccacatcggccacactcatgtgacgttcatcgcacagcgagatcagttcgtcgcatgtggtgaacggatagggcatgtccatatcgatatcggttgaggaatcgtcggtctgatcggcgaaggccgttcccgcagggggtttctcatggatgccgatcatcaggtcgtcggcgtcgccttgtctgacgaatccaccgccaatggaataccagacctgttcgtcgatgagattgttctgccggtcgaaggcttggaatcgcatgccgttgggatgggccgccatgcggtgccatacatccatcaccacatcgcgtccgtaatcgaaatcgatgcgatgcgtgccgttgagcatcagctcgccgcctgcctcgcattccatacggatattgctcatgtgatcggtatcgacggttttcggtacgttgccttccaagcccgccaccgtggcgcgatcggtaccgtgcccaagaccggtcagggcgagcgaaccatacagtaccgttcgcacgcggccgacccggttcagtatgccgtcacgttcaagggaggcagcgaatctgctggccgcgaccatcggccctacggtgtgcgacgagctggggccgacgccgatggtgaacatctccagaatgctgaacatgtatattgcgctctcttttccgcgtcttcgccgtcacgccgcgtaaagcacgctgaacatgcgaatcatgatgagtaggccgatgatggcaatgacgatttccgcgataagcagaattatcgcaacggttttgcgattgccgagtttgacgtcgagcagttttgcgaaaaggaaagcgacgaagcccaaggctgctccgttcagcgcgatcgcgccgacctggccgttggtaagaacgctttccccgactttggcgagtatcgaattgatggtggcggtgaacaccagcaggctccatacgccgtatccaatcaatcctaccgccgcatagccgaacgggcggaatcgttccttgagtttgaaagtgaacgattcggcgcaccacaacaatgcgaagcccacaacgaaggtgaacgccacggcaaggaatgcggcttccaatgcccacggaacgagtgccaacgaatggtccatcaaggtaaagtacagcggagaacatgcgatttcgccgatagcgagcacgccggcaacgataatcacctgcgcaagcatcagggggatttcagtggcgggctgttcgattacaggcttgatgtctttcgaagtcatgcgtcatccgtttcagtcggtgtcatacggtttgtaatgtccgacagtgtacctacggaatgtttcgggaacgatatgccacattttgcctacacattgcccacatttttccataacccaccgtggaaaagggttgaatcgcagtgaatcgcgatgatgccaaaaccgttggagaataaaggaaaaccgccatctctggcggtttccaaaagtgcctccagcgggactcgaacccgcaatccgaagaggtcgattttaagtcgactgcgtataccgatttcgccatggaggctttgcgccggccagaagaaaaagccgacgccaagctattatgccacgtcagcgcgcagcaagcaatctcttgccgtaatccagcacgatgccgtccaacagaccatgctcgctggccatgaaggagtcgatgcgctggccatgatcctcatatgcggcttcagacaccttggcaagcacacggttccacaccaatgcgccgccgccgaccacatcgacgcgtccgggatgaatggtcttgtaggtcagacgctcctcacgaggcatgtgcaggaaccggttgtcaacggcataggcatcttccagcgtgcagcgtgcgccgtccacggcggtgtggtcgtattccgtcaatcccatagccaatgcggtcatggtggtgaccgttccggacacgccgatgatggtgtgggtcttgccggcgggaacggtcttgaacgcctcgtcgatatgcgcgtcgatatccgcgaccgcctcggcgatctgcccctcggtcggcgggtcgtttttcagatgacgctccgtcatacggacagacccgatattcatggagaacgcggcctgcacctgcgtgctcggatgggtgacgccgtcgcctcccagcaccagttcggtggaacctccgcccaaatcgaccaccagatagggggcctcaacctcgcgatggacgatgctggtggcaccgaggaagcttaaatccgcttcctccgtgcctggaatgacttcgggacgcacgcccaagatcttctcgatgttgtcttcgaattcctcacggttctcggcatcacgggtggccgatgtggccacgaagcggatgccgtccacgggatgttcggcaagcacgccggcgaattctcgggcggcctcataggcgcgcgccaacgcctcgtcggcgaagcgatgggttttgtccacgtcctgaccgagacgaatcacccgcaggatgcgcggaacgatgtcttccacaccgtcctcgctcacacgcgagactttcagacgaatcgaattcgtgccgcaatcaataccggcaacggttaccgacttcattactcccaccttctactcttcgttttccactgcgcaacggcatacggccggatcgaactcatgtttgatggcggacagggccatatcaccgatggggttggcgccctcacccatcaccagcgtctgggccaacaacgcgtgcaggcatttgacacgcaccggcatgccgccggcactggtgccttcgatgtgttcctcgctgtcttccaaggccaaagcgatttcatggcggaacgcgaggtacagttcgtgggcacgttcgtatccggcacgcagatcctcgttttcggccagcatatcgttgtattccttcatcttgccttcggcttcgatgtgggagatggccttcaccgcttcgggcccggtcagatagcaggtcgtcgggaacgggacaccgcctggaagcaacggacgggtgaccacagccaaaggccggccgcatacgcaacgggctccgacggcgaccatgccgcgcgggtaacgtccaagctgacgctccaccacggcgatatcatgttcggtggcgggttgggcaagcactttgtccgccaaacccttggcctgttcgataatcgttatgtccatgtcactcctgtccgtcttccgacggctgctgaccgtcctgttgcgattggccagtctgttgttgactgtcctgtttgtcttcttcgccggcatgctgcgactgtttcgtcgagtcggccttcacgggatccgaccgatccgcctgcttgaaggaatatgcaagttccttataccacggcagggcggttttcggtgattcgtcgtatgtcgtcccttttttcggctcgctcttgccggtcaccgcttcgggatgctcgacacgaatcgcctgttcgccggggaagacgaatcccaaacgatccctggcctgggcggtgacatacgccttgtcatcccatcttgcgatatcgttctccagctcgcgtttctgcgcgaccaacgccgcttcctgttttttcagtccgttaagctctgccagattcaacgcataggtatggaatgtcgatgccaactggatggttcccaaagccacgatgaacaatgccacgaagaacgcgaccgggccggcgccgccgcgttgtgatggtttttttcgtgccttcgaactcatagcaacgaaaatacccgtcgcgttcgacttggaacacgacgggtatttctatgtcaacgcattcatgatgcgctggctacgctcactcagcgatgtacttcttgcaggccttgaaagcgctgtagccggcgtactgagcggtggagccgagctcctcctcaatctcgagcaggcggttgtacttggcgatacgctcgccacgagccggggcaccggtcttgatctggccggtgttctttgccacagccaggtcggagatggtggtgtccggggtctcgccggaacggtgggaaaccatggaggtgaagccgttcttggtggccagctcaatggcgtcgagggtctcggtgacggtaccgatctggttgagcttgaccagcagggagttggcggcgccgagcttgatgcccttggccagacgtgccgggttggtgaccagcaggtcgtcgccgacgaactgcaggcgatcgccgagcttggcggtgatggccgcccagtcgtcccagccttcttcctggaacggatcctcgatggagacgatcgggtactcgttgatgaggttctcgtagaagtcgagcatgtagccggcctcacggtcgtcgccttcgaagtggtacttgccggtctccttgttgtagaactcggaggaagccacgtcgagggagatgccgatctgcttgcccggctcgtagccggcggcggagatggcgtccatgatgtagttcagggagtccttgttggacttcatcttcggagcgaagccgccctcgtcgccgaggccggtgttcaggccctgcttcttcaggacgttcttcagggtgtggtagacctcgacgccagcctgcagagcctcgctgtaggtgttgaagccgtacggggagatcatgtactcctggatgtcggtggcgaagtcagcgtgggcgccaccgttcatgatgttcatgttcgggaccggcaggatgtggccgttggtgccgccgatgtagcggtacagcggctgatccgcggactcggcggaagcgtacagagcggccagggacacgccgaggatggcgttggcgcccagacggcccttgttcggggtgccgtcgagctcgatcatggtctcatcgagagcgcgctgatcggaagcgtccatgccgatgaccttcggagcgatctcctcgttcacggccttgacggcgttgagcacacccttgccctggtaaacggacttgtcgccatcgcgacgctcccaagcctcggcttcgccggtggaagcaccggacggaacgaggcccaggccctgagcaccgtcatcggtgtcaagaacgacctcgacggtcgggttgccgcgggaatcgagaatctgacgcgcgtaaacgctttcaattactgccacaactactccttataaacgttaggttgtgatgacaatgccaagaatagtgcgatttatggacgtatgccaaactttgcccgcatgttccatgtgaacgctcacactcttttttgcatcccattgtcattgacgcggtgtcggtttccagtccagatcgtcaagcaattgactggtccatccgaccacttcgtccgagctcatcggcttggaaccaagcgagcctgcgaatggagccggtaccagatacgtcttggtcaacggccggtactggatgcctttgtagattctggccatgcgcatctgcacggattcacgcggctcgaacttcgacacgcgcacgttgcgtccttgcgcgatgatctcggaaatgccgagcttacgcgccttgaaccgcaaccgcgccacgtcgaacagcgcctcgaaatcgacgggcggcttgccgtaacggtcggtgagttcgtcgcgcagctcgtcgagatcgtcttcggtgcgtgcggaggcgagtttctggtacgcttccaatcgcagtttgtccgaatcgatgtagtcgacgggaatggacgcctcgatcggcaggtcgatggtgacggcaaccgattccttgcgttccggctccttgtactgttcgaccgcttcggacaccatacgcacgtacaggtcgaagccgacgccttcgatatggccgctctgctcatcgcccagcaaattgccggtgccgcgcaattcgagatccttcatggctacgtcgaagccagagccgagcgcggtgttctgcgcgatggtggcgagcctgtcatgcgattgctgggtcatcggcttggtcggatcgtacaggaagtacgcatacgcgcgctcacgtccacgaccgacgcggccacgcagctgatgcaattggctcaagccgaagcggtcggcatggtcgacgatcagcgtgttggcgttggagatatcaaggccggtttcgatgatggtggtgcataccagcacgtcgatgtcgcgatgccagaagtcgcggatcacaccgtcaagctgtttctcccccatcttgccgtgggctatgccgacatgcgattcgggcacgagctcgtggattttcgccgcgacggaggagatgtcctgcacacgattgtgcacgtagaacacctgcccaccacgcaacagctcgcgccggatggcggcggtgacctgcgcgtcctcgtaagcgccgacgtaggtgagcaccggcaggcgatcctccggcggcgtggccagcgtggacatttcgcggataccggtgacagccatttccaacgtgcgcgggataggcgttgccgacaggctcagcacgtccacattggtgcgcaacgccttgagcgtctccttgtgctcgacgccgaaacgctgttcctcgtcgatgatgacgagtcccagatccttgaacttgatcttcggattgagcagcttgtgcgtgccgatgaccacatccacggaaccgtcttcaagccccttgatggtctcgttaatctccttggtggtctggaatcggctcatggcagccacgttcacggggaagccttcgaaacgttcggtgaaagtctcgaaatgctgttgcacgagcagtgtggtcggcacgagcacggccacctgcttggaatcctgcaccgccttgaacgcggcgcgcaccgcgatttcggttttgccgaagcccacatcgccgcagatcagacggtccatcggaatgggtttctccatatccgacttgacctcgtcgatggtggtgagctggtcggccgtctcctgataggggaaagcgtcctccagctccttctgccacggcgtgtccttgctgaaggcatagcctttcgtacgctggcgtgccgagtagagcttgaccagatcctcggcgatctcatgcacatgcttgcgcgccttggctttggtggcggcccagtcggaaccgcccagcttgttgagtttcggcgtttcggcgccgatgtatttgctgacctggtcgagctggtcggtggggatgaacagtttgtccgccggcgcgcctcgtttgctgggagcgtattcgatgaccaggtattctcgggtggtctggttctcgcctttgccgatggtacgttggcgcatctcgacgaaccggccgatgccatgctgttcgtgcacgacgtaatcgcccgttttgagttccatcaggtcgatggccttgcgtcggcgtttcggcgttttcgcctgtcctgcggcggatgtgcggccggtcaggtcgcgttcggtgagcagggcgattttcgcggcgtcgtccacgaaaccgtcgatggcgcgcgatcggacgcaatcgaaattcgcgatgccggtttcgttgatcgcacgcttcagtcgggtgagtgtgccttgggccgcggccgtgatcgtcaccgcatagccggcgtcgagcagtccttcgatgccggaggccgctttgttttcgtcaccgcggtattcaccgggtttggtggcatcaagttggatgtggccttcccgggtggcgtcgacgccgaagctggtgagtttccacacgtcatgtttggagaagacgagtgcggagatggtttcctcgaaatcgtagaaattcgcctggtcgaaggtgatcggcgctccggcgccatgtccggatgcggcgacatgccagcttgcggcaaggaattcgttggcggttttcgccagatcgtcggcggcgcgacgaagtttttccgggtcggacagcatgaccagcgcatgcttgggcagcatgccctgcaccggttccatatcgtcgaccagcgcgggcagcagcgattccatgccttccaccgggatggcgttggcgatggattcgagcatgtcctcggcgttgggaatggagccgatcagcgatttcgcacgttggcgaatctggtcggtcaactgcagttcacggcatggcgtggcccatacggtggaaatatccttaccgtaggtgcgctggtcggatgcgtggaattcacgtatggtgtcgatctcgtcgccgaagaattcgatacgcaccggatgcggcagagtgggcggaaaaacgtcgatgatgccaccgcggacggcgaattcgccacggtccatcaccaagtcgacgcgcgtgtacgcgttttccaccagtttgcgggatgcttcgtcaagaggcagttcctcgccttgggagaacacgagtggttcgacgtcccccaagcctgcgaccaccggttggatgagggagcgcaccggcatgaccagaatgcggatggggccgaacagcgtgctgccctcttcgggatgcttcagcctgcggaacaccgccatgcggcttgccacagtgtccgcgcgtggtgaaagccgttcatggggaagggtctcccatgcttcaagctgcgccacatcgtttgggtctccgtcataccaggaacggatggactccacggcttcctccgcttcgcggctggaggcgacgacgagcacgaccggctgtttgcccgcagcgccggctgcgagcgccgggcgtaggccgtccggcacaccgacggtgatgctggggtcgatgtctgattccggttcttcgatttccccggcgatgagcgcgcggaaatcgtcatcggtttccagcacgtcgaggatgccggcaagcgagcctgcggtcggcagttgcggtggttgcgccggagacgtcggttcagcggccattgaatcgctcctgggctttggcgagaccgtcgaagatgatggtttcggccgcgtcggcaccgtcggcgaggaattcggggagctgcttgcgttggtccggtccgaagccgcccagcacccagttcacggtgttgtcgtgcgcgtgggctccgcgttgggcgtggccgacgcccatgcgcacgcgcgcgtatttcgaggtgccgagcgaacggtcgatggatttgatgccgttgtgcccgcctgcggagccgccggctttgactttgattctgccgaagtcgaggtccatgtcgtcgtggataaccacgatatggtccggttcgatctggtagtaggcgctgatggaggcgaccgcgttgccggattcgttcatgtaggtgagtggcttggcgaggaagaatttgacgttgcggccggataggttcatcacgcctttgccgagcatggcgagtcccttgtggtcggagaagttgacggaccagcgttcggccagcacgtcggcggtcatgaagcccatgttgtggcgggtgccctcatatttggagccggggttgcccagtcctgcgatcagccagaaatcagatgccataataatcgtccattcctctgtgttcttgcgtgctctcgtcttgtttaaccgcacagattctactgtcaggtgcttacaggtcgagatgccagtagctcatgtcgcgcatggttccggtggagtcggtggcggcttggggcatgagtccgaattgggtgaatccgaaatgtttcatcagtgcgatggatccgcggttgtcggcgaagatgatgccgcaggctttgcgcatgtggcggtttcggcattcgtcaagcagtctggccagtgtgaaggtgcccgctcccctgccctgccattcgggggcgatgtagtaggcgaggtcggtgacgccgtcgtagccggcgcggtcgtagaacacggacagcgcggagaagccgatgatccgttcgccgccttccgtggctgcatccgtggcaggcacggtggtgacgaacaccgcatatggatcgtggtgcgattccacccatgccttgcgttgcgcgtaggtacgtggcgtggtgtcggcggacgagccgccgcggatgactgccgcgttgtagatgtcggtgatcgcttggatatcgtcttgcgtcgcgatgcggaaagaatagtcggccatgcgcccagcatacccggcggcgaacgacaacaggggccggttcctttggaaggagccggcccctgcgtatttcatgaagggaatcggacaggaatcactgttcgagttcgatggccttgttcagtgcttcctgaagctgcttctgagcgtcgccgtaggcggaccaatcgcccttcttcatggcggcatcggaatccttcatggcctgtgcggcatcgtcgagtgccttcttcaggtcggcgctcatcgtgccggacgaatcgccattattgccgccggtcttaccgtcggtattggatggcgtgtcctgcttgccgtcagtgttggtcttgccatcggcggaatcgtcgttcttagcatcctgcttgtcatcggtggtgtcgcccacgttttcggcgtcgcctgcggacgcgccggaatcgccgccgaacacctggtcgagagcctcgtccagcgtgtcggcgaagccgacctggtcgccgaatgcgacgagcaccttcttcagcagcgggaagctggtggagccggacgatttgacgtacaccggctgcacgtagaccaggcctccgccgagaggcagggtgagcaggttgccgcgctgcacattggtcgagccggattcgagcaggttgagttccttcgacacgtcggcggacgcgttgaagttgttctgcgcctggccggggcccggcacgttggaatccttcggcagttcctgcaatcgtatggtgccgtagctcgagccgattttgcctttctcgtggcccgcgtcggaatcgaccgacaggaagccggtcaggatttccctggtggacgagcctgcgggaatgtacgacgaggtcagcgagaacaccggttcgctggagccgccggtctgcagcgtcagatagtacggcggctgcaggatgtctcgctgttgcgcctgctgcgattcggtcgggtcgacgggggtctgccagaaatcctctccggagaagaactggttggcgctggacacgtggtatttggccagcagttcgcgctgcaccttgaacaggctttccggataacgcatgtggctcatcaggtcgccggagatttccgacagctggtggtactggccggggaagatcttctcccaggctttgatgaccgggtcggactggtcccatacatacaggtccacggaaccgtcgtatgcgtccacggtggctttcacggaattgcggatgtagttggcgttcttcgagttcaggctgcttaccgtgtcggaggattccgtggtggagtccttggtggcctcgcccaagtcggtcatctgagagtatgggtaggcgtccgaagtggtgtagccgtccacgatccacttgacccgtccgtccaccacggccgggtatacgcggccgtcaagcgtcagatacggcgcgactttggccacacgttccttcggggaacggtcgtagagaatctgcgaattggagttcacacggttggagaacaggatctggtcggagccgaagcggatggcgtacagcagtctggagaagatgttgccgatcttcggaccgccatcgcccttgaaggtgttggtggcgccttccgaaccggtcggatagtcgaattcccaggatttggtgccttccggagcgcctacgatcgaatattcggtggcgttcggagagaagtagatgcgcggctcgtacttttcggaatcggtgagcttgccttgggtggggatgcccgcttcgaagaacttcggctggccgtcggcggtcaccttgttgccgtaggcggccacaacgccatagccgtgcgtgtacacggtgtggtcgttgacccagttgcggttgtcgagaccgtccagatcgagttcgcgcgcggcgatcaccgtgtcctggctgacgccgtcgacgtcgtatttgtcgaccgcgacggtgtcggcgaacgtgtagtactgcttggactgctgcagctgtttgaacgtcggggagatgatctgcgggtcgagcaggcggatctgagcggtggattccgcggaatcagccaatgcgccttcctcgccttcggtggtggccttgtactgttcggccttcaccttgtccaagccgtacgcggcgcgggtggcgtcgatgttgcgctggatataggtggattccatttcctgcgcgttcggattgacgcggaagcgctgcagcagcaccggccaggccacggtaagcaccaggctcaccacgatggcggaggcgatggccacggtcggcaccttccacgccttgagcgcttcggaagcacgtgccgcgatgggtgcggaaccttccaacgtatgggatttcataatccacaggcccagtatcacgccaaggatggcggtgatggcggccatgatgaacgtgacggggatggtggcgttcaccgtggtgtaggtggcaccggtgattctgctgccttcctcggtcaggtgcgagaacactcccagaacctgattggcggcccaggcgaacatgttgagcatcagccagatgccgatctggcggcgggcgcgtttggtgatgcggaacaggccatggccgttcaccggcatggtgatgcggatgccgcccataagcacgtgggtgacgatggagaagatgatgccagcgagcagcaacagcgagacagcggacatgatgagtttcagtccgggcagcacgaacacgtagaagccgttgtcgatgccgaactgcggatccttggtgccgaagctttgcgagttgaacatgagcaggatttcggaccagttcgcgttgaactgggagccgaacaccagtccgacaatcagggagatgaccacggcgatgcgtcgagcgctcttggagctcacgctcttgccgatttcgatggtgtcgccgttcacgcggatggtggagccgtccgcagcgtcgggacgcgcccatatcgccagcgtggcggagatgaagccgactgcggcgatgagcaccgcgtacgccagccagaggccgaccctggtgcccagctgcgtccaaatcacgctttggaagccgagctggctgtaccacatgacatcggtgacgaactgcgcgagcgcgaagaacagtccgatgacgatggcgagcgccagcaccacgccgatgaagatcttgctgccgttcgacggtttgcgcggacggttcggcttgctggtgatgcgggggcccgaaggtcgtttcgggggaacgttcgacgatggttgcggaccgtcccctccgtcggtttcgacgttgaggatgatcggatcgtcgttgctgggtttgcgcggattctgcctgccggcacggttcgagccgccttcgggatcgaacatgggaccaaacatatcaaagaaagacatgctaatagcctagcgacaggcgaggaacgccgttaagccgccagccgaacggatctggccgtgggctgaatcggctgttccgtggcatgttcgtatgaagggaacatatggggaatgccggcatgccataatggcggtatgaagaaggctcatgggtttttcacacgattggtggctgcctgctgcgtggcgatgctgccggtcacgttggccgcatgttccggcgacgcttccccatcggacgccgccaccgcagctttttccactcgccggccgacggtcacgcatgattccctcgacaaggcgcaagtgccgtccgtccgcgacgattcgccgcatgccaaggcggtgcgggccgtggagtccatgagtgtcgaggaacgggtcgggcagctggttatggcgccattgttcgctggttccgatccgtcatcgttgtatgacctcatcgcgaacaggcatgttggttcggtcttaatcatcggcaactggaattcggggaccgccggggtcgcggccgccacatccacgctgcaatcgtatgctccgggcgacaaccagctgttgatgtccaccgatcaggagggtggtctggtccagcatctcaagggggccgggttcgataccatgccttcggccacccagcagggcgcaatggatgtcagccagttgaggcaatcggcatccgcatggggcacgcagctcaaggctgccggcatcaatgtcgatctggcacccgtcgtcggcacggtgaccgtggaccgttcgtcgaacgccccgattggcgcgctgtaccgtgatttcggtcttgatccggccggcaatgcggaccatgcgaaggcgttcatacagggcatgtccgattcgggggtaggcagcgccatcaaacattatccgggtttgggatcggtgaccggcaataccgatttcaccgcgaacggcatcctcgacaccaccaccacgttggatggtccggaaatcagcgcgttcaacagcacgttggaggcaagcccttcgatggtgatgatgtctttggccacatatcaggcgatcgatccgaataatccggccgtgttctcatcaacgctggtcaccggctatctgcgcgggaaaatcggcttccaaggcgtcgtcacttccgattccctgtccgcaacggctttgagtggcgtgcagccgagtgatttgggtgtgcggctggtcgaagccggcggcgatttggcatgtatcggcgcctcttcctacgtgcagccggtgttggacggattgaacgccaaagcggccggcgatgcgacgttcgcgcggaaggtgcagcaatccgccattcgtgtgatgacgctcaaatacgagatggggctcgccaggtaatcgcaatgccaagcacaggcggaagccgtcttacgagaaaaccagctgtaccagcagcatatagacggcggtgccgccggcgatcgacagcagcatgttccttttccatatgtgcagcagggcgattgcgataatcgccaacaattcgggaatgccgtggctgcctgacgtcaggcgcactcctttgagcgagtacacgacaagcaggcctgtcatggcatacggcaggacggtgcccaggtaggtgatgaaacgcggcggttccttcgattcggggaacagcaggaacggcaggaaacgtgtcagcatggtgccgagcatcgccatgatgatggtgatgacgccttgccacgtggtcatgatcatcatgcgttcgtctccttgtccgcgttgttcgtttcgttctccccgtccgtcttgtcgatcttcaggtcgtccaggtatggccgcagcagaatgaacatgacgagcatggcgaccagggatgggatcatgaaattgtcggcgccgaacacccccagacagatcgcgggcaccgctatgccggtaagcgcggccatgtggcttttgcgtttcgtggtcagccattgatccacgaaaatgacggcgaacatggcggtcatgatgaagtcgagaccggaggtgttgaaggtgatgcgttctccgagaaggccgccaagcgtggcgccggccacccatgatgactggttgagcaggccgacgaagaagtagaaccatccgcgatcgacgtcggccgcaatgatggtgccgttgtcgatggcgaaggtctcgtcgcacaacgagaaaatgagatacggcttcttggcgcccatgttcttgaaccggccgagcatggagatgccgtagaacagatgacgggtgccgagcatgacggccagcatgaacgtgacgaacgggttgaacgcggacaccagcagattcacggtgacgaattccatggaaccggtgaagatgaacgcgctcatgcacatgggccacaggaacgaaaagccgcgcgtgcccatcagcacgccgtacgacaacgccagaaggaaaaagctgatgcagaccggcgacgtccgcggcaatgccgttctgaacgccttgcccatgacggcgttcctgttctgcgtccgcaccattaaatatcagcccttcttccgtccgctcccatgcttctcttctcatgccttctcttgccgcgccctgatataccccgacgcgccacaacgacggccaacatactatcgccgaccccgacaaaccatgcgcaaccgtatcgacgcgtggacatcgacgaattacgtacaaagcatgcgcgacgagattatcatgctgcatactggaacgtaacgaaaaacctttggacaaggagcatgaatgaagacactggtactggtattccacccgcatctggaaaaatcgcaggtcaaccgcaagctcatggacgcggccaacgagaccggcgacgtgaccgtggtggacgagtacgccgcatatcccgacttcaaaatcaacgtcgaacatgagcaggagctcatcgaaacgcatgaccgcatcgtgctgcagttcccgttctactggtacagctcccccgcgctgctcaagcagtgggaggatgacgtgatcaaggccggctgggcctacggcggcgggcgggcgctcgaaggcaaggagttcatgttggccgtgtccaccggctctccggcggactcctacacgcgtgaaggcagccatgtgcgcaccatggaggagctgctttccccgttcgagaccacgttccgtcatacgcatgccacatatctgaagccgttcctcatccaaggcgtcgccacgtccaccgatgagcagatcgacgccgccgtggcgaagtatccggcagcgctgatcggctgattcctctgcctgtttcggcgcgcatttcccgattttccgcagggagccgtgttcgttccagacgaacgtggctccctgtttgacttcaagtacttgaagttcctagtctcttccaacagagcatgaaggagcatacggtgaataacactccagatacatttacatccgctgcggagcaggacatgtccgaaacccgccaggcgttcctcaccggcgagcgcgcggagttcttcgcgcatgaccgccggtacgtcgatacgattttcgacgatggcgaatcgccgttgaagcatgcccatgacatcgaactgaggtcgagctcgttcaaatggaagtatccgctgtggtattgctcggatatcgatgcgaaggactgcacgtggtttgagatggcacgtgcgggcgtatggtacacggaccatatcacggtggaggattcaacgatcgaggcgccgaagaatttccgccgctgccatgacgtgacgttacgcaacgtggatttcgtcaacgccgaggagacattgtgggcctgttccggcgtgacgttggacaatgtgagcgcgcatggcgactatctggcgatgaattgcgcggatgtgaaagccgacaacctacgtttggtgggcaattatccgttcgatggcgcaaggaacgtggagatttccaattcccgtctgatttcgaaggattgtttctggaactgtgagaacgtgacagtgcgcgattcgttcatttccggcgagtatctggcgtggaactcgcgtaacgtgacgttcgagcattgcacgatcgaaagcctgcagggcctgtgctacgtggaccatctggtgttgcgtgactgccggctcgtcaatacgacgctcgcgttcgaatattcctccgtcgatgccgacgtgcatggcacgatcgacagcgtgttcaatccttcgtccggcacgattcgcgccgaccatatcaacgagctgacgctcgatccggcgaaaatcgatccgacggccacgacgatcgtgacagccgacgccgcataacagtaggtaggattggcggtatgacttacgatttcgatactccgatcgaccgttccggcacgtactcgctcaaatgggaggaggctggcgacgcgctgcccatgtgggtggcggatatggatttccagaccgcgcccgtaatccgcgaggcgttgcgtcggcgcgtcgagcatggcgttttcggctattcgatcgtgccgccagaatggaatcagacgtacgtggattggtggggacgccgtcatgggcttgccatcgacccggactcgctggtgttctgcaccggtgtggtgccggcgatctccagcatggtcaggaaactcaccacgccgaacgagaacgtcgtgatcatgacgccggtctacaacatcttcttcaattcgattctcaacaatggctgccgtgtgcttgaatcgccgctcgcctatgacggcgaaggacattacgagatcgattgggctgatttcgaaacgaaactcgccgacccgcagaccacgctgatgattctgtgcaacccgcataatccgatcgaccgtatttgggattgtgagactttggaacgtatcggcgaactgtgctggaagcatcatgtgacggtggtcagcgatgagatccactgcgatctgaccgatccgggtttcgattacgtgccgttcgcctcggtgggcgagcattgcgcgatgaattcggtgacctgcatggctccgaccaaaacgttcaacatcgcaggactgaattccgcggccgtgatgattccgaatccggtgctgcgtcataaggtgtggcgagctttgaacaccgatgaggtggcggagccgaacgccttcgccatggacgccaccctggccgcgttcaacgagggcgaaccgtggctgaacgaactgcgcgcttatctggccggcaacaaggcgaccgcgcgtgcgatgttcgacaaatacaacgcttcggtgccggccgaccggcgcatcatcatggtcgaaggacatgccacctacctgttgtgggtcgactgttcggccatcacgcatgacacggatgcgttgtgcgattatctcaagcgcgagcataaggtgatgttctccgagggttccgaatatggtggcaacggtcatgatttcgtgcgtatcaacgtggcctgtccgcgtgcacgcatgatcgagggtcttgcacggttcatcgacggtctgctcgcgtatcgagcacaatcgtttccaaagatggactgataaacccttggactgacgcatgacggatgcggcaacggcctcttcaaggactatgaaaggacgcaacatggtggtggtgtttttctcccgcgccggcgaaaactacgaagtgggcgaggtgacggtcggcaataccgcgaagcttgcccaagaggtggcccggcggaccgattcgccgatgattgaaatcacacgtaccgagccttatccggaacggtacgccgcgacctcagaaatggtgcaggaggagcagcgtgtcaacgcgcgtccgccgttcacgctcagcggcgatgtcgatgcgctcgattcgtccgataccgtgttccttggctatccgatttggtgcggcgatatgccgatgcccgtgtacgcttttctggaaagccgcgactggtccggcaaaaccatttatccgttctgcacgcacggcggcagcgggcttggacggactccggaacgtatcaccgcaatcaccaagacgacggtgaagccggggcttgcggtcatggggaccgacgcacagaacaacgcaagtaaagccgccgaagccgtcagcgggtggatcgccaaatccggtctatagattcgcaatccacatccatccgttccgtctgcttcagcacgccttcgagttggagcagacggattttggtttcaatgcctcccgcataaccggtgagactgccgtcagcgccgacgacccgatggcagggcacgataagcgcgatcggattgcggtgcaccgctcccccgatggcgcgtgcggataccctacgcccgtccgcacgtttcaactccaatcgacgtgcgagtccgccgtatgaaaccgtttcgccgtatggcactttccgcagcaatgcccatgcttccttgcgaaacggcgtgccttccagccgcaacggcacttcggtccgaggtatgcaacctgcaaagtattcgtccagccatcgtttcgcggcgccaatcgtcggcgaatcacccaaaaccgcggaatcatcgtccgcatagcctggctgccaatcgaaccacaggccgagcaatgccgtttcgtcggtgatcagcgtgatgccgccaagcggcgaatcgtaatacgactttgttttcaccactgtcctccatccctccacaaaacacctatctcgcctatggatggcggatttcgtctttcgacacatgttatctcgcttatagatggcggacggcaaagtgaaaagccgcgctttttacccccatacgctatctcagggggtataagtcgaaaaacatccgccatctatagtggagatagcatcaggcagacccgcaaatccgccattcataggcgagataggaccaaaacgaaggagttggcatgggatacgcactcatcacgggagcgtccggcggcatcggacgcgaactggcggcgctgttcgcagcggacggacatgacctggtgatcaccgcccgcagccaggaacggcttgacatgataaaaaccaagctcgagcagcgttttggcgtgcatgtggtgacgttcgccatagatctgagcgaagccaacgcaccgaagaaactccatgatttcaccacatcacaaggtattgcggtcgaccatctcgttaataacgcaggcttcgctgactggacggattttctcgacgccgactggaaccggcaaaacgagatgatgcagctcaacatgcatgcgctcgctgagttgacgtatcagtatggccgagacatgcgcgccaacgggcatggcaggattttgaatatttcgtccgtcgcctcgatgatggcaggcccatacatggcgatgtatttcgcgtcgaaggcattcgtgcgctcgctatccgaggccgtggcccacgaattgcgcggcacgggcgtgacggtgacctgcgtatgtcccggtccgaccacgaccggctttcagaaggctgcgaatatgagtggccgcaacttcttcaccatgaccaaaccggccaccgcacgtcagcttgccacgtacgcctaccgcaggatgatgcgcggctcaaccctcgcctaccatggtccgctcaccaaggcgggcgcgctcgcggaacgggttcttccccgcgctctgacccggcgaatcgccgcgttcatgaacggcggcaagccgcacacgcttaaggtttaacggcgaatcgcttggacggacggtagcaaagcagagcgatgccgatgagtacggcggttgcggcgaggctgatcgggtagacgatcatgatggcctcgaacgtgcgatgcgcggggaacacgaacgcgatccaggtgatgcgcacgccgaccacgccgattacggtgagcagcgccggcaccagtgagatgccgaagccgcgcagatatccggacatgacctcgtacagcatgctgaacgtgtaggcggagaacaccatgacgagtctggtgtagccgacggaaatgacctccggtgtcgcatcgaacaacgccagcagactatggccgaagaacagcacgacggcgatggtggccgcggtggcgatgaaatcctccagaatgcagatgccaagcacgcgcttgcagcgtccgatccgtttggctccatagttttgcccggtgaaggtggcgcaggcctggctgaacgagttgagcacgtagtaggcgatgatttcgatgttgaacgcggcgctggaggcggccatgacaacggtgccgagactgttgatggcggcttggatgatgatgttggccacggcgaacaccgcgctttgcacgccggcgggcagtccgatgcgcagaatctgacgcagggtgaaccagtcgatgccgaactcgcgcaaatcaacatggatggctgcgtcagtatgaaccagtcgatacagcagaatcatggagctgacgacgttcgcgatgactgtggccgtcgcgacgcccgaaacaccccaatggaacaatacgacgaaaatcagtcccatggtcacgttgagcacgccggaaatggcgagtacggcgagcggagcctgggtgtcgccgatgctgcggaagatggctgtttcgaaattgtatagcaggatgacgggcatgccgatgaggtagatgcgcaggtatgcgagcgccagggggaacacgtcggcggtcacgttgagcatgccgagaagcggtccggcgagcaattctccgatgatggcgacgatcacgccgccgatcagggcggtgacgatggacgtgtgcacggcgttgcgcaccgcttcgcggctgcctcgtccgatggcgttggcgatgacgacgttcgcgccgagagcgatgccgatgaacaggttgaggatgagtccggtgacgggcgcgttggagccgacggccgcgaccgcggcggtgccgtcggattgggagaagttgccgacgatcatgatgccggatgcgttgaagagttgttccagaatgccggtcgccgccacggggagcgcgaatcgcaggactttcgtccatatgcgcccgtgcagcatgtctatgccctgcttgttgtgcaccatgttttgcctccgccagccgcagccggctcgtcgttcgcttccgaaggcattgtagtggcggcaccaaacgagggaaccgccatgccgttttgtaggatgctctaaaaaagggcaatgacgttttcgaattccctttggtggcgagtggagcccgcgcgttagtatgaaaggcatgagtgaaaccgtttcaaccgcatccaacgcggccgacgcatggacgaatccgctgcgcgacccgcgcgatctgagacttccccgcatcgcaggcccatgcagcatcgtgattttcggcgtgaccggcgatctgtcccgtaagaagctgctccccgccatctacgatctggccaaccgtggcttgttgccgccaagcttcggtctgacaggcttcgcacgccgcgactggaccgaggaccatttcaaggacttcgtcaaggagaacgtgcaggcgcattgccgtacgccgttcaaggaatcgacttggaagcagcttgcggccggtatccgtttcgtacaaggcacgttcgatgatccgaaagcgttcgagcgtctgtccgacacggtcgccgagcttgaccgcgaccgtggcacgcgcggcaatcacgcgttctacatgtcggtgccgccgcgcgcgttcccgcaggtgtcccgtcagctggccgactgtggtctggcgaaaagcgacaagggcgcttggcgtcgtgtgatcatcgaaaagccgttcggtcatgacctggccagcgccaaggagctcgatcgcgtggtctccgaagtgttcgacccgtcgagcgtgttccgcatcgaccattatcttggcaaggagaccgtgcagaacatgctggcgttgcgtttcgcgaacgccatgtacgagccgatctggaacaacaattacgtcgaccatgtgcagatcaccatggccgaggacatcggcgtggccgggcgcgccggatactacgacggcatcggcgccgcacgcgacatcatccagaaccatctgctgcagcttatggcgttgaccgccatggaggagcccgtctccttctccgccgccgatctgaccgccgagaagaccaaggtgctctccgccgtgcgcctgcccaaggatctggccgcgcacaccgcgcgaggccagtacgccgccggatggcagggatcgcacgaggtggtcggctacttggacgagaagggcatcgatcccgaatccaccaccgagacctatgccgcgatccgcctggacgtcgacacccgccgttgggccggcgtgccgttctatctgcgtaccggcaagcgcctgggcaagcgcgtcacggagatcgccgtggtgttcaaacgcgccccgcatctgccgttcgaatcgaccgccaccaaggagctcggcaagaacgccgtcgtgatccgcgtgcagcccgacgagggcgtgaccatgcgcttcggcgcgaaggtgccgggcggcacgtcgatggaggtgcgcgacgtgtcgatggacttcggctacggtcgctcgttcaccgaatcctcccctgaggcatacgaacgcctgatcctcgacgtgctgctgggcgacccgccgctgttccccaccaccgaggaggtcaacctttcgtggaagatcctcgacccgatcgaggagttctggtcgacgctcggccagccgcagccgtatcgttccggcacgtgggggccggaggaggccgttgaaatgctcgcccgcgatggacaccgttggaggatgccgtgatcattaccctgcaagacaccgagacccgcgagatctcggcgaaaatcgacgaactgcacgaggagcgcggcgaggcggccctgggccgtgtgctcaccctgctcatctccaccaacgaggccgagctcgagcatgatctcgaagtcgccaacaatgcgagccgcgagcatccctgccgtgtgatcgcggtcgccccgagcagccgcaagatcagcccggaagaggagcatcccaccttccttgacgccgagatccgcttcggctccgacgccggtgcgggcgagatcatcgtgcttcgtccgcgcggcggtctggtccgtcacgccgacaccctggtgatcccgctgctcgtgcctgacgctcccgtggtggcatggtggccgaacgaggcgcccgcgaatctgtcgaaggacctgctcggctccatggccagcagccgcatcaccgacgcgatgcactcctcgaacccgcggcgcacgatggacgatctgcgccgcaaccgctccgccaaggacgtggacatgtcgtggacacgcctgaccgtatggcgtgcgatgatcgcctcgatgctcgaccagccgccgcacctgccggtgagcaatgtgcgcgtgaccgggcagaaggattatctgccgttggatttgctggccgcatggctgcgactgcgcctgaacgtgccggtgatgatcgaggaggatccgaacgccacggccgtcaccggcgtgtacctgacgcgcggcgacggcgtgctgagcctggagcgcccctccaccgacgacgggttcgccgtgatcagtgtgcccggccagtcgccgcagaccatcagcgtgcccgcgcgcacgcttgaggaatgcctgagcgaggagcttggccgcctctaccccgatgagatctacagcgaggtcgtctcgcaaggactagatctcgtcaagcccaggcagtagccaccgagcgtcgaaccataatacaaggagtgaacgtgacagaacgtaaaaccgtcgtataccccaatccgcaggtactggcgaaggctgtggccgcgcgcacgctgctgaccatcatcgatctgctggccgagccgaatcgtaaacgtgtggatatcgccgtgaccggcggcaccgacggtaaccgtgtgttcgccgcgatgaacgccagcccgctgaacgatgccgtggactggagccgtgtgcacgtgtggtggggcgacgagcgcttcgtggcggccgatgacgacgaccgcaacgcgaagcaggctcgcgaggcctggtacggtgcgcttgtggaaagcgggcgcatgccggcggcgaacatccatgcgatgccggccgatacccgcggcgccgaggagatcgccgccgcctcccccgaacagaccgatgcggtgctggccgaggccgccgcggagtaccagcgcgagctcatcgagcagttgggcgagaatccggcattggatatcgcgatgttcggcatggggccggacgcgcatttcgcgtccctgttccccgaccacggcgaggccgagatcgacgacccgcacgtgctggtcgcaggcgtgcgcgattcgccgaaaccgccgccgctgcgcctgacattgaccgtgccgatgatcgcccggtcgaagcatacgtgggtgttcacctccgaagagcgtaaggccggcgcggtcaaggccgccttcgcccagcgcaacaacccgcatgccccaagctcctacgccgatggcgaggaactgctctggctcattgacgagggtgccgcttccaagttgtgaggttcatccgaaacaggtaacagggggtgtcccgcgactcatgccgtgagacaccccttttttttgagtgttgattgattgttgagtgtcgttttgacgcaggttcccgctggactgcagcttcgtaggcggtttcgcgtttccgtaggcggttgccccaagtatcggggtcatggaaaaggccggtttccggccttttccgcagcaggctcccaagaccaaccacctatggaacgcaaaaaccacctacggaatcccaatccgccgcctatttcgccccatagcttccgaaaacctctcgaaaggaggttagacgatggcattagactcccctagaaacgcaaatgggatgcatcacaaccacaagtaccattcgttctgcttacggagcgacactatgctccgtcaatgcaacggtacggcaatatcgcagctcagtaatatgcatatgccagaggtcttgcaatggaacacatcgcaagacctctggcatatccgccctgacacggaggcaaggaaaagatcaggcttcgatttcctcacggcccggctcggcccacagggtgtggaacgcgcccggctggtccacacgctggtaggtgtgggcgccgaagtagtcacgctggccctggataagggcggccggcagacgcttggaacgcaggccgtcgaagtaggacagcgacgaggcgaacgccggggtcggcagaccgttgacggcggcttgggccaccacgttacgccaggacttctcggcgttttcgatggcgttcttgaagtacggggcgaacagcagtgacacgttggcctcgccggattcgaacgcttcggaaatgcggttgaggaacttcgcgcggatgatgcagccgccacgccagatgcgtgccacggcggcgaggtcgatatcccaaccgtattccttggcggcggtggtgatctcgttgaagccctgtgcgtaagcgacgatcttggaagcgtagagggcctgacggatatcctcgatgaaagccttcttctcgtcgtcgttgaggttcaacttgccgtcggggccggcgaagccctgcttctgggcttcctcacgcaggtcggcttcggaggacaggccgcgggcgaacacggcttcggcgatgccggtgaccggcacggcgagggacagtgcggtctgcacggtccaggtgccggtgcccttcatgccggcgtggtcgacgatgaggtcgacgagcggcttgccggtcttcttgtcgacctggtgcagcacttcggcggtgatctcgatgaggtaggagtcgagttcggtcttgttccactcctcgaacacgtcgccgatctcagccggagtcatgccaagaccacgacgcatcaggtcgtagctttcggcgatgagctgcatgtcggagtattcgatgccgttgtgcaccatcttgacgaagtggccggcaccgttgagtccgatgtgggtgacgcacggttcgccttcggccttggccgcgatggattcgaagatcggcttgagggtcttccaagattcctcggaaccacccggcatcatggacggaccaagcagggcgccttcctcgccaccggacacgccgcagccgacgaagtgcaggccgcgggcgctgatttccttttcgcggcggatggtgtccgggaagtaggcgttgccggcgtcgacgatgatgtcacccggctccatcaggtcggcgagcgcgttgatcatggcgtcggtcggctcaccggccttgaccatgatgatggcggtgcgcggcttgacgaggctgtccacgaattcctcaagcgtcttcgccggatagaactcgccttcgccgccatgctcgttcatgagcttttcggtacgggcgtaggtgcggttgaacacggccaccttgttgccgtggtgagcgagattgcgtgcgaggctgccgcccatggcagccagaccgacgacgccgacgtttgcttcagctgacatactgttccctttcatggagaaacgtagtactttttatgaaccttccccagtgtagccccgagcgcacccaaagcgacggcccatctcagggatgacgggccgtcaaccggtcgcatggtttcagttcgttttcgtaggcacgatggtgcgtacgaatcgcatggcttcggctggggtgagcgacggcacgtaggcctgcgcgacggcaagcgagatctgcggcagtttcgccggatccggatagcagatgtacactttggcttcatccggatggaacttgagtttgaagcggaacagggagtggaatccgtaagccggttccatgatgtcggccaccatctgcagcacgtggtcgagtacggcgctctccccctgttcgtggccttcgccgctcatgccggcaagtggcgccgcggacaggctcatgaatcgcacttcgccttcgtcgcgcagccgttcggccatgcgggcgatgaggaattccatgatgccgttgacgctgtcggtacggtgacgcatgaagtcgagcgtccatccgaccactttgccgttctcataggtcggcagccagctggtgacgcccagcaccttaccgtccgtgtccaccgcgtacagcagtttgacgcgtggatcgaccagctcgtccacaccacccagggtgaagcccatttcaggcagggccttctcgccggcccattgcgtggagatctcacggatctgcgtctgcacggagaacggcgattccttgaatgtggcgagcacgtcggtgatgccgtcgcgcttggctttgttgatggcggtgcgtacgtcctgccatttcttgccgcgcgtctgccatgcggccgggtcgatcaccatttcggtgccgacgtcgagcgcgttccaaccggcggagaccaacgcgtcacgttgttcggcgtgcacgctgtagaacaccggcgtcagggaacgttgggtgcagaagccggcgaacgcatgcagatcgtcctcatactcgtcggggtcgccgaaaggtccggtgacggtcaacgcgatgccgtacgacacgcggtaggcgatggcggaacggccggtggcggagaaccagtagtcgttgcctttccaagtggccatgaacgacatggattcgccgccgagtccgatgatctcgtccacgcggtggcggtacgcgtcgttgatcatggaacggtcacgcaggccatcccatgtgcagcacagcgcgaccagccaaaacatcggtccgacgcactggtagacgatttcggaaagcagtccgaccggcacgaacgccggttccacgccacttagcaggccaatcggcagcaaacgctgcacgtagtctgcgatcagatcgaccagcagcggcgtttcgttgaagccggacggcatggacaggccgtagccgacgtacagcaatcccagtaatacgaatgcggcgaacgtgatggcgacgccacgcagcacggtctcgcttttcgtgcgaatggtgaagcatgagcggaacaggatgatgatgacgatgcacagcagcggcaacgccatcgtggccagcatcgcgtggaatgcgccgtgccgttgcaatgcggatatcgcatccatgtatgcaccggcgtcggagccgtccacgtaggacagcggaatagccacatagaacaccgtcgatagcgcaatggtgcatgcgttgaacacaatgctgagcgcggctgcgagatgacggcctcgatacagaccccaggcgatgagcagcagcatcagcgtcggcatgatggataccagccagttgccgggcatggtgaaacgcatcatgcggtattgcgtgaagcagtccgtatgcgaggcgccgctgaggcagtcgaccacacgtccggtgtcgaagtcggtggagccggttaacagtccgaacatggacagcaggccgaacgattggcgtgacgagacggcgacgagcgagccgatggcctgcacgcccgcgacgatgccgataagccgacgcatttcgtagatggcgccatgccggtattcgtcaccatgcgtgcaggaggccatcagatagccgagcacgtggccaatcaccgaagtggcaagcaggcagtagtcgctcacctcacctcggtagaggaacatgatgagcacgaccgcatagccgatcacgcggatacggcggcgccacagcatggttgtgaacgcgctgacgcacataagggtgccggcgacgagaatcagcggaccaaggatggcgccatcatgcgagatcgcatgccattgggggctgcgcccgtcggatagggagcacagtcccatgcccaaggccacgccacccagtgtggtgatgacggacacccatgcggttttgattttgccgatcaccgattcggccaggccgaacgcaaccagcatgagcggaacgtcgatgagcagacggcccagattcggcacgtacagcatggatatcggcgcggtgtaccagcggccgcgtgcgagcgcttcgaaacttactttggccaggctcggcgggaacggctgacgtatgagcgcgcacacgatctgcgtgcccacgttgatgaggatgacgaacagcacgaggcagacggtgagcaggtgtcgtctgatccatccggccagatcggcgagcagcgcgcggaagccgaacagtggtttcgcgggtgatgcctcggctggtttagcaggtgcggtttgcgtttgagtcatttctttccttttctgggattctcaggcttgcgggtttgtgttcaggatcgtcatatcgtgatgcgtttgagattcggatagtcggataggttcgggttcgcaccatccagtccggtgtcgtggccgaatacggcgagcccgtaacgcagcacgtcctgcacggcgtgccagtcgtgtgcgttgccggacgattcgacggcggcgacgcgcatgccggctttcgccgcgaccggcgcgattgttttgacgttgcgtattgaggtggtgtccttctcccccgcgcctatgatgagcatctgatgggtgggcgcgtggttgcggatggcgttgaccggcacttggttctcataggctgtggtgtcgccgtcgaagaaccggtcgatcatttcctgtcggctgccgttggtcggtttgatttcgctgtcggtgggaatcatggtgccaaacaggtcgggatggttcacgccgatctgcagcgaacatgtggcgccttgcgagaatccggcgatggcccaatccttggcatcctgtgcggcgggcaggttggttttcacccagtcgaccacgtcctgcgtcaggtaggtcagcgcattgccgtacaccttcgaatccacgcatagcgtgttgtgcgaatcggcgccaagctgatcggctgcgatgacgattggggcgagtccgtcgtgggttttcgcatatccgtccatcatggtttggatgccgccggcttggaagacgcgtcccggactgcccggctgcccgctcagcatgaggacaaccggcagggccggcttgcgtttcgagtcggccaatgccgccggaggcaggtagacgagggctttgcgtgcttcaaactgcgatttcgtggccggaatgtcgattttgttgacggttccgttcgccggaatattgcggattgcgccgttggcggcctgtttgcgccactgtgcgacggtgatgaggtccttgcgtttggccagtccggtcagatcggcttggctgtaggaatcctcgccgaacagcgagccgatggtggcgtattcgccgtacgattggtcgatgccgatcgccgcggccagtatcgcgaatacggtcaagatggccgcggccacgcgcatcatgcccctgctcaacacgatatgcacgatggcgaaaccagcgatggcgaaaccagccgccacccaagacatcacacgggatcccaatccgacgccgaacaccacgaacacgtcggacagcagccaagctaccacatagccgaccattccggacacggccgcaacgccgatcggcagcacggtagccagtatgcgtccgtcccgtttcgaaacggccgcgctaaccagcagggttacggacagcactgcgatgacggcgaacgccgccgccggaaaccagcctccgaccaggcttatgttcataagccactgacgcatatttcccatccccaacatataggttttccttcaacttgacagttgtagtacgcaaaataacgggcacgcgtcatccttatggctgatttcgcctcaaaactcagggaaaaccctgaaaccgccgtgaaccgttcgctattggcgtatggttttggctatgacatacgtattcgaagcatcgaacgtgcgctgttcgattatggtcgacggcgaacgccgcaccatattctccggattgtctttcgccatcgagcctggcgaaatcgtggacttggtcggaccgtccggcgcaggcaagagctcgctgctgaccgctttcgcacggctcaatccgcgcgcgtcaggcgatttacggttggatggccgttccgccgacgatttcaccccgcagcagtggcgcgcgcaggtcgcgtacctgccgcagaagccggtgctgttgggcgagacggtggcgcaggcgattcgtctgccgttcacgcttgccatacgccagtcggcgagaacgaagcagggaccacgcaggatctcccccaccgacgcgttgccggacggcagaatccgtgagaccttggacaatatgggttgcgccgacatcgatctgaaccgtccgccacacgacttgtccggcggtcaggcggcgcgcgtgagccttgcgcgcacgttgctgacccgtccgaaggtgctgctcgccgacgaagtggacgccggattggatgacgacaacgccgagaaagtggcgcgtatcctcgccaaagcggcggcggacggcatggcgatcgttcgtatccggcaccggccgccggatggccgtgccacacgtgtcatgcgtcttgccgatggcacgctcacgcagtccggcaacgccgaagcggacggtactgcgacgggtagtacttcgacgggtaacacggtagaagggagcgtcgcatgaacggcaactactatgcgatcgacatctggggtctcatcgccgcgctggtgatggtggccattgccgccggcatctccgaaaccatgcgtatgggtgtgggacgtacgttgctgtggtcggcatgccgagctttgctgcaattgtgcgcgatgggcttcatcatggagtacgtcatccgttcgaacaatccgtggctggtgctgctgctggtggcgttcatgctcatcgcggccgtgcagatcactctttcgcgtgcgaaaggtgttccgaagggcttggctggaccggtgttcctgagtctggtcgtgaccatgctcatcatgatctcgttggtcaccgagctcatcatccgtccgcaaccgtggtatgcgccgcaattggtggtgccgttgaccggcatgctgctgggcaacaccgtttcggcgttggcggtggggttgagccgcttctttgaaagcatgaaggaacgtcgtgacgaagtggacacgctgctggcgttgggtgccaccacgtgggaggcggcacgtccaagtatcgtctcgtcgatccgtctgggattgctgcccaccaccgcgtcgctcgcctccgccggcattgtgacggtgccgggcatgatggccggtcagatcatcgccggcggcaaccccatcgacgcagcgaaataccagttcatgattctcgccaccatcgcggcgcttacgctgctggcggacagcatcatcatgctgatggtctataaacgttgcttcaccgcgctcgaccagtatcagccggtcaacagctgatactgcgatatcccgtatagaaaaagccgttcattccttgcgattgctggaatgaacggctttttgcttgaccgttgacgtacgtcagcgggagcggaacggcgccttgcggatcttcgcatgcttgcggtacggcttaccctgcctttcgcccgcatgcttgtcgtggcgttctccgtgaccgccacgacgaccggaatcgccatacttggcttccatgcgacggtcataacgcttcgcgtcctcgcctcgctcgtcatgaatcacgcggatttccttgcgatggatgcgtttgccgccctgacggcggtcgtcgcgttcgtcgcggttcctgcggtattggcgatcgtcctcgtaacggcgttcggcacgggcttcggccttgcgctgcttcttggtcggcgcgccctgctttttcgcatactgctttttgccgggcttcctatcggattggccacgctgatcggaacgctcgtcggagcgccgcttgcgattgtcggttccacgctgttcgccggcttcggcacgctgctgctcatgcagccgcgcgtacttttcgcgacgcttgttgttgcgcttctcctcgtgcttctcgcgcttctcctcttggatttcaggatgttcccaacgatgctcgcgtgcctcgtattcgcggttgtcacggccttcgaacttggcggcgcgacgttcggcgcgattctgtttcggttcgaaacgctgctcgcgttcggcgacttcggcgcgctcttcacgtcccttgcgattcgcgcggtccttgcgttcggacttgaacggcttgccgcccttgtccttgccccggtccttgttgcgtccaccggaacggttgcgtccggagcgcccgccgttttccgcggaaccgtcgccgcccttgccatgcctgcgacgcggattgcccgccggctgggactgctcaagcgtccaaccgaaacgcggttcggccgactcgcccaccaattccaacacttccggggaatcgtgggtcacttcgatcggcttgaccttcagtccggcctcatgcagcatgcggcgggtgcggcggcgctggttcggcagaacgatggtcaccacatcaccggaatggccggctcgcgcggtacgtccggagcggtgaaggaacgatttcgggtcctccggaggctccacctgcaccacgagctccacgccggacacgtcgatgccgcgggcggccacatcggtggcgaccatgacgttcacgtcgccggattcgaaggctgcgagattgcgatcacgctggttctggctcaggttgccgtgcagctcggccgccggaatgccgttcttcgtcaggtccttggcgagcttctgggtctggaatttggtgcgggtgaacaggatgcggcgtcccttgccggaagcgagggtgcggaccagctcatgacggtcgccctgcgtggtttcgaacacgtggtgggtcatttcgtcgacggccgcggtggcggagtcgacgctgtggatcttaggatcggtgaggaacgtgttcaccacctcgtcgacgccatggtcgagggtggcggagaacagcatgatctgcgcgtcgaacgacacttggccgagcaggcgcttgaccggcggcaggaagcccatgtcggccatttcgtcggcttcgtcgatcacggccacttcgaccttctccaaggtcagcgcatgctgttcgagcaggtcctcaagacggcccgggcatgcgacgacgatatcggcgccggcccttagatcgcggatctggcgggcgtagcgcacaccgccatacacggtggtggtggtcatgccgtacatctgcgcgagcggcatcagcacgtcgttgatctggttggccagctcacgggtcggagcgagcaccagaccgcgcgggtgcggcaggaaatcgtcggcgcgccgttcctcggcatgccccttgcgcacctgttccacctcatggcggaactggctcatgttctcgtactcgtcggcgtcgacctcacctaggcgtgcgaccagcggaatcgagaacgccagggtcttgccggagccggtacggcctcggccgagaatgtcacgaccggccagggaatcgggaagggtgtcggcctggatcgggaaagcggttttcttgccatcggccgcgagcacgcgtaccaacgggccgggaacgccgagttcggcgaacgtctgggggcgttcctcctcctcgcccgcctcatcgaaatcggcggcgagggcatcttcattttcaatcacagcggtatcgggcacaatggcctttcatgtcaaacattgcgcacgttgcgcaaacctgttaacaatagcccatgcccgatacttttgccttggctgtgactggtggccgacgctaccggtagttgcgttcgatgaggatgtcggaaaccgtcagattcgcgtcgttgacgaggttgaacagcaccacttcggccagttccgcggcgctcatgaaggaatgctgcttgtccaacgacacgtaatcgtggctgtcatggtagaagtcggtgtcgatgcctcccggatacacgcccacaaccttcacactggttcccttgtaggccgccttgaggcttgtcgtataccccttctcaccccacttggtggcgcagtagacggattcgttggcgttgccgcgtgtggcggcggtggacatgacattggcgattttgaggtcctgctcgccgtcggccttcaatgtttcgacgctccacagaatcatgcctttgagccccttaaggcacttgtccacgtcggcggcctcgtagtcgaccggctttttgaacgacggctgtcccgcgttgttaatgagcaggtcgatgtggccgatctccttgatggccgcgacggagtccttcacgaacgcctcgtcgctgatgtcgccgacgaaggcgcggtattcgtccgcgccgaacgtgcgggacagttcctcctgacgggccgtgttgaaatcgatgccggccacgaaccagcctttgccgatcagctgacgtgccagctcatatcccaagccaagcgcggaaccggtcacaatcgcgattttctttcctgccgcagtgctcatgttgtctcctttgccacattgcgcaatcgcttatagataccatcataaaacgtatgcgaagcaacacgtcaatcgattgacgaaaacggcaatgaaaaacgcccgccgacctttttggccgacgggcgttgaactagccagcgtgagatgcgatccgttacaggatgtccggatcgtccttggcgatggtgccggtcgccttgccgatggccttcaggccgtggtaggcgacgaggatgacgacggtgccgatggcgatgccgttgaaggagatgccgttgaaggcgaactcgaactggccgacggcgatgatcatggtgatggcggccaccatgacgttgaccggcttgtcgaagttgaccttgttctcaacccagatgcggatgccgaccatgccgatcatgccgtacagcagggtggtcacgccgccgagcacgccggcggggatggtgttgatgatggcgccgaacttcgggcacaggctcaggatcagcgcgaacgcggcggcgcaccagtatgcggcggtcgagtagaccttggtggcggccatcacgccgatgttctcgccgtaggtggtggtgccggagccgccgccgaaaccggcgatggtggtgccgagaccgtcggcgaacagcgcggtgccgatctggtcgtcatagtcgcggccggtcatctgggagacggacttgacgtggccgacgttttcggcaacgagtacgagcacgaccgggatgaacatcggcaggatggtgaagtcgacctgcggcagacggaattccggcagaccgacccatgcggccttgccgatggctgagaagtcgacctggccacggaagcaggcgtacgcgtagccgatgatcacgccgatgaggatgttgagtcggccgagcagacccttgaacagcactgcgacgagcagcaccgcgacgagggtgacgatggcggtgtcgggagcgactttgaagttgttccacacgctcggagccaggttgaagccgatgatggccacgatggcgccgttgacgaccggcggcatgatgatgtcgatccacttggcgcccgcgtaatggacgagcacaccgatcagggccagcaggatgccggtgaccatgatgccgaaggatgcgacggcgaggcccttgtgggcgctggcgacggccgcgatcggggcgatgaagccgaaggacgagcccaggtagctcggcagcatgttcttgttgatcagcaggaacagcgcggtcgacatggccgtgaagaacagggtggtggacgggtcgaaaccggtcagaatcggcaccaggaacgtggcgccgaacatggcgatgacgtgctgcgcgccgatttccgcggtgcgcggccaggtcagcctctcgtcaggttcgacgacctcgccgggcttcagcgttttgccgtcgccgtggagcttccacgtgaacaggcccgcgattggattggacatgcgattgtctcctaactctctcacggcacgaaacacgaacacgtgccgcacaatcacaggccattgtagcgactacgccgatacgtatggtttcaaagtgaggtagggggcaatcatcacagccaaggatacttatggacacgataggtcacagatgacggtcgacggcatgtaccacgtccaccaaatcgccattcgacaacacaggacgtttgaattcgcgccaatcgtccaccttcaccacccagcgtccgtccgtctcgtcgagcaccgggcgtgccgtctgctcccaacggaaccgcttatgggtgcgcccagtcgacgggtcgcgccgcgaatagtggaaacacgtgcagttggtgatcttccattcgtcggcggccgctcgatgcatgaactcctcgtcggacaggtcctccaacgtgagcatcaacgccagcatgaggtcgccatggctgaccatcaccacggattccgcatccgacttgcggttcagggacgtgagcaggttgtgcacgcggttctcggccacgtcggcgatggactcgcccgccggcggacgccagtacagcggatcggtgttcttgaacatccagttgcgcgcgtagttggttttgaaatcgtccttcgtgatggtgttgatctcaccccaggagcgttcgcgcagcacgcgagtctcctcccatttcgccttaggcagggccatcgtggccgccgtctcacgcgtgcgcacgtacggcgaaacgaggtagcggtcgaacagcggctgctgcgcgacgagccaacggccgatgcagtcggcctgcttgcgtccggtggcggtgagcctccacgaacggtccggcacggtgacgttgtcctgcgtatacagcgagttgtcaccctgttcgccggcgctgatgatgacgttcgcctccgactcgccatgtcggatcacatacagatcaaggggcattcccatattcgtttattccttcgctttcatccacatcctgcgcgcacgttccttgttccgccgttcattcggccggtggtgcgcatcatcattgaatgcttccaccgtagctgattcgcgcgtgtttcgcacgcgcggacacgtcgatttcacgattggcacacccgaatttcgcggtgccgtcaccggcggttcaccgcaaccggcgtggtagacgccgtgatcgcaatcactccggccagatgccgttctgcgcgtacttggtgcggtactcccccggcgtcatgccggaatgttttttgaacaccttcgagaagtggctttgcgaccggtatgcgaggatctgggcgatctcgtcgaagctgtattccgagtatttgagcatgttctcggccgcttccatacgcttgtcggtgatgtattgcgatatggccgtgcccgtttcgcgtttgaacagctccgacagatacgtgggattcagatgcacatgctcggcgaggatgggcacggtgattttctcatgcagatggtagtggatgtagtccaggcattcgttgacggctttggaatgtgtttccgccttctgcatgtcggccatggcccatgtgaagaatgtcatcatgtcggtgtgcaggcggcgcacgtcgtcgggcgtcttgcagttttccaggttctggatgtacaggtcggaggcgttgtaggcgtcctcctcgtccataccgccttcgatggcgaaacgtgtggcgagcgtgatggtggtgacgaaccggtatttcgcgtttttgagcggatcgtccgacaggtagccgtacagtccggagtcccacagacgtgtgctttcggcgatggcgttgatgtcgccggaacgcatcatgtcgtactgtttcatctcctcgacgtaccggtggtgccgaacacgatcctcgcgggagaggaagtccaagtatctcagcttcgcttcgtcaacaacagccatgcttctccccgctatttccgatcgtccaaatcgaatcctccctcaaggataaagctcttcagcagcttcgtggcgagaagattcgccgtgaattgggagaccggactatccggcttatcgaaaaacgcctttgccaaagacctgttaaccgacgctttcaaccggtcgaatcgtccgaattcgttcagggttgtctctgtaaggtcaagccgcatcatctcgttgagcaacgccccatccacgtcaaacgccttggtgatttgctccacttggctgtttttggcgctgttcgcgtaatacgtgatgtagtcgcgcagcgtcttgccttcctccaactcgatttcgccacgttccacatcatgcatgaacagttcggcataccgttgttcctcttgactgagcgaagcaaacgacttatgcaactcctcctcagctgatgccaacagggccggatcgcctccgccaagcgccttgagccatttggtgaagttggcgttcatgtaatccgtatcaatcaatcctgtatctatctcagtgatatggccgtcaagttcatatggtgcttccggaccgctgccggaaccttcgccgctgctgaacatttccttataccgctgtacaagaatcagatatgtccgttcatcaagcttcggccgcacaacctccacggatccatcgtcatgggtgacggagtattcctgctgttcccaagtgaaaccttgcactttggcggattccaggaaatcattgagttccacgaacagttttgcgaacttgcggcatgcctccaccgattccggcagtcgcatgaaatcttccacgcctccggcactgaacacggaagcgatctcttcgaaacgcgcatccatcaggcgcacgttttccggcagtttctgcacgaacagatcgagcggcttgtctccggaatacagttttaccgccgcttcgatataccccttcatggtgtgtggcttgcggtagtagcgaatagttccgaaaggcttgtcgggaccgaacagtcggttcgtgcgactgaacgcctggatgatgttctcatagtcgatgattttgtcgaggtacagcgtgttgacccacttggaatcgaaacctgtcagcatctgatcaaccacaatcagcagatccagccgctcctcacggtgctggtcgaccgtcaggtacggacgcttgtgggaaagccgcgcggtgatgtctttcttcatcttcggccatgtggggatgatgaaatccttgtcgaacagttcgttgtaatcgccgatgatttccttaagcgcatcctccttgaggattgcgccgtcggaattgtcgacgttggggtcgaacagcgcggtcacgtgcatctgcggagcacgttccttgaacagatggtaatagctgatcgcctcgggaatggaactcgtggccagcatcgcatggaatttgttgcctctgctcagcaatgggaattggtcgagaatatcctccacgaccttgtcttcatgtggcgtgccttgcgcatactgcgctgaggtcagatagtcctcaatgcctttgacatgttctcctgcctgcgtttccatgggtcccatcggcatttgcttcgggtccatgtaatggtagaacacctcagctttcgccggatccgcctgggcttcctcaaccgttgccgctttcgccttctgcaacgcgacagcctgacgaacatccttgtctcggtaggtcaacaccatgtacgggtcgaatccgagcacattgccatcgcggatgccgtcggcgatgctgtatcggtgaaggcaatcgccgaacaccattgatgtggtcgcgcccttcttacggttctcttcatgaatcggagtgcccgtgaaaccgaaatacaacgcgttcgggaaggaatggcgaatatcctgcagcatctcgccgaacgtggaacgatggcattcgtcgataatgaatacgatgcgtttgccagcgagcttcttcacttcctcttcggtgatatgcccctcgcccgctttgatgttgctcattttctggatggaggtgacgatgagtgtgtctttggggtcgatgcttgccagtttcgatttgagcacatccgtgttttccgtgccctgcacatcatcggcatcatccgcgaacgaccggtattccagcagcgactgcgtgcccaattcgacacggtccatgaggaagaccaccttgtcggcatctttcgagccagcgatgagctgcgcagccttgaagctggtcatggttttgcccgagccagtggtgtgccacacataaccgcccggacggcccggcgtgccgcttggcaccggctcatcccatttgcaggtgcgtacacggtcggaaatggcgttcaccgcctggtattggtagctgcgtagcactttgaggcatccgtctgcggaatcggcgaccgtatagaacccgatgagctggtgtgccatgggaatggatagcagatcagatgtgaaacgcttccattcatcctgcccgacatgtttgttcgccgctatgggctcattgttgaagtcagcccagtggaagaagtagttgctgttgaaatcgccttcaccgggattggcgaagtacacggcatcatccggattcatggccacgaaaacctgcacgagtcggaacagcccggtgaacacgccttcatgcgcgtatttggcgatttgattggtggcctggcttacgggaatgccgcttttcttcagttcaatatggatgaccggcattccgttgataagcaggcaaacgtctcccctgcgatcgttcagcatcttgcttttcgccggataaataggctgtcttgcgatttggtaccggctttgcccagcggcgatttcctggcgatcgtagatcttcaggctgatttccttaccgaaatgtgctgtgtctgcgggattgtcacgtttgatggacacggtcttgccgttgatgaaggaattcaacgccaatggcgtgcgcaatgtttcgatctgttcgaggatctgcgccatctcacccttggtaaggcgctgcccgttcaggcgatcgatgcctttgttgttgtcgaataggatgttagcccagttgtcgatgagatcctgttcggttggatattccaacacaccatcggtccacccgtggcgtttcagcaccgcaaccagatcgtcttcgaaatccgattccttatcgtagaacatgttccatctccccgaacgcaccatcacttttccgagctcaatcttacgagcgcaacccctaacatccaagaaacaacaccacaatacttacgctgatgaagggtgatgagcgaatccagacggtcgaagaacgcgccgattcggcgctgctccatcagggatggcagaggcaaaaggagatctgaatattcttgcgcgttgatgccgggctgccctgaacgctgagaagtaagcaaaacaaactgcttataccgttcagtcagtgtgctctgaaagatgaaaccagcatctgcctcatctgaaacatgcgctcgaataaggaaaccggcataatacgttttcccgtctgatgccttatacaggtaggttttacctacgctggccccggttcgtgcaaataatatatcgccttctttgagtagatacctgtcatcaatcggattattgatatcaggcgaagataaatcatccgtacggaattcacgagtttgatcatctatatcagtgattcgaagatactttttctcaccatcgaaatccgaagcagccgcattcaaaccgtactcgaatccagaagcaacttcccccagcttacgctgttcccaagcgggggcgattgatacgggaaaacggccacattatcgctcgtgtatgcggttgagcttccttcttgtgagcattagagcgtatccgagcagattctgaccgcgccattggctcggattgaacctggctggatcatgcattgacaagccaatgccccagatacggtctttgacggcgcattccgccaacaccgcattgccggttgcctcaagctgcgcaccgagttcggcgttctgactgaatttggcaagcaatccttcatagacttcgatttggcgaacgccgttccatacgtgatcgtcataaccggctaccagtcggccaagtcgtttgatctcggccacgtcgctggttcgaagaatccgcgcggctgtttcggtatcgttgaaacagcaggctttgcggtacatcatgtactgttccatcgaggaaaactcgacatcatccacaacgaagcgcgatggataccagttgctcaggtatccgttctcctcatcgggattatggaagcagatgatgtccgtcattcttcgccgactttccgcaccgcaagctccagatcgagatcatgaagcccgaaataggctttcttcaggaagtccagcggcaccttggcgatcacttcagcactgggaatggcgtagaaccattggtagtaggcgtagaattcgccaatccaatcaggcatgaacccttcgagcgccctgccgtccttcaactggtagtgctcggtctcggtgaaatacttccacagctctttcgcatccatcgtgttgacgtaggctttggcctcatcaatgcttttgcgtgttttgctcgccatatatacggtgatgaagtcctccgtgctcttgcccggaaacgactgtgccacgtagtcgaaaagcttgccttgagtttccaccacatcatcccggtagacctctggatatgcccgcattgtcatcacccctagagcaacgtgctgaacacgttggtcaccgtattggcatcggaatcgatgaggtcgcgcatgttctgccgtgcctcaacatccctctgattgtatttgtcgttgaattcgctgtagctgacggaaagcaggccgtccgggacttcgcgcagttgcctgtacgcctttgcggtcttgacgcaatactggatgcccagacctccaagcgacagcagttcctccaagatatcgacgtccacattgtctcggacgaattctttggcgatataaaaatacgaggcgttcgcacgccagcctttgatgacgtcatagccgctggtgtcgatgccgtattgggcgatgaacttcgcagccagcacacgatagcgcttggaatcagcggcatcacgatgcttcatcagctcagccagccaagtaagcacgctatgctcctgaaaatccaggatgcgcagcccattcgtgtccagttcgtactgatggacccagccattggactcatccggccggcacacggcccactccttggccagttccacattcgcggtcagatagaaaccacggccgtagtcgtgtttgtcgttgcctaaaccgtattcgggggtcacggattcgtacggagaaccgtgaaataacgtgattattgccatgaacacccctatacaaacatcttgtcgagcatggatttcttgatattccggagtaattcgagcttacgctgatgaagggtgatgagcgaatccaaatggtcgaagaacgcgccgattcggcgttgttcatccatgtggtctggcaaagatacagccatatcttcgacgtcggatgcgttgtacgacggtagagccccaacttgaaccaaactcgtcaagtctatccgctcaaaaagcgattgaccgaattgcgaatccaaccggtttggatccattgaaaatgccatcgtgttgttatccagcaggaatggctcatttaccagacgttttctatttaatagaacagcagcgccgactttagcaaagaaaattgccggcacctggcaaatcggatgccagctcatacgcgcgatttgatcggcggtcacgtaattgttcgatataaccaattcgcgttcattgcctggcgtattcatatccgacaccttgaaaaagggtatcccctcggaaccgccttgctcagcatcgggaaagcctattcctgattgagcaaaaccaagttcccccagcttacgctgttcccaagggtcagtgaaaccggcgaaacgaatctctggatacagtgaaccccctttagggaacattttgtcgagcatggattttttcagcacgcaaagcttgtcatacttacgctgatgaagggtgatgagcgagtccagacggtcgaagaatgcgccgattcggcactgctctggcaaaggtggaacgagaatttcctgcttaagaaaatcctctacaactaattcgttcatcatagtgccactttttgtggaattcacaagaattggccgcataaccttctcactgtgaataaagtacttccaaaatgagtactcctgttcagcaattggccgcaaacaagtgaatcttggtgacatgatgccgtttccagcatcattaagcacgaaccttccataagcaaattctttattagcatgtccttcaaatgcgatatcgcctaatcgaagacgcttgtagttcggcaaggaagaatcatcagctccgttgcctgcagaattaaacgtcattgaagcaacagataaagttcgttcagaccctaaaccatcagtatttcgctcgtcatttttctggtatagctcccccagcttacgctgttcccaagggtcagtgaaaccagcgaaacgaatctgcggaaccagtgtttttccgtgctgttcggccatatcattcacctccgagcagtgctttgagctcttccaagcccgccatatcgcgagcattgccggtcaaatcgcccagcattccagccaattccttctccgcttcatcgatttggccgcatacatcggcatatgtggtggcatacttgttcttcaacgcgttcactttgccgatgaactcgtcgatcacagcattcggcaatgcttccagttgcttctgcaatggtgtaatccacttggcttccagcaaccttctggcttcgtcatcgctcaacaccttgatcgcatcgcaggtcttctcctccaacgcgtttcgcttggttttgataccagacttcagctttttcgcctcatcgaacaacttctgggcctgcaccaagccgcgctcaaaatcagaaaccggggtcttgccgatcgccttgaccgctttcttcagttcggcggcaacgaaagcgtcaccgtcctgattgatcgcatcgctattctgcttgtcatcctcatcgaaaccttccaaaatggtttcaatctcggaatcaatgtcctgcacacggcgttcgtccgcctcgatcgcggccaaatcatcgtgcagcagctcacgttgaaccaagtcgaagggcagaacgcggccaatccagccatcctgcacttccacatccttgccgccttttttcttgatgaccatgttcgggtccacggctcttaccgcatcgaagccttcggaacccagcacttccaaatcaatggagatgccgccccaagcatcatcaagcttctgataggcgtcatacgggtcgatcagcgcggtatcggcaaccatcgcatccagttcctcaccaatggccgtttcctgcccgagcgcatccacctgttcaggatgctccaccaagcggaagcgtaggtcggagggaagcccggaaatggcctgcgcatatgaagcgacgaacgtctgtacgtcggcattgttgcgcaccacagtggcgacgtcatcatggtcgcaggcatagcaggcaccattatcgcggaacagctcagccttcagactcggccaggcgttccaatattccccaagctgctcgacctcgctcttcggaacgcctccgaacatcgaagcgtacatatcccatgtctccgcattctcagacgaatcaacataccggggaatgttgaggttgtaatcattggcgcgaatctcgtcaatggacaccaaacggctgaatttgggcaccgtgcggttgttcgacaccacgtcgacaatgcgtttgatgtcagaagcctgtagcttgttgttcttgccgtccttgatgaaatgtttcgacgagtcaacaatgagcaccctgtcgtcatcgcgtttcttgcgcagcaccatcacgatggtggggatgcccgtaccgaagaaaatattcgccggaaggccgataatcgcctgaatatggtggttttcaatcaggttcttacgaatctggccttcctcgccgccgcggaacagcacaccgtgcggcagaacgatggtcatgatgccatcggcacgtagatggtacaagtcatggagcaggaacgcgtaatccgccttggacttcggtgctatgccatagctgaagcgtggatcgatctccttgtcagtgggatcccaattctgcgagtagggagggttggagaccaccgcatccacgaacaacggattgtatgtttcctccttgttctccaacgtgtcgaaccacggccagtcgtcttccaaggtgtcgccgttgcgggcgacgatgttgtcgggaagaataccgcgcatcaccagattcatacgcgtcaggttgtaggtgttctctttgagttcctgcgcataatacatgatggaattcggattgccattgcgccgagccacagactggccaatatgaatcagcaaagagccggaaccggatgttggatcgtagatcttgatctgctcgcgcccctgcaaatgccatgcgacgatttcgctcatcagctgggagacctcggacggtgtgtagaattcaccggccttcttgcccgcattggcggcaaaattgctgatgagatattcgtaaatgaagccaagcacgtcataatcctgacggctatccatcggaatgtccttaatgagataaatcaggtctcgcgcggccttggactggcttctcgcatcagtgccaagcttggaaagtccggtctgcagggtgtcgaaaataccgtcgaacactctcttacgcgccggattgatgttgcgggagaacgccgaaagcgcatcacgcacgttggaaatctcgaaatcgttgccctttttgacccatgtggagaacaggttgtcataggagatgaagtagccgcactcatcctgtacgccttccacaatgtccggattatcctccgtaagcagcagcaggtcatcctcggtgaaatcggtgtccttcaagcgcatcagctcgttttctgaaaggaatttgtagaagatgaagccaagaatgtaatccttgtattcgttcgcctcaatcttggaacgcatcttattggcggactcccagattttcgaagcgagctgctgcttgttcatctatccctcctcattgcggtgccggcaaaatgcgcggctccacgagcgactgcacatctttcacaagaataccgcacccccgcttgggaacagcgtaagctgggtgaactgttcgaggagagtgatgaacgagcttccgatagagagattttgtctgtcagcgtagccaacgggatatacccagcatctgagtccgatagggagacgaatcctggcgcgagtctcgcgaactacaaaatagtgcatttcggagatgtcgtttacaacagtatgcgcatgtggcagggggctgtagatgcaagtcggtacgacggcatcgtaagccccgcatatgtagtagcaaggcccaattccgaggtttatgcacgattctttgcgcgccttctcaggcaaccgatgttgctaaaacagtatcaacaggtttcgcagggcaattccaaggacactcaagttttgaaattcgatgactttgcttcaatcggaatttctatgcctgtctcagaaaacgagcagcgccaaatcggcgggttcttcgaccgtctggactccctcatcacccttcatcagcgtaagtatgatggctgcgccaatcccctatttttagaaaggcgcatctcatgcaggaaaccatcacatcagaatcgctgttctgcgactactacgcccagtgggtgaaaacgtacaaggaaggcgccatcagagacgtgaccatgggcaaatatcgacttacgcaatcctggctcggcaagctcatccctgaactcagactcaccgatatggatcgaaccgcataccagcagctcatcaacggatatgcacagcatcatgagcgccaaaccaccatagattttcaccatcagatcaaaggcgccattctcgatgccgttgacgaaggactcataccccgtgatccaacgcgcaaagtcatcatcaaaggcaagcagccacgcattaagaaaatgaagtatctcaaccaattcgagctgcatgccatgctcgcggaccttgatcttggggccgaggcaagctgggattggcttatcctccttatcgcgaaaaccggactccgattctctgaggcgcttgggctcacacccgatgactttgatttcgcacaccagacgctttccgtcaacaaaacttgggattataaaaacggcggcggtttcgtacccacgaaaaacgaatcgtccgtgcgtaaagtgcaactcgactggcaactcatcatgcaaatgtctggattactcaaggatcttccgcatgataaacctattttcgtgcacggcaaggtctacaactcaacagccaacgacgtgcttgcaaaacattgcagaaacgtggacgtgccagttatttccgtccatggtctgcgccatacacacgcatcgctgctgctgttcgccggcgtatcgatcgccagcgtgtcacgccgtctaggccatgccagcatgactacaactcaggaaacctatctgcacgtcattcgcgagctggaaaacaaggatgtagatatcgtcatgcgggcactatcgacacttatctaatgggggggttcctactcttttcagatattcgaaataatcgagccactcgaagcggcatataccgtttttcaccatcttcagtaaaagcgccaaacaccgttgccagactcaattccgtaggtggttttgtggttccgtaggtggttggttctggtattggtgtctgagaatggcttaatttaagccgtttctcaaacgcctttcctccggcaaccacctacggaagcgaaaaaccacctacggaacacccgcttgggaacaaacccgccgcaagtcaccaggccaagacgaatctcggcacacgaggaaccggaaattgtcgttccggagcgcagccgcacggtcacacgccacactccggaaccaaaggcttttagaaataggtgctacagccaagcttgacggcgaggacgatgccggtgagcacggcggcggcgcgcatgatgttctcggggatatggcgtgtgaccggaggggcgatggaactgccgatgatgcagcccaggcacatggcgatggcgaacggccagtagacggagccacggcagatgaacatgatcgcggcggagatgttcgcgccgaagccgaccacggtcttcagcgcgttgatctggtggaacgggccgatcttgccgaggtcgaggatcgccagggcgagggtaccggcggcggcaccgaaatatcccgaatagatgccgacgaagctcacgccaacccacagccaccacgggtcgttgcgcagactgccattggccgtcctactggcgatcagcgccgcgcgctcgccttgctgcgattggggcaacgcctgcgcgacagcgtcgcgtgcggccgctttcttccgcgggttcagcgcgatgataagcgcgctgaacaggatgagcggcggcacggcgaattcgaagaccttcgcgggcaattccaacagcagcaagccgccgatgatgcctccgaccaagccgatgcaagcgtagacagccacacggcgtccctggcccttgagctccttgcgggcggagagcaggccgccgatgccggtgccgcatacgcccaccgtgttcgtggtgttggacagcacgggcggaatgccgaacgccagcaacgcaggataggagatcagcgaggacgcgccgaccgcgtatccgacgaatcccgcgccgattccggcgacaagcaccagcagcaaagtggtgatggacactcctgcgatcatgaccgcttccccttcgtaaaactcctacgtagtcctcctataagtaacgggagccgagcttaacggctcggctcccgcatatcacgcgtttgcccagaacgtggccgggcaaacgtcatatcagtggttgcgcttggcgatcagcgactcggtccagtaggcggcaagcggaatcagcgcccactgcagcgcgagaccgggcaggccggcggccaggtcgctcgtccatgtggcggcgatggccttgctggaaccgaacgcgaacacggcgatcgcggtggctgcggtcagcaccacacgtccggcgagctgtgcgatgaccaccttcgccaggctcggcagcttgatgccgcgcagcagaccggccaccaggccgtacgcgcacagttcgaccatcatgagcggcagcatcgccagcatcggcatgccggacagcaggaagctcacgagcggagcggcggcgccggcgatcgcgccgacggcggggcccgcgatcaggccgacgaagatgatcggcagatgcatcggcaggaacgcgacgcccagcatggtgccctgtccggagacggcgccgatgacgtggaacagttgcggcagcacgaccgctgcgacgatggcgagcagggtggctgctgtcttggtgccgagactcagtttcggcaggtcggtgcggcgcagggcggccgcgggcatggttgcggaatcagacatttgttttctccttaatgtttccttctcttcggatatgcgtatacgtcataccggctcgacgaccgacccaccgtccggcagcgcggtgtcgaccagcaaatcggcgacggcttggatattggtcgcttcgaaatagcggttttccagcggaatccactcgtcgacgaatcgttgcaacatgcgtggattgcgtcgttcgagccgacgcaactgttcggcaggatcgaccgcaagacagatcatgcaatcgtaatacctccgcaaggcggggtgcatgctgtagctgccttccacaatggtcagctgggccggttcgacggcgtacgcgacggcgaaatcgcctgtatggcaatcccatggccggtattgcgcggcttgtccggcggcgagcggtgccagcacttccgtttcgaaccgttcacggtccacgttgccgccgggttcggcgaaacgttccggcgtgcgctgttcgggacggaggaagaaatcgtccatgtgcagcacgttgccgccgaaacgcctgttgagcatcgcggcaaacgtggttttgccagacgtgcatggcccgtcgattgcgacgaacacacaatcgcgttcggcaagcaacgtttcgatacgtgcgattgcgatgctggcttccgtaggcttcgcgggtttcgtgaccattgcgttcgccgtcagtcgagtacggtcagacggtacgcgcgcgaaccgatgccaagttcctcggcgtattcgaggatgtgttcgccgtggagcgaggcgatgcgttcggtgacggacgctccgtcgggggcggtgtggatgaggtcgacgcatgcctggtcgagtgccaccgggtcgagcgaggacagcacgccgatgtcatgcatgtccggttccgtcggggaggccaggcagtcgcaatccaccgacaggcggttcatgacgttcagatacatcatcttgccatgcatgtggctgatcacggcctcatcggcttcggccatcgattcgaggaatgcatcctgaggagtttccacccacttgtccttggtgacgccggcggaatggatccagcgtttgccgttcgacgaggctatgccgatggacacgttcttgagcgcgccgccgaagcctcccatcggatggcctttgaaatgcgacagcacgaaaatggaatcgtagtcgtcgatatgcttgccgacgatgtcgtaggcgatgtggcggtgcttggccaccgggatctcgatttcgccgcccatgtccatgatctggattggcgcaagatcggcgtatccgtgctttttgaacgtggcaaggcttttttcgggggtttcacgattgccgtcgtatgcggtagcgcattccacgagcgtgccgccgatctcctgcacgaggtccttgacgagcgaaggattgagattattggatttttccgattcgccggaatggactttgatggccgttttgccttccggcttgcgtccgagtgcatggtaggcggcgacgaggctttccggtgtgatgatcggcgtgaagaacacttccggtgcggactgcgcgtcggtgcggtgttccagtccttccagtcgcgaggcttcgaattgcatcttgaccctccttgattctgcctgtgtttctggcttgcatctccagcgtaccaacttaaacccgacttgaagcaaacagacctcaaacccgttcgagatatgttgcaaaatatggattcccgcgcgtgtctccccatccggccggcttgtccgcatgaaccggaacacttgacgctcgtgattgatttttgcaagaaatggtggactcgcatagccaccaagggaatggcgttcattggcatcgtcacgttggcggcctctctggtggcttcgtggctcaagcagtttccgggattcagcctgttcggcgcgttgatcatcgctctgctcatcggcatggtcgcgcagttcccgatccgcaaatggtattcgagccgttccgccgaacataaggccggtgtgaaggatgcggccgggctcatttcgaacaagctgcttcgcctgggcatcatcctgcttggtttcaagctcaatctgacggtgctgttcacgcagggtatcaagtgtctgccgatcgcggcagtggtggtgacgctcaccatcgtggtgtgctacaacatcgcacgcaagcttggcgtcgatccgcagctcgccattctcgtggcgggcggtaccggcatctgtggcgcggcagccgtcatgggattgtccggctccatcaaggtgccgccggaaaaagaggatgagaaggccaacaatgaggtgatggccgtggccatcatcgccatcatgggcaccatcttcgcattgctggaaatcgcccttgggccgttgacgggcctgagcaagacgcagttgggcatcaccgccggagcgtccctgcacgaaatcgcccatgccgtggccgccggcgacgcgttcggcgcggtggacatcgccaccatcatgaagctttcccgcgtgctgatgctggtgttcgcggccatcatcatcgccgtttggtgggataaaaaccattccgaaatgccggccgacggcaaacgcaaagtgtcgttcccgtggttcatgctcggtttcatcggcgcttccatcatcggcacgttcgtgccgttcatcggtgccatcgcaccgaatctggtcgatttcgcatacatcgtgctcggcatggccatggccgcgcttggcatcaacgtgaatttcagcgccatcgccaagaagggacagaaagcgttcctggcgagcttcctcacgtccgtgctgctcatgtgcttcgcggcgggaatcgcggcgctgttcttctaatcgccttccgttgtgccacgctgtcgttttgcggagggcagttggatttcggacagcagaatcgcaccgaaaatcagcgcgaaaccgcataacgacggcacggtcagcgtttcgccggtgaaaatcacggataccagcatggcgaagatgcattccgtgcttaagatcacggacgcctcggaagtgggcagattctgtatggcgatggtttgaaacacttgggcgatcaccgtggagccgaccaccaggtaggcgatgcacagcacgatgtcccaccgcgcccaagccatggacggtccgccttcggtaagcaccgcgccagcaccgaacagcagggcgcaccacacgaattcggcaagcatcagcgcgatcgcgtcgaaatccttgccgatgaaaccaaccaaaaccagattcaacgcgaagaaaaacgcgccgatgatagtcatggcgtcaccgaagctcatatgcatgagttccgcgccaccgccgccgctcagcgacaccagaccaatgccgaacgcgcagacgaacgcggccaccagatgctgccagctggggcgtttgcgcgtgaacgcccacaccacgaacggcaccatcacgcaataggtgtcggtgaagaagctgttgcgtccgggagacgtggtttcaagtcctttgagctggaagatgaatcccagccagtaagtcaatgcgagtatcagaccgggaacgatatagcggcgcaggcgaatcctgcgaagacgtgggaaaaacacgatggccataagcagtaccgccgaagccatgcggaagaacatcatccactgtgtcggcatgttctcctgcacatgcttgagcatggtgtagccggacccccataccgccgcgttgaccagcatcatcacgcgggcgaccggcttcgatacgctaatgccttccgatgattcctgccccgcgtctgccatccgtccccccttacacgcttccacacatccgacgtcgtattcacgtcatgctttccgaaggaaactttagacgtggctgcggaagcaacacgcgggagcatgctactgcgctttggccgcctggctgttcacccagttgtcagccatgtcaatggcttcgtcaagcgtgaccttggccgcctcgtaatacttggaatccttgatgttgctgctttcgacgagcttctgtccggagtccgcggccttggacagcgcggacagcagtttgcgcccggtcagggtcagggaatcgtccttgctgagtttgtcgaccagtttgtctgcctcgtcgatcgactgttgcagttcctttttggattcatccaacgatttcgtgtcggaggtgccgttcgaagaagtgctgttcgaagaggctccgttcgattgcccggatgggttattggacgattgtccagctgccgcgccatccgaatcggccttcggatcctgcaacgcggtttcggcgtttttctcttggatgcttttcagactggcgttcagggaatcggtggcgctgtccaacgttttggctacgagattgagctgcgtgatggtggcttccgccttgcagccttccgtatcgactgtgttctcggcgctggtggccgcgtccgcgaacgcgtcgatgatgtcgttcacgccgagcgcgcctcgaatcagcttctgcagttcgctgccgttttcggaagtgtcgagcacggctttgcgggccgagctgaattccgcgagcgattgccggcatgtggccaatgcttcctgctgcttgttgcggtaaacgcacacgccggcaccgcatgccacgatgagggccacgaccacggcaaggacgatcggccatgccttgcgggggctggaaggctgttcagtggtctggtactgataatccatacgtgtcaccccttgcgaaccgatagctgtcatcgttcttcgtcttgttaaccttgcctattgtacgggcttgaagatgggaatatcctgaatgggcatcctgcgcacaccaatgacgcaggatcgggctggcatatcgtctctccgcaggcgtgccgcatgtccatcacggccagcagcccccgtttgtccgctcgttcgacagccatgtccacgaaatcgaccggcagatgccgtttgtcggcgatttgccgcaccgtcaatcctgcggcgatgtcgccggcgatgcgtgcgacgatatcgttccggccgtcgccgtatgtatcagccgtacgtggcgtgcgccgccatccgtgcgcggaagcgccggaccgttccataccgctcaccatatcaaccgcaatgtttggaaggcgatgatggcgatgacgtatgccacggccaagctcagcaggacggatcgcgccgcgactttcgtgccaaactgccgtcgcatttcggcgaccgttgcaagacatggcgtgtaggcgagcgtgaacagcaggaaggcgatggccgccgccttgccgtggccgtgcgatgactggtcgaacgaggcgcgcagcttctgtcccagcgttccctccccggcttgttgggaagccgcatcatccggttcgtccgcatggtatgactgcgacatcgaaccgaccacgacctctttggccacgaatcccgtgatcagcgcggccgaggcatgccagtcatcgaaaccggccggcgcgaacacgggagcgaccgcgtcggcgagcacgccatacgcggaatcatgcacgtcgtcgacatgagcgaaaccgcctgcgttggcggttaccggaatgccctgcagcagccacagcgccgtgatcattgaaatgatgatcacgctggctccacggatgaagccccatagacgcagcagcaccgaacgtgccagctgcaacgcgcgcgggcattggtatgcgggaagcgccagcatcaacggttcgggttcgaggccgcggaacatggtgtggcgcagcagcacgccgaccagcaggatgaccatgaccgaagccacgtacatgaggaagaccacgagaccggcgtatttcgggaagaacgcgtgggcgagcaccaaaaacaccgatagtcgcgcggaacatgccgcgaacggcaccagcatgccggtaagcacccgttgccgggaatcggatagggttcgtgtggcggccaaagccggcagattgcagccgaagccgacgatgatcggcaggaacgcgcgaccgtccaatcccaaggcgcgcatggcacggtccatcacgaacgcggcgcgggccatgtagccggaatcctccaagattgacagcagcaggaacatgatgcccatcaccggaatgaacgtcagcacggtgaccacgccgtcaagcagaccgtccaccagcagcgaacgcagccagccgccgctcacggatggtccgaacaggccgagcagcaggtcgagtccatctgcgcaccatccgcggaaggtcacgtcaatccaatcctgcatggggctggcgagcgtggtggtggcctggaacacgacgaacagcaccgcaaggaagacgaggacgccaatcacggggtgcagcagcacgcggtcgatgcggtcggacaaggtgacgtggtcgaccgcatgcatgtcgaggccgcgcaatatgccggcggtccagtcgagtcgtgcgtcggcccgcgattcggcccagacgctcaggccgtcggcggttttcatgtcggcgtcggctgtcgcggttggcagtgcggtcagcccgtgcggaacgggcgttccctcgaaacttgcggcgatcgcgtcggccaaagccttgccgccgtttccggtacgtccgtcaatcgcgacgaccggcatgccgtccagcaaatgggacagtcgttccgcatcgacgccgcagccgttgcggacggcgaggtcgttcatggtgagtgccacgacggtgggcagcccgagctccaccaccatcgacagcaggtacagcgatcgggacagcgcggtggcgtccagcaccacgacggcaaggtcgggaacgggcatgcccgacgcgccggtcaacgcgtcgacggcaacctgctcgtcgggactcatcggagatagcgaataggttccgggagtgtccacaaactgccaattctgcggatttttcgtcgttttcgagcttttgtaccggtattgcccgcaagtgatggacaccgtggtgcctggcgcgttcatcgtacgggtcctcgcgccaagcagcgcgttgaacatggaagatttgccaacgttcggattgcctacaaacacgacgcgttttacattttcgacgtttcccatattgccggagtcgccgcccatgccgtcattcgcgggtctgttgacacgacaaacgcgatgccggcaacagccattctgcgaacggcagcagtcgccgcccctcaggttccgtagattcaacattcgcgcatattcccgttctcttcgcgttacgcaacgtcgtcttgcgcatgttcatcccgcgcgaaccgtacccggacggcacgcgcggtgccgccgtccaccgcgacacgttcgtttccgaatgcgacgacccttccgccgaaagcgctccgctgcatgacccgtaaacccgcgcccggagccaatcctatctcacataggcggaaccggtgccggtcatccaggtcgatgccgtccacgacaacgcgcatggcgcgcggacagtcgcgcagcgtcatgatggcgccgcgctcccccgcccgacgccgcaccgtgtcatcgaagcggcgagcatgcgtattatccatgttttcacacatagcaggaaacgaagcaaagcacaagagtgtttttcacggaactgaaccgcaccccaattgttggacgtcggtaagtgggatgcagtctgagaccgcgatctggcacgcatcatccagactttggtcgacgatcccattgagcaacgcattcgcgaacggctcgtccaagagcaggacggcgaggccgttgccgacaatgccccggtcaatacaggctgtggcaacgctgccgacaatgccactgccgaaaaacgcaagcccagtgccgccacattggcggcaataacagtaccggcacaagcggcaccgacgcggttgccgacaatccgctggagctggtggaatccggttggtctgtaagccaacaggggtacgttagctacgcattcgccctgcgcaacaccagcacaaccctgcaggtacagtatccagaagtcgccatcaccggcgaaccaaagacggctccatcgtgttctcgcagacgcaaacgctgaatatggcgttcccgaatcagactatatataacgccgggcaagcgggtcaaggtaccgcaccggccaccgtggacttcgttgcgctcagtccgaatgagtacaacgtcacggaagcacaaggcactgccactttccccatcagcggaatctccaaagtgcgcaacaacgacggcggcacgaccttcaatggcgaagtccgcgccgtgaccgatggtttcaagccttcagatggacagcagatcaaggtttccctagtgttgcgggataagcaaggtaccatcatctatggagaaatggcatttgtggattggccggacaatggccaatccatgcctttctcgatactggtgtacgatttgccggactacacgtcctacgagtcgtacgcacaaatttggtagttcggcttaatcgccatcaggccgcgttacgcgccgcatcgacactagtgttgcgccgtgcctggccgaatacacggccagccatcttctcatcggtctcggtctggatgatggtgcgcatcgggcccatgcagatggccgaagccaaaccgttcaccacatcaatcagcaaatacgccagcagcttgtggaccacgccaagaccaacgacggagacgcccaccagagtgatgccgaaggcgaccacgcgcatgttgttgcggacgatgatgacgccgaatcaccgatcatcctttgggaacaacgcgtcgaaggcatgttccatcacggacttacggcggatcacaccgacgagtctgccatcaccatccaccaccggcagtttcttgaactgcttcttggcgaggattcgggccacctctccaacatgctggtcgggcgtggcggcaacgaccttacgcgtggcgatgtccatcaccttcttgccggagagcgcctgcaccttggaggccacggtttcgtcgtcgaacaccaccatcgtcgaaccagtgccggtggaaaccgtacgggattcataggtggcaatcgatttcatgacatcgccgtcgctgacgaagccgacgagcctgccatcgccgttcaccacgggaaggctggaaacgttgaggcggatgaactcgcgcaccacatgcgtgatgtcatcgctgtccaggcagctgtagggatgatcgtccatgatcccactgatggactgttcctgggtctgcttgaacagggaggaggcaggggccacgtatgcgccggcgtagtgatgctcggcgggctggccttcagtggtttcggccgcgacttcggcggaggcttgcgcctcgtaggccttggcgttgcgtgcggccttctccttggcacggctggtgacggtgaagatgcagatgatcagggcgaccagcgagatggcggcgcacagcaggtaggagaacgcgatgccgctggccgtggcggacttcacaccctgggacatgtgcgaggcggtcacggatgtttctgcggtaaccagaagcgaggtcgcaatggctgccgcgatctggcggccggtgttggcgatggcgttgccatgggcgatcatgtcgttcggcaaagcgttgacgccccaagtgttgatcggcatgttggcgatagcctgaccggatgcctgcaatgcgcagaacacggcgacaaacagcactgatgtcctggtgttgatggtgccgagaagaccaagagagatggtcatgagcgcaaggccgccgatgcccacgccgcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatacgaatgcgacgaaggccacaagaccaacgacgattgaggtaatgacgaccggactggcccatcccatcgtggaagcggacgagaagccatagagcaggccaccgaacgcgatggtcgaaaggatcacggacaggacgttgagctttgggttcttcaactcgccgacgttcttgagcatcatcgtgcctccgacaaggatgaccagtgccacaactgcgatgccaatgaacatcgggcgccatccgaaaccgtcaatcaccagaccaccgacaaccgggccgatagccgggccggcggccatgacgataccggccatgcccatggcggtgccgcgcttatccggcggatagacgagcatcggcactacggcgaccaatggcaacagcacgccggagccggcggattgcagtatgcgtccgacgagcaacagcacgaaattcggcgcgacggcacacagcagtgtgccgaccatgaaagtggcaagggctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcccacgacgatgaatcgggcgtgcgaatcaataggctttacggaactggcggcggacccgaattccgcggttttctgtgaggtcacagcatttccttctgttggtaacggcatgtgtgggcgatccggccccatacttgtgtcaagacgcggggacaccgatgagtccggggtaaaggaaaagccgccatccgttccgcattcatatacggcaaacgattcgcggctttgcgtaagttgatggctatggtgagcgattcatgcgacgtcgaccgcggatgggccatcggtacatcccggcataaggcgtgtccccgctacaccagcatcgagaatagggccatttgtggattggcaaacagaacattgccgacgaacgacccacggcaggtgcgtgcgatgaacatcgcgtagcgatacaggttcatggcatctccttgatgggtcttcgtacggcagacatcgagaagcctatcatcattcagatcgacggtgaaacccacgcatgcccgacaatacacaaaatctttacaaaaggattgggcttacgcatacgctccgcatgaataacggtccgggtatgaatcaggggcgagctaagggttgcgtctcgtgtttccgtcatgatttctggcaaaatagtgaagctgaacatgcgcggaatcgaccggaatcggaaagggactaatcatgcgagttctcggcaatatcctgtggatcattcttggtggattggccatcgcaatcggatgggcattggtgggactgattctgtgcatctccatcatcggcatcccgttcggcattcaagcgttcaagatggcgggactcaccctgacgccgtttggcaaaaccgtgcaatacggcggcggagtcggctctgccttggccaacatcctgtgggtggtgatggtcggctggtggatggcactcggctatctgggtgcaggcgtgctcaactgcatcaccatcatcggcattccgttcggcatccagtcgttcaaaatggccaagcttgcgctctggccgttcggcgcacagatctacagtttgtgaattactcgaaatcacatacctacaaaaccaaagattgttgctgtaccaacgtctagtcgttggtacagcaattacggcaacatctccccttacaggaagaagtcgtcaatctctgcttcattgtgcaatatctcggtttcagagacaccaatgaatcttgccaaatcaacagatgcggcgaaacgtagctgtatatttaaatcaagattgaatgcataagtctgcagctcccctagtttccggtatttatcgagaagagtttccaatatttgcgcgtattgcacgtcgagattcgcgacgaacaagtccgctttgcgctgatattcagcgatgattgcccgctctcttgcactcaatatgttcttgccaagaccaagcacattcgaagcgacaattgacccgataagcgcgcccacaacgggaacaggaataagcgtctgaccaatcgccgctcctaccgccgcgccggtagcatcaagggcattgatagttaccaagctcaagaaaccgtcatcatcaatctctccggaacggaatttcatgacagcatctatgagtccaaaagttccggacgctatcgcccctgcgctcggagccgaaagatgacagacattggtcaatccataaattgcatagcccgaaaacccgcctttgaaggcaccctctgctgtcttgacgcctccttccttccaatcctcagcggtaaactgccatatttccttgccttcttcgtgcttttgatacacgaaaatgccgaagttcaatccaccttggatagcagcacccaccccggcagctttgttagcctcgcctagattcggctgagctttgtgatatgcagcagccttatccgtattggccttattggagatttcgctcttttgctcggatgtctgccgtttaatattgtcggtttcttcagtaaaagtccggtcaatcgcttctctttggacctgatcatatttcaataccgatgattgcatccatttgtcccaggacagtccccggatgttactttcctcttcgataatctgcttaattttctgcacttggttactggttagcggttgtccgttgagaaagacttctttatcgccatgcatgaccgcacgaaaaacgtccatgtggtcctttgaaaacatcatatccatagaacggtattccgcagatgtcttcagctcgttcattaggttcgcatagaactttacctgcactggcttgccgttaatcaacaaatcagcaggaccattattattaagcgtaattgttgatttttccaacccttcaaatgctcgtctggcgttagcgattcccgtctgcgcgaattcagcgataaatccatgcataccattttcaccaccacgcccactgttgacaatgttcatgacattttgattcgctaaatcaaggttccttagcgcattagcttgtcgctcggcgagatctttcagctgacctgtttcattattaagaatctgtctcaatgtgtccatcagagtagacacacgtagctgattcaaataatcaatatacgcggcaatgccctgagcaacattgttatcgatggcgtgcttgtcagcagtattcttgtcagtcatcgagttccagttccttgttaatcatttgcgctaaggtgagcgtcatattgaccagtaatcccgcctgcattttctcttcgtgggagaactggctgtaatcggcgcctgtcaccgcagcattcgcacgctgtacaccatctatctgagtttgcgttgcctcagtcaatgccgcgacttcggcattcttcacattgaatttgcgaattaatacttccacattctggcgctcaagcaaaagcttgtcagcagtttctttgtttttatgattcgcataaataccagaaccaattgccgcagcgcccgccacgccagcgatggtccatccaaccggaccagccaagcccaggaacgcggttccggctgacatgccaccgccacctgcagccaatgcaccgccaccaagccaagccagagcagcactatttgctgcagctccggataatgcagaaatggcagtaccggtcgaagctacaccgaaggtggtggccacacccattgcagccgtaggtcccatggttgctactgcgattcccaaagcactgagggtggctcctgctccagaccctccttcagctgcttttgcttgcttttctgcctccttaatctcatcctctttattctcgaacgtcgttacttcggtattgatcttatgcagttcaacggcaaattcttttggcgtattagccaattgattgatatgttgttcaacatacttgacatgcacaatagcgatttttctcaagtcatacagcacttgcgtacttttagctaaatcatccgctacgttttcatagcgttctacggcattgttgtaatcctcaacagccttagctcttagtttggaattaaacaaatcgaccttatcggcactatccttgacgtttttagcgattgagacggtaccctttgccatgctgtcagccgctttgcttacttcgccacttgcgacggccgcagactgtgccacgctccctgcaacagctgccgtcattttgcccgcatcgccggcaagcttacccgcatcgttggcgatcttacctgcccctttggcaacatctttcgtgatttttcccgctgtgtcaccgatatttccggctattttaccggcttgtttggtgaaatcattaagacctttgcccaaattatcgaacatgttgcccatggttgttgctccccttttcacgcacctgccatgatgtccgtcatcgacggcaagtgcttcgttgcacttataggccaagtgtactcataattacgtagctgcggtacatgaccatacatgcacactgcgtagtttgacggattcgcgaagaagcccccatgaatgaccaaaacgtaacttgcttacacacaccgtgatttgacggatttggacgtaagaccttatggtgtgcacaccatgattcaacgtatcgcattcagcagcaacggcgtgaacgaacacgccaagcgccagcagacgaacctgccggcgatgctcgaatgcgccttcaaacagggtttgcgtactgctcagttccaaccaataaccggaaacaagcgcagcctgctcgctgccatacaaatctgatcagtacacctctcattggcgcatagctgaatcattgccggtgatatcgagccggctcgttcgcaccatgcctcataaacgcacctgtacgagcatgtgttcttggcatcgccgcaactcaatgcaccgcagcaaaacccattgcataccatcacatattcagaaagaacaacagatcatgaagtatttcactactgacacgcatttcgggcatccgctggtcagcgtgctgcgcggattcaccacgttcgaccctgggcacacacagtatgacgctctcctctcctcgcagggacgcaaggccgccgaggattgggtgaagggcgtggtgcttgacgattcccggctcaatttccgcaaggccgcagacaccgatgcgcacgatgaagcaatcgtggccaatatcaatcggattgtcggcgaggacgacgagctgtggattttgggcgatatcggataccgaacatcggtccggcatctgaagagctgcctgcgtcagctgcgctgcaggcatctgcacgcggttatcggcaatcacgatgactggtggctggacgatgcacccgcgcgagatctgttcgaatcgattgagccgaacagcacggcggagctgaccggtctcggaattggccgcccgcaggcgacggagaccgtcaatctatcgcatttcccctaccgtgaggatcttgcctatggctggccggatgatgccgtacgtttccgcgatcaggcattgccgttcgacggacatcgtctgctgtatggtcacacgcaccagctgtctccggagggcgcacgccacgaagccctcaacgttggactggacgcatggaatctgcaaccggtaagcgaaacacagattgccgactggttccatgcacacgcgaccgattcaacgcacgtatcaccgctggatatgcccgactcccccgagccggcgcccattgactccgccgcacagcaggaaccaggcggctcggtttcggcagccgaatcataatacaagcaatattggggcgagcagaaccttatgccatcgctggcacctgtctcgccccacagcacaacgaaaggagcttggctatggcaaagctcattattctgcgaggactgcccgcttcgggcaagtccacgtgggcacgctcatggtgtgaggaccccgccaacacgtggccgcattgcgtgatttctctcgatgacattcggctcatgatcgccggctcggcacaggtccgaaaccgactgcaatccgagcacggcaagcgattcaatgacatggtggttgccatgggacggcacatgattgccgacgcattggatgcggggtgggatgtggtggcggatgcgcaacacgctaatccccggtatgcagccgaactggcgctactcgctcaacgtcatggcgcactgtgggaaacgagggattttgacgttcctctagacgaattgttgcgtcgcaatgcggcgcgtgataccgctgaccgtgttccggaagattacattcgttcgtcctggaagcattttcacaccgcgatgttccgcccgttggaaccgggcgatccgaatggaaacctgttggagcgtatgcgcgcggacccttacgttcgggttattccggtgcgcggcgaaacagacgtgtatgcgtgcaatttcactgcagaggcatttcgtgaacatcggtggacggatcgcaccatcaatgcgcgagggctttttgtcggcggcaacggtcaggtggtgcaacgcgggttcgagaagttctttgctgtggacgagacggaggagacatcgttcgcccaagtcgtcaatcacgctcaagaacatccagagtcgttgcccgtgcgcgttgagcgcaaggagaacggatttctcgggctcgtgggcgcggcgggaactcctggattgttccgcttctggtcgaagtcggggcaaacggattattccgcgcttatcgagcgcctgtttccttcagattcagcggtacgtgccgaattgtggcgtatgttgcatgagtggaatgtcacggcggcgtttgaagtcatcgatcgcgagtccgaccggcacatcgttggatacgaatcatccgggctgcgcttgctgcatctgattcgtaatgccgaatcgttctccatcgatgccgctcacgaggaaacgttcactcttgccggcggcttcgtgcggccggaaacggtggcgatccgccattcgccggaagaagtcgcccaggcaatcggcgaagccaaggcaagcccgcgtgaaggcgtggtgctatattttgccgacggttggatggtgaaggtgaagtcagaccggtacaagttggtcaaggcgatgcgccctcttatgcaacgcgtgctgctgcgtggtcgttccttcaacaagtccggcgacattgccgatttggctcgccgtatcatcgattacgcacacgaacaccacatcgacctggcctacgagcggcaggcattcggcgagcgcgatatcgatatgaccaaggtcaacgacatcgtggaccacgtgcggtaactgctgagttctagcgcaatatcttctgaccaacgtatgtatcacgaaagcatgtgtcgtgaaagcatgtattgcgctagaaccaaatcattctcgttgaggccggataatgaatctctatgctttgaacatgacgcaccatatgccggcatttccttgcgcgaacaactgttcattacgaacattgtactgatgccgttacagaacagaagagggtgctgtcctactttgctgacgacgttgcattgaagctcgactcatgccatgtgttctacactccgaacgtggggatccgaggcgtatccagctacgagcacagcttcgatttcctgttccagcgtagcgccaaccatccgacccggttctgccaggcaccgaaccgattcgacaaggacgccgtgaaagacatcatgttcggttgggatgacacgaagaaggatcccaagcgcagggattcccggctgatagtcatcggcgacgaccggcagacgccgttgcagcgcggcgcgctcaccgcgttccgcaactacggtgtgaccgttatcccctactccaaattggaagagcgggctcccgtggaactcgccgcgtagcttccgagccatataaggactcatcccgacgactcaccgcgagcaccgggatgagtccttggttcttgtgtttcgctatatgatcttgtgtttcgctatatgattgagtcatgtcggacgacaatgtccggcacgaagagagacccatcatgaaaaaggcaatcgcactgcttgttgcggcgatgttgcttaccggcctgtccgcttgcgggggaagcactacggccgatgcgccggccaaatccgatggcacgtcaaagaccgagaccaataaggaagaacccaaaccccagccggccgatctgaccggcacatggaagcagaccaattccaacgacccgagctcatacatggaagctaccatcagcggcgacaccatcgaggtcaactggatcggcaccgacaccaagagcctctactggaagggcacctatcaggcaccggccgcagccggcgattggaaatggaccagccagggcgacaccgagaccatggccagcgcgctcctcgcctcgcaggatgccaccaaggacttcacctacagtgaggcggacggcgtgagctgggagaccaccgcgctcggtaccaccatcaccgtcaagacggtcaagcaataaatcccgtgtcgggcggatcaagccctaaacacgaaaccgccccggtcactctgcgagcgccggggcgattctgttcctggataagggttatttgattccgttggccttcatgtaggctttcatggtttcgtagcattgtgcggtttggagtgcgtcgtctgccgcgcgatggctttccgtttgtgcgatgccgaatcggcggatgatgtcgacaaggcggtgtttcggctcttctgggtagagggcgcggtccagtggcagggtgtcgatggttttgttgccgatgtgtctcatgccgagtctggtggtgttggcgaggaggaaggcggcgtcgaattcgttgatgttgtggccgatgagggtgtcgttccctatgaatctgatgaagtccgggagcacttggtctacggtcggctggttgcgcagatcggcgtcggtgagtccattgagacgtgtgatctcctcgggcagcggacgttgtgggttgatgagctggctgtaccgtttgaccggtcggccgttcctgacgcggatggccccgatctccacgatcctgtcatcgcttggcgagaacccggtggtctccaagtctatggaggtgtagttgtccaccatgaggtctttggccttgactggcttggacttcatcttcgtgacgctcttcggcttcttcttgaatcgcgcctccgggtcgactttccttgccgccatggcgaatccgacggcgagcgccacgagggcgatgatggtgacgatggtgagaggcagaccgctgtcgcggttgtcgtcgaatggtgcgtagatggcgcttgcggcgaacagcgccgcgaggatccagtagagtgtgcgcttcctcatgattgttcttcttccgcttcattggccgcgagtcgtcgtgcccgttgttcgaggttgtcgatttcggtttgcatgtccgttattttccgtttgcgtcggtcgatgcgttccctgattttttcgaccgagacctgtttcctgctgccgtaggggtctttggcgtcgagttcgtcggctttgatgcgggctttcttgatgtagcttctggatagcgtctcgattgcggagagggtggagtcgatcagaatgttccttggctcgcgggctccgccggcgacgccgaagtatagggcgcgacgctggttcatccggtcgaggaacgactggacttcatggcatgagtgaatcagtgcgcgtgggctgtccacgaattccagatggcagagcagcacgcaggcgtagttgtgggcgacgagccggtcaagtgactgttggaatgagcgcgttttcgagccggtctttcttggcttgtcgcataggcgcatggcggccttggtgatttcgatatcggaacggccggtatctttcttgtgcggtgatgggcggctcatgccggtgagcaggcagttgccgtgcgatacggcgtttcgcatctttctgacgatgaacaggagatgctgatatgggtggttctcgttgtgacggtatcgccagtaggtgttgaacagagtcagttggtcgttgaatcccaagagttcccagaggttccatagggcaaaatcgccttgcaggccggttttcatgtcgtcggtgtagggattgtcgtgcatggtgggcaggttgccgctgaagcaccttctgacgcagatgtcggcgatatccgggttctgatccttcatgatgagctggttaaacctgaccttgatggaatgctcaatgctggagcacattgaccataccagtcgactgagtgcgaaatccaccagcgagagttcgaccagatgaccgaaatcaaggttgtcgtaaacgtatcctccggattcgtcgatggttttccggtagttgttctcgtaggatttgatcttgaagaagtacgagttgttcgagaggaaccttcgggctttctcttcgtccatcaggtcgaaggtgacgccatgcgagacgagggtgtttatctgctcatccagcgtcgctcgttgcttcatcttcacctctcagaataaaaaaacggcggccgatgaattcgaccgccgttccgagacgcctcggcgaaccaaggcttctctacgttgtatgccatacaatagccgcaatctccggacttttcaatgataatcagccgtgcgcccaagtctttccgttggttctacggcgtgtcgctggcatgcggcgcgatgtgcctcatcctcgccatcggcggacggaccatcgccgccggggtcttcggagccgccgccggggtcttcggctacctcgcgggaggagaacgatgaccgaacgtttcctgagcctcaaggaggtcggcgagcgcctcggcgtgaagaatccagccgcgaagggctacaacctgccggagccggatgcgctgatcggcgcgacgcgcggctggctgccggagaccatcgaccggtggaacgcggcgcgtcccggccgcggggtcggtggcggcagaccgcgcaaacatcccgaggagtaagcgaaagcccccggtcgctcgtctgcgagcgccggggcgattctgttggctgggtggaggttatctgatgccgttggcttcgtgccgttggaaggctttttgcatgtctttgtcagtaaagggttcgccgattgtcatggatgccttttgcatgaatagcgtgtatttcatccagtggatgcttctgcccagctttgcgatcatcatgacaagtgcatatatggagatggctgtggatagtcccgggcgcgacggccagaggcagagggatgccagcgggagcaccgccgtgatggctgtccatgcgatgatgctgacccagtttctggatagttcgtcgtgatatcggtcacgcgcgatttgcatgtagcgtgattccgattggtaggacatggaacagatgaatgtcactgccgccatgacgagaccagagagggtggatagcgccacgaagaggttctgcgagacgttgtcgtccggtaccggtctcccggagattgcccagatgatgattgggatggcgggggcgagcatgtcgacgctcggatgtgcggctaatgcgtcgccgagcgtcgattttctgctcatgtcatgctcctcgcgatatttcgtataggtaagtttgcttttcggtgcagacttttacgaggtggtctatgaggttggtgaattgtcttggctcgttttcgccgatgatgatgtcctcctgttccacgacgggatgactgacgaggttgagttcgaggagtttgcctgcgaggtcggtgccgctgacctgcatttgcttgttctgttttacggcgaatgcgaccaggtcgctcaccgtgcctttgagtttgcgtcccgcactggggaagaagccgtctttcggtatggagactttgatttccacgtcgaggtcggttccgatcgcatcggccatttcgcgatagaattcgcctgtcttgccgccctcctgcgccgtcgagtccaggtatcgtcttgttgtgaatccggcggtgaatgacgacagttctttgagctccctttcgaaacgttcgatgctgtccaccgttaccacgggctgtacgtcccattcgaattcccctccgggagaccaataatggtcaagcgcttttttcagcggttcggagcttttgccggcggagccgctgattcttccgatgagcgcgtattcgggaaagaacgcgaatgccgacgatttggacagatcgcccctttcccccgccaggtaattatccatgtaatccgttacacgttcgttctcgcggtcgatgtattgcatgaaggttgggtcgaattgttcggatacgctgagaatgggatattctttccccaggatggcgtcatatctgatgccatcaatggctttctcctgccatttcatggaatccagatcggcgagtcggctttcccagtccacatcctccacaggcctgtatgatacggcctcgcgggatcttaagcggagccagtagaaagcgactgtgcgctgtatcgttttgggcatcatgcctcccaacctcgttgttctctcggccgtctctttgcggctctatggagattctacaggcggatccgtggttccgtgtttttctctatctcaaacttgacgttatgcgcattatacgtataatagagggtatgaggttcaaggagatcgagaagcgcctgctggccgacggctgggtgctcaagtcgcagcgcggtagccaccgccaatacgtgcatcccgtgaagcctggcaaggtcacgctgccgaaccatacgggcgatctggacccacgaaccgtgaagagcatatggaaacaggccggaatcaacgaacggaggacgaaatgaagctggtctacccgatcatcctctacccgatggaggagcatgagggcggctacaccgtcgaggtgcccgacctgcccggctgcgtcaccgaggggcatgatctcgccgacgcgctggatatggcgcgtgacgcggcgagtggctggatcctcgacgagatggaggacgggcgcgccgtgccgcatgccagcaacatcaccgacgtgaagcccgacgaaccggacggcatcgtcagcctcatctcgctggatatggacgcctatgccgagaagtacggcagcaaggcggtgcgcaagaacgtgaccatccccgcatggctcgacacattcggcgagcgcaacaacatcaactattcgcaggtgctgcgcgaagggctcgaaagccgctaccgcgccctgcaggatgcctgactgccatacgccgaaagccccggcgctcacacttgcgagcgccggggctttcgtttgttcgccttatgcggtctcctcgatgatttcggcttcgatgatgtcggtgtcgtcgtggaggtcggggatggcctggtcgagcagggcggcgagtgatgccgtgtccctgtgggtgtagtggttggtcatcgtgatgctggtgtggcccatgatggcggtgcgtgcgtcgtcgggcatgttggcgcgggctgtcatgctggcggtccagtggcgtgcgctgtggatggtgaccggcgggaggctggcggctttcaaggccttgttccagttgtagcgttcggtgctgctgcgcacggggttgcctcgtgagttggtgaatatgaggtcgcgtgggcctatgccgagtcgtttgatgcgcgcccacaatcgctgccacaggctcgtggatatgggtacgaaccggtgggcggcgtgggttttgggtgtggtgagccacaggatgccgtacaggtgctcggctttgagccaggcgggtatcacggcgtcctccggtttgccgtattgctggatctgctgctgcacgttgatgccgggcacgccgtcgcgttgctccagctcgtagggcatgagcgcgtatcgttcgccttccctcatgccggcggcgaacgcgagttcgaacagcagcatccaggattcgtccacgtccacggtcagggccgggccgcggcgtttcgcgccgcggttgggcacggcctcgatcaactgtttcggctggtcgggtgagaggatcctggtctcggtgggctccacccttggcggcttgaccctgcggcatggatccacggggatgagctcctcgagctccgcctggtcaagcatcatcttcaggctcacgaagtggtccttgagcgtggagggagcgagccgcttggagagcacgcgcatgcacttgcggatatggtcaggtgtcaggtccgtgaggcggatacagccgatgacctccatgcacgcgtggattctgccggcgcgtgtgcggtatgtggtgggtttgacgttgagccggtattcctccagccagcgctccgcgtagtccttcaggtacgggctcttggctccgggcaacaggccggtgcgctccatctcggcgaccttcgcgccgaaccgttcgcgggcatcggccttggtgcggccgctcgccgctatgaaccgtcgtttgccggtggcgggatcccggccgatttcgcggcggaactcccatcgtccatccgcgcggtggatgatgccgcccgcgcccttcgtgcgccgcgaacgtccgcccgtcttccgtgtggtcttcgccgtcatggtgttctccttgtgtccgagagcactcaatgagcgtccacgcacatggcgagaaccgttacggcgagcgcactccggggttttccggaattacactctatttacactctatcgccgcgtaaaacggcggaatacgtgcgtaaaacggcggttttccgcgaatcgaaaaacggcgcgattccaacgttccgacaccccggaacccttggaatcacgccgttttctagggtctgaagaccctacttggaaacgttgaacttgaattcgacgatgtcgccgtcctgcatgacgtagtcgcggccttcctgacggagcttgccttcctccttgatcttcgtcatggagccttcggcggcaacgaaatcgtcataggagacgatatcggccttgatgaagcccttttcgaagtcggtgtggatcacgccggcggcctgcggggcggtgtagcccttgtggatctgccatgcgcgcacttccttctcgcctgcggtgaggaaggtggacagaccgagcgtgtcgtagccgacgcgtgccagctggtcgaggccggattcctcaaggccggcgtcggcgagcatttcgcgcgcgtcgtcctcgtcgagttcggtcaggtcggcttcgaattgcgcgttgaggaagatggccggagccggagccacggaggcggcgagcttggtcttgagatcctggttctgcagttcggaatcgtccacgttgaacacgtagatgaacggcttggcgctcatcaggtgcaggtcgtagacggagtccttgtcgaagcggccttcgcgggcggccttgtcgatggtctcaccggcttcgaggatctccttggcctgcttgacggcgtccatgtaggccggctcgatcttcttgccgcgcagatccttctccagcttcggcagcgcgttctcgatggtctgcaggtcggcgaggatgagctcggtgttgatggtgtcgatgtcgtcggccggatcgaccttgccgttgacgtggacgatgtcgtcgtcttcgaaggcgcgtacgacctcgcagatcgcgtcggcctcgcggatgttggcgaggaacttgttgcccaggccttcgccttcggaggcgcccttgacgatgcctgcgatgtcgacgaaggtgacggttgccggcacgatcttctcggtgtgcacgagcttggcgagcaccggcagacggttgtccggcagcggcacgatgccggtgttcggctcgatggtggcgaacggatagttttccgccagcacgttgttacgggtcaatgcgttgaacatggtggacttgccgacgttcggcagtccgacgattccgatagtaagagacatggttccttagtttagtattaggcttcgatggcgtcgaccgctttgatcacggcaccacggaacgcgctttcctccaacgatgcgacacccttgatggtggtgcctcctggagagcagacggcgtccttcatggcacccggatgggtttcgttggccaggtacagtgcgccgacgccttccaccatctttgcggccagacggtaggcggtggcgcgttgcagaccgtatttcacgcccgcgtcgccgagcgcctcgatgtacatgtcggtgaatgcgggcgcgcagccggcgatgcacatgccgatgcccatatgcgcggagtcgacgcgttcgatgaggctgatcgatgagaacagcttttcgaacgtctcgttttgcgcgtcggtcagcgtgttgtcggtttccgtgacgagcacgcctttgccgacggccatcggcgtgttcggaatggtgcactggatgtgcatcgcgccgaaatcggcgccgaacagttcacggtatctggcgagatcccagcctgccgcaatggatacgacgaatgtgctttcgttagcgagcgcgccggcgattggtttgatgacgctttcaatctggtacggtttgatggcgatgatgacaacgtcggccgcgtctgcgacttcggcagcggtgcgcagcggtgtggcaccaaccttcgccgtggttttctccagtttgtcgtaatgcgcggcgcacgccacgatgtcagtaccgtcgattgcacctgccgcgacaagtccttcggcaatggcctgtgccatgttgccgtatccgatgaatccgatggttgggttggacatggtttctccttgttgttcccggttcctatttgatatcgatatatggatggattgtctgcgtcagaacagttcttccagatctcccctgttcagtgcttcgttgaacaggcgtttgaagaccacggaaccatgcacgccgtcatgctcgaattcgttggtggtccaataatgtgaacgaccgacgcgggacagcgtgtcgagctgcaatccagaatctacgtacatgtcgtcgaaatagacggcagcctgcagcggaacctcattgcgcgccaactggtcggcatcgtagatcgtgccgaaatgcgtgtcttccataagcacgtccatggccggtttgaacggacgcaacgcacgttcctgctcgaacatccacgggaacatggcctcgccggtgaaattaagcggacggatgtcacccgcgaattccggatgctcgccgcgcacgcgctgggcggcccagcaaatcggcgtttccagctcgccgttggcgtagatgaactcctgcaacggccagtacagcgggcgagacgaggtcgcatccatcacggaagacaggaattcgtcagacagttccgccgaggtcgaggccgaaccgtcgccgtcgaggaatgcctggtcaagaatccaatgcacgcgttcgaaacttggcttcatgccgaaatcggatcccaagcattggaagcgttccaccgtgagcggatcgccgttcggcaatgcgaccttgcgcgactgcagaatgtcggcgacggccgcggcacgttcgacatcgatcgggtaacgctcgtagaactgcttcgtctttgccgccatgcgcgggaacgtatgacggtacacgtcggtcgcatcggcgggaacatgaggaatgccgcccgtggtgaaactggcgataaccccttgcgggaacagcgaaagatatgtcagcgtcaggaatccgccatagctttgaccaagcgtggcccaacgtgcgcccccgaattcggtacgacgcagatgctcgaaatcacgaacgatcgaatcggcgaggaagcgcttcaaaaacgcggcaccggccttgccgccgccatccataccctcaatcacatgcgtatcgacacgagacgaacgcccagtaccacgttgatccggcaacaccacacggaaatgcttgatggcctcctcaatccaaccatcggaacttggaccgagcggacgggggccggaaccaccgggaccaccctgcaggaacacgagcagcggaagatcatcatgcacatgttcgggagcggtgaccacacggtagaacaggctgattgattcgccatcgaacccatgaccgggctcgtggcccgtccaatccaacggcaccttgatggaacgatcctcaatatgcaatccgggcacgtagtattcgctcagcaacgtcatgcattcaccttccctttggcgtcatcggcatgttcaatgcgggtagtgacttcttgatggcttccatcccacccacatgcggagacaaccttacctcacaaaagcggctttatcctgccgctatttcattcccgcgcatgatggcgtcacagcatatctggcgctagggtggaacgtatgtcgaatctcaagcagcgtctcttgtcgtggatgcatggtcatgtcttcgcaggcgatctcatcatcacgcttgtcataggtgttctgctgttcggcgtgaccggcggcatcacctataatccgggattgctgtttgaccttaagccttccacgcagatggcatgggaagcggcaatgcttatcccgctgctgatccgtcgatggcggccgcagaccggagcgttgctctgcgtggcattgaccttggcgcatctcatattcggcccttgcctgttgggcgccgatattctggcattgttcatgctgtattcggtgatcgtctacggcaatcccaaaaacacgaaagccttcattattctggcgttgtccatcggtcttctggcttcggcgctggcggcatggaccatgtccaatggaccgctgctcaccggaggcaaagtgcatacatggagcagctggaatggctcaaatccgaatggcgttatggccacggaagacactctcggttccatctacacaggaacatccatgtcggaagtcgccgacatgatggcgcaatccatgctggtgctgacgccgattttcgaagtatgcattatttccaccgtcattgtagcgttctggcagcgcgcccgtctggcaaccgttcgcatgatgcgggaacgcaatgaggcaatcgccgcgcgagaccaggatgaacgcgatatcgccgcgttggcggaacgcgcacgcatcgcacgtgacatgcacgatgtggtggcgcacaccctgtcaatcatcatcgtgcagtctgacggcggtcgctatgcaggcacgcatgatcccgcggttgccagaaacaccatggagacgattcgacacgaatcggaacgcgcactgcatgacatgcaacgtcttctgggagtattcgggggttcaccgcacgccgattataacgatatcggcaatcttgtggaacaagcgcaaaacgtctcccccgacattcgaatccgacggaatatcaccggcaccgccagcccagaacaactcagcgaacaagcctcgatagcttcctaccatgtagtgcaggaggcgctgacgaatatccgcaagtatgcggggccgcacgtcgatgcgcatattaaagagtcatggaacaacggtttgctcactttgaccatcaccgacaatggtcgtggcgcggcggccaatatcgacgggcatgcgccaggttacggcctgctgggcatgaaggaacgcatcgaatcggccggaggctcgttgcaggctggccctcaactcggcggatgcttcgaagtcatggccaccctgccttacggcggtaaagaacaggtgacagacgaaaccggcgaacagtatgcctcggaacagtccgaatcgtgcaacacaactgccatatccagcaaagcgagattatccgacgaagcaatcgcgtctcacacagccgttaacatatcggcgcgaatcccagatcaaccatcggagcggacgcaggaaaccaaccaaccgaccggtcgcgatcatcgttcgaatgccctgcaacatttgcgcatcaccgcacccaatctgcatgatttgctcaaatcgttgaaactgaaatccgtagaatttgcaaatacatccaattcgcgagggccgaattgggtggaacgtgtttccgcatggacgcagcaccattatgtgctcatggattccgttggtgccgtggtattggtcatgctgctgaatcgcatgtcgattacgttcctttttgatagttcacctcttgcgcagctctctcatgcgatcgctacctgctgcatattggcgctgtcccttcgacgcaggttccccgagacttgcgcgcttattgtgttcgtattgtcagttgtgcaattgttgtttttgggatcgattgaggttggacatatcgtagcgtcgctgtgtgctctgtattcagccgtattgtatggacgcgaacacgcatggcgttggaccggtcctgccgctgtcacctgttcggtgctgatgggcttgaaaatcgcggccgatcaacacggatacattaccttgttcggcgccatcaccgcttccgtgggcttgacaaaaccggtttcagccgcgtcaagcagtactgcggcgttttttaccggcgttatgtatacggttgcggtgttgatactgtgcgccgtcattatggcatgggcgcgttggactcgctccagtgattcaaacgcactggtgttgcaggcgcgagaggaagcgctggtggccgagcaggagaagcagcgtattctcgcggcgaatatggaacgcgaccgtatcagtgccagcattcaggctgaagtcaccgccacgctgaacagcgtgattagtcaagccgtcgatggtatccgcatgttggacgctgccgaagcacaaggcaaagagcctactgccgacgagatttccgcagcgttcaaagccatcggagaacaggggcgcgccgcgcttaagcgtatgcgcgaactgctcggagtgcttcgtgagactggtttcagcgatgacgctcatgccggtagcgcgagcgaactgcagttgaggcccgcagcaccgctggaggagcagctgcagcgcgcgtctcgatagccggttcaagtttttcagggagatttaaggggttgtttcgcgctgtgagcggaacgatgccgataaggtggagagtatgagtgaagaacagaagattcgtgtggtcatcgccgatgatcaggaattggtacgtgccggtttcgcgatggtgatcggctcgcaaccggatatggcggttgtcggccaggcgcgcgatggcgcggaagcggtggctttggcggagacgctgcatcccgacgtggtgctgatggacgtgcgtatgcccggtatggacggcattgaggcgacacgtcggatcagcgcgttgcagcatcgtttcgcacccgatggcagcgcgcttgacgatgcgcatacccgtgtgatcattctgacgacattcgatttggacgaatacgtgatggccgcgatcaacgccggcgcgtccggcttcctgctgaaggacacggaaccggagacgctgctcaattcgattcgcaccgtgtaccaaggcaacgcgatcatcgcgccatccgccacgaaacggcttatagagaagatgatggatggcgatttcgcaggaacgaccgccgcagcgcccgtttccgcaacgtccgcttccgcttcgacggcaactatgtacaccgatccggaattggacgaactgaccgaccgcgagcgcgaggtgctcatcgaaatcgcgcatggcctgtcgaatcaggagatcgcggacaagctgttcatcagcctgcctaccgtgaaaacgcatgtcgcgcatatcctgtcgaaaatcaatgcgcgcgaccgcgtccaagccgtcgtgttcgcctacgaaaaccatctcgtataaaatcttcataaaacgtattcggcaacaaaaatgctccttctttcgaaggagcattccgtttatcgcctaagcttctgcgagcgcctcaacaggcggtactttgaccgctctgcgggcaggtgcgatgctggcgagcaacgcagccacggcggccacggcgagcacgatgccgttgacgccccattcgaaggggaacaccacggtgccgtacaggctgaacaccacgtatgcgcccagccagccgaacaatgtgccgagcaggatgccggcgatgccggagacgagcgagatgagcagcgcttcgatggcgagcgatgccctgagctggccgcgggtcatgccgatggcgcgcagggtggccgattcgcgggtgcgttcgatcaccgacagggacagcgtgttcgccacgccgacaagtgcgatgagcacagccacagcgatcaatcccaccagaagcatcatcatggagtcgatcatcttcgcccatacgatgcgttcggcgatcggtccggtcactgtcgcatcagtgctcttctccaatgcggcctgcatgtcgttgtagatgccgtcaacggaaactcccgacttgtcagtatccgccttgaccagcagcacatgggtggcggcatcgaggtcaccattggtgaaatggctttcatccacgaatccgacagctccatactgtgcggatacgcgacggtagtcggcttggtttgcttgcaatgtcagcgaacgcgtagcgtcgccgtcctggttccattcggtagagaaatcagccgtaccattggcgaactgcagttccttgccggtttgcgcattgtatgttggcatgagcacgccatcactgtcgatggaggcgttacccaagttggcacgcatgacctgcttgacctgatcgatattcttcacgccgaccagcaatgcggacgtaggctgggttccatccgctttctccaaggtcacggaaaccgccggcgcatacaacgtgtcggacacgccgttgatgtcggctacatccttgaccatttgctggctgatgtcatcgcccatggccacgatgtcgacgctataacgggtggcgagcgcaccattcatagtctctttggcgctggcggcaccggttgcgatggtggaaaccagggtgacgccgatgagcagagcggcaccggttgctgcgatgcgtcgctgattcttctgaatgttggcgtgcgcaaccgttgcggaaggtcctgtcagcgaggccaacgctccaacgcccttcatgagggccggcatccagaacaccgctgtgaccaccattccgaggaacaccagtgcggcgccggcgatggctacgagcagaatcatcgtgaattgatcgctgctcgcatcctcgccgccattggtggcctgtacccgccagatggaaaataccaccatggcgataccgaccaccaccatcagaataccgattatggctcgcgtgaggctggaacgacggttgtcggtcagttcaatcgggcgcaatgcctccaatggcgtcaccgcagtagcggaacgtgcggatcccagggatgcgagcaccgtcaccacaataccgaagagaataggtatgacggcggcctgccaagagaaattgaatcgcataccctcttgcatgatgtcgctgacgcacatgccccacatgagcagacttcccagcatcacgccaagcacggatgcgacgaagccaagcactgccgcttcgaacagcacggaaccatacagctggccttttttcgcgccgatggtgcgcagcaaggcgagtgtgcggcggcgttgcgccacgagtacttggaacgtgttggcgatcaccagtgccgccacgaacatggcaagcacgccgaagcacatgaggaatgtggtgacgatgctggtttggttgccggttaaggatttgatgctttcgtcactgacctgctgtcgcgacatcagatcgaaatgctttggcagcaacgctttcacactgttgatggtttttgcggatacgctatttccatccaaggcaaggtcgaggtataccgttgttgttccggtggtgtcgaaatcgtccgttccctgcattgcggcaagcagattgtcggatcctacgatcgcaccaccatagtacgagtaggcgccgttcggatcggaggtgagtccgaccacgcgcacgttgtccgctttggctttgccatcggtgcctaccgcatattgggaggtcagtcttacagtgtcgccaatgccgacgttcagctgtttcgccatgtcttccggcagtgcgacttcgttggagtccttcggctggtccccttccgtaatattcacgggaagcatgttcttctgtgccgcggtagagatgatctcgccgctgatggcgctgccccccctggaaacgctgacgccggtttccaccgaggcgcggacaccgtcaaccccttcgatgccggcgatctggtcgagatggaagtcgccgacagtgctggagtacgcttcgttgagttcctcatcgctcaggtcggagctgttgacggtcaccgcatagttggcgtttccgaacatggcggtcatctgccgtgtcagggagtcgttcatggcattgccgaacaggaaggtgctggcgatgaacgccgtgccgatcatgatggcgatgcctgcgggtatgagcatgcgcttggtttttcgcatgagtttcaaagtgatggaccacatggttaattctgtttccttcttcgaatgcttctacagtgcgtttagcgggaatgtctcacggaagccacattcattgtggcggcttcgcgttccttcatcagcagttcactcatctggtctgctgtcggcttgttcacgtccgccacgatctggccgtcggcgaacacgagcgcacggtcggcgtaagacgcggcgaccgcatcatgcgtgaccatgatgatggtttggccaagttcgttgacggaacgtttcaggaagctcaacacttcggcgcttgatacagagtcaagattgccggtgggctcgtctgcgaacaccagtttcggtttggtgatcaatgctcgcgcgatggccacacgctgctgttggcctcccgatagttcgttcggacgatggttaagacgttccttaaggccaagcgtttccaccagcagacgcaaccactgtcggtcgggtttcgctccagccaaggtcaagggcatgagaatgttctgttcggcagtaaacatcggcagcagattgaagctttggaagatgaaaccgatctgatggcggcgcagcagggtgagctggtcgtcgttcatgcgggtcagatccttgccgtcgaacatgacgtgtccgctagtggccgaatcaagtccggccagcgtgtgcatcaacgtggatttgccagagccggaagggcccatgatgacggtgaattttccttgttcgaaggcgatattgacgtcacgtaacgcatgcaccgcgttgcttccggaaccgtagtccttgacaagatcgatggcttcaatggcagtgttattggctttgatggcgtccctgatgtccatggaagttcctttctttgcgaagttacttccaacatacggaacattcgacgtcaacggcatcatgcgttggtctgaaatcctgctgaaccgcgactcatccttgagtatgagatcaacgcgggaacagcgaaacgctcttccggatcagggcttggaacacagatcatcaacacgttcgtcaccaatgattttggcggaacggtgcattgggagccacgtcgcggtggtggtacccgtgtggtgctcgacatgaaactgcgtgccgcgcaagataactgacctctagaactggaatggcatatggaagggccggtcggattccatcgaatccgaccggcccttccatatgccctgaaaagaatcagacctgcatctgcatggcctgcgagcgacgtgcacgcatcgcgcgccgcttgagcgcgcgccgctcgtcttcgctcagaccgccccaaacgccgtagtcctgattggtgtcgagcgcgcatttcagacacgcgtcaatcaccttgcaggtacggcaaacggccttggcttcttcgatttgctgataggcggcaccggtgttgccgaccgggaaaaacagttccggatccttatcccggcacgcggccttggctcgccaatcgaaagcactgctcatgtaatcgccttcctcttgccataagtggcgttctatccgttatttagataaccacgaatcggatgatttttcaagactttttcgcaaaagaagccaggtttttttagaatccttggaattccgcgcattgcacgggacatgcccgtgcttgttggatgaagaccccacgcccggcaatggcatagtcatcgacgccgaaaccgtcgagaaccgcgctgggaatccccatcatcacatcggtggctctctctccgcaaggaaacgcaacacgtgtgaggcaacgttcaagtagggtgctttgcggcttttccacagctgcgattaccgtgacggacggatcggcgagtgcggtcttgagcttatcggcttcgggcatggctgcgaaaggggagagcaattcgtcggcgtcatccacgaaccatatggtgcgttcgtgctgcggcgatattctgccgtcgtcggtggtccattcgctgttcgtcttgcgtgtgaaccggatggtgcagcgaccggattcatagagacggctggcgcagcagagcagcagattggttttgccgcttccgcatgcgccaatcacggcgatgttgccgtgtcctacgtcaaggaatgcggtggagatgagtacaccgtcgtcgctcaaagcaaaaggcacatggtgccatgcctctcgctgtggcgccgtcaaatcgtctttgcctgcatgtggtgcgagcggcgcggagaacaaaggggagggattggtggtgccgctgaatgccgatgcggtgttgatggcatgcaccaaggaatcaatgtcatggaccgcgctgcagcggaaaggaacagtgcgttgaccgtcatgacagtaagcggcaccggggaaggccggtggaatcaaagctgcatccttggtgccgatcagttcattcgattgcatttggtcggtgacgcgtaggcagatgctcagcgatatgttggccttcatatcggcatggacctgacccatgggattttgcgtgcatacgatgagatgcatacccaaagagcgtccgagcgacgccaatcgattgagtcgctgcatatagtcgggtagacggtcgcgcaatgcatggaattcgtcaatgaccaccacgagccgtgcagggggatgggaaagctggtcgaatctggaaacgcgttcggcacttaccaaggcctccctgcgtgccaattcttgttctatggcgttcagcgcacggacggcatgggcgaggtcaagatcgcagacgttgcccacggtatgcggcagacgctccaaagcgttgaaggtcgatcctcctttgaaatccagaaagacgaaatggagggtttgaggactatgccgaatcgccaatgccatgcaccaactgatcagcagttcggatttccccgagcctgtggtccccgcgaccatggcatgcggtccggatgatgccagatctatatggaatatgccatgttctgacatgccgatgccgttcgttggggaacggacaagccaattacgcacgatggtgcgccatatgagcgggtcgttgtccaggccatgcagatgctcaaaacttatggacggcatgtcggcgaaaagctgagcatggtcgatttcgtttccgttatgatgcgttggaaccggcgaatcgcttccagtaatggtgttgctgttcgtttcttcatgcctgacgcgcatgatcatggtgatgagcatcaatgcgctgccaagcagactcggagcgagcatcgccgcatagagccaatgacgttgcatgcacatgacaatcagcatgatgagctgcgccagcaaaggcgcgctccaactcaatacagtgagatgttgttcgcttatacggtgaggggcctttttgttcatacggccagcatgggcaagagcggcggcatgccgcaagccaatatgagggttgtggtcggagaatgtgggttatccacatcctccggcgtgtcgtcagttttgctgttcggccagcgtgcccacggttcctgcggaatgcgtgccgtgtgagagttcggagaaaagctggatgttcttcgcgtcatccagcagaacgcacgatccgaccccatcgacgtaatagtccggatcggtccaatacacgcttcccgaaatgccatccttgcctgaggcgcttttgaaagccaacgccatccgaagcagagaggaagtcgatgctttctcatccacggttacggagctcaacgccgctgcggcgacctttttggtcttgttgaaattcgtgagcgtctgtttggaagcgcccttcttgacgatggcgttgatcacctggcgctgacgtgcggcacggccgaaatcgccttgcacatcggcatatcgcatacgggagaacgccaaagcggtgttgccgtccacggtgtggcatccggcggtccagttcatacccgaataagggtcattcacattctggtcgtagcataggtccacgcctcccaaggcatcgaccactttgacgagtccgccgaagcggaccattgccacatggttgattttctggccggtgatgtcctccacctcgttgaccaactgtttgcggctgtacagctgcgccacggcgttgatcttcatatagctcccatcgatttccaccagggaatcgcgaggaatggaaatcagcgaggatgatcctgttttcggcttggtgagtacaagaatggtgtcggttctgaaaccttcgacgtcaccggcatctccgatggtgccctcacgttcgtcggagccaagaataagccagctttcgccggcggtgtccgctttggatgtcagccaggtctgtttgttgagctggtcatcgacccagttccaagcggagaatacccctattcccagtgcgagaatcagtacaaggaaaatggaaaggacgatacgtccgacgcgaggtcttctttttggcacggaagccgtcgctggagaggatggaacagatcggagcgccgtggagacggaggatgacccccggaactgctgcgttggattggccgtgcgggtatgttctggagcgaaggacaccggagatgatgaagggtttcttcttgtctcgctcgttgcccgtgccgcaggctggaagctttgcggaaccgaggaagaaggacgcgccgtgcgtttggccggttttacggatgatgcatggtcggaacgtttcgccggtgcgaaactcgctggctggctcggtgcgctttgcgagcgggaggaatccgtggacggcatggtttttttgcgtcctgatgacggaatgaaacttggtggcacgctcgtaggctcttttgctcctttgccttcactcatggttcctccaaaaagattcgtccctgcgtcatacgttgaaaggggacgtgattgcgtggtctacgtcagttctttgccggaacggcacatacggtcgcattaaggtatcgatccgcaaggccgatgtactggcccgtggtcgcgtcatgaatggagccgtcatccgggtcgacggtgccgccagtgcttggatcgaccaacgtgccgtcggatttggtgatcagtcccgtgacgggatcgggagtctcggcagtggtgtccgactggttgctgtcggtcgtgccggaatcgtcggagctggctgaattatctgaactggtgtcggagaagtcgcccgagtttgaatcggcggtatcgaaaatcggcttgcccgctcgcatcttctcccagagattgtcggcttcgtcggtccagacggaacggttggggtcggacggtgctgggaccacggggacggtctgggtctgcaggttggtcatggtgaaattcttcaggctcatggcaagtcccgccaaagccgcggtatcagccatgccttgggatatgttgagcgatttcagcgcggatttcgccagctggtacagctgcgcggtatcagtgaacagattcttgctgagcgcctcgctcagcagctgcttgatgagatactgctgacgtgtggtacgcgaggtgtcggatccgtctcctatgccgtgacggatccgggcgtactgcgtcgccgcaacgccgtcaagatggtgcatgcccttgtcgagattgagtccggtgtacgggtcgttgacgttctgcggaatgcacaggtccacgccgccgactgaatcaatcatcttgaccaggccggcgaagtccacgacgatgaagttctgaatattcaacccggtgagactgttcacggcgttcagcgtgcagctggccgccgaggagagatctccgccggttttgtaggcacctgcgaagatggaattgaacatgacgttatactgtgcgggaatcgtgcccttcgacgtttcgcactgaggcacgtccaccagggaatctcgtggaatggagaccaggttgatttccttgcggtcggcggagatctgcacaatcatggcggtgtcggcctgatggttgccgatgacgtcatcgaaactgcctccgatggcttggttctccgcgccgtcacgggaatcctgtccgatcagcacgaactcgatcggcttgccggagttcggatcgatgatggatgcgtccgtattcagggaaccctggccgatcacgccgaccgaattgttcttgatgatgccattgacgtccatccaagtagcggcagctgcagtgccgacgaacaccagagtcgcggcgattgccgcggcgactgcggtcctgacgtgatgctgcacgcgatatcccaggctgtgacgtggtttcgcatcctgaagaccattgatgttaggaagcttattgccggttgatgacgttgccacggtgttgccttcctgattgagatgcgcgtttgacgcaatgcttttagaacctaccactatccaaatgggcaattatagggttaatggccgattttcaccgattctgcgactgtagaccccagattgggctgaactttagcatggattttctggaatataggcattgacacggggaaacttgacaaaattacattgcgtgtgtgtaatttgaagcggtgtgaaagtatgcgcataaaaggtgcgcacacaattatgggaggactcatgtggggcgtgactgatgagtcttctgagaatccgcttgctgaactgtggggtttgttcaagcgggatgatgacgtgtcttggcagcacaaagcgctgtgctcgcagaccgatcccgaagcattcttcccggaaaaaggcggttccaccagggatgcgaagagggtttgcgcccagtgtgaagtccgtgaacagtgcctggaatgggccatcgaccatgatgagcgtttcggtatctggggcggtatgagcgagcgtgagcgtcgtcgctacaaaaaagagcacaaggaacgggcttgaaggcatggtgcgtcccgtgcgtacacttaaattatgaattctaacgccagcagcgatatccagacaatcgtgaccgatgtgctgaacagcagaccgtatacgcatcggcaggacgtcgatatgtccgtggctgcggtgatcaccgcgcagcatgaccttcgattcctcgcttctaccgttggagcggtgcttgcgcagcgcatgcttccaggaatgatcgttatcgccgattgcacggggcagatcgagcagcccatgcagatgaccttcgatgtcattcactcatcacaggatgtgcttacggaagtgccggaagccaaaacggtgagggtcattctggtgggagtgaagcaggcggcgtccttcatggacgctgtaacgcgtgcgatggatcagatcggcattgatgccggcatccgcgcgttgtggaccttgcatgacgattcgcggccggcggatgaccggtgcttcgagacgttgctggatgcgtggagaaacacgccgacagccgcgctgctcggtgccaagcagttggattggcaggcgaagaacctgcacaatgtgggtttgtatgccgggcgccatgatgtcgtttccttggtgatcgacggcgagcctgaccaggagcaatatgacgggcgtcaggatgtgctgtcggtctccctatcgggcgcgttggtgccgttggctacgttgcgtgcgttcgaaggggctgacccctggttcggcaccttcgcggaatccacggacctgtgccgccgcatatgtcttggcggtgggcgtgtcgtagtggttccccaggctcgcatcgcccacagaagagcccgattcgaaggaatccgttccaagaacgggcgccctgtggaagacgaggacggtcgcatcgatccgtatcttgccgtacgcgaggcgaatgccaaatacgcgtacactgacatgcaccgttcatggtggccgttgctttggctgtggtccatcatccagtcgttgggattggccgtgctttgcttggcgcgcaaacagccgtatcatgcatgctgcgagctggcgatgccgtggcgtgcgctgctgcgtttgcggggtgcttggcgagcccgtgcgcggttgtgcaggcaaagcaaggtcacgcttaaatcgctatccacgttgtctgcgaatcaccggcaggtcagggaatggctcgaccgtcgccgtgcgttgcgcgaccagagggatgtcgtgctgctcagtcctcttgagaaggaccatctgcgtaaacggttgctgcgtagatggggattggccttcggcgcggcgctgattgccggcatatggatagtcgtgctgtattgggacgtgcttcgttccgtatgttcgggtgcgtcgatgtattccgcacagctgttgcccacgggcgcgagcttcacccagttgcttcataccgcgaccacgtcgtggtcgtatgcctcaggcacgggcatcagtgcgcctaacgcgccatggctgttggtgcttgcgctggcgtcggtgctcactggtggacatgttgccggagctgtcggactgatgttcttccttgcagccccgctcatggtgttttccttctgggcgctggccggcatcttcacccgctcggatgcggtgcgctgcgtggtcgcgttggcgtggttcgcgttggcgttgtccatgggactttatgatgacgcggatgtcacgatgctgactgtcatggtgtttcttccggccgctttcgccttctcgttccgtgcggtcggcatgtatcggacggaggatctggtcaatccccacgcgtcggtccaggcggcggcggttgcggcgctgtgtttcattccggtcgtcgccgcgcagccgcagttgttgctgccgctgatgctcaccttcctgggattcctgctgttcgtccgctcccataagcccgcgttgctgctgattccgcttccggcggcgttcgtatgcgcgccgacgttggtcaatgccgttcgtttcgcttccgacggtacatggcgtcagctgttcggcagcgtcatgctgccctcctccacgcatgatggcaaaccggtcgtcgcgaatctgtccgatctgttgctgcgggtgttcggcatcggcgccgacggtggcgcatggcggtatgtggcggtttccatactggcgttgatcgtattgctggccgcggtgtcattggtgttgcctttcgtgctgcgcgtgtcccgtatgatgtggatcgccgtgttcgcgggattggcgacggccttgctgtccgcggcgattgcggtggccgtcgatgtggatggtccggtctccggttccatgcttccgggaaccacatatgcgatgatgggcttgctcgcctgcatctgcatgatgtcgggcggcgcggttcgacgtttcgtcatgctgagacagcatgagaagaccggcgccgtcgaaatcgaaggacgtggctcgaaggcagtgtcgattgcctcgcatgtgggtcgtgccgtattggtttgtctgttggccgtctccgtcgtggcctgtgcgggattcaactatgtcgaatgcgatcacagccaggtaaagaccagcgatgctggactgccgatggtggcgaccgatttccttgggcaggatgatgcacgtcgcgtgcttgccttgcgtgccgatagcgccgaatcggtcagctacagtgtgatgcgtaccggtcgtggcgacttgattgacagctctcccgcgcaacgcgtcgaagtggtttcgggacgttccgacgggtccagcagaaccattgcgcaggattgcgcccagttgctggccaatgccgattccgatgccatcaacgagcttggcaagttgggtttcggcggcatttacgttatcaagcagaacggcgacaaagcgcagcgagaggcctcgaaccagctcaattcgaacattggagcctccgacgggacacagaatgtcgtcagtctggataatggcacgtattatcgtttgacggttcaggatctatccaagcagcatatcgatcgaagcgggcttgataaggccggctcaagtgtgtggcgtcgttcatggctgtggtgcatgggcgtcgttcttgtagcgtattgcctggtggcgcttccgcgcattcgtcgtcagggtctggaggaagcatgagcagacattctcgtcccaatacgcctttgcgtattgcgcttgccgtaatctcggtgttgctcatcgtggtcctgatgaccgtgacgctcatataccggccatcatggctgcatgcggacacgcccacggtggaacgctcctcggtgggtcgtaccgtcagcccccggcagcggcagacgtactgcccgtctcgcatgaccattgccgataccgatgcctatggagatagcgaataccaggcatccaacggcaatatcgcgtcttccgcgagatacgccgccttcggttcggtgttccattcatccgtcgcctcgatgggaaccgacatgacggcatccgtgtcgatgctggacaaaaaagacgactcgtccgatgacatctttgtggcttccggcaatgtcgatgacggctcccgattgcaagacacgcgtctgctgacggcttcgaacggtaccggcgcggtttcctcagtgatgtcatgggccacggacggtgatttgaagggcgtatcagcagcctcctgcgtcgtgccggcgctgaaacaggcgttcctgctttccggtacgaagaccggcttgacgcaacagcttgttgtggccaatccctccgccaaggacacatcggtgaccatcagaatctggggctccgacaaatccggcgcgctggcgctctccaccggatcgacgctgaccgtggcctcaggcaaggaaacggtactgaatctttccgcagctgcttccggccaagacgcgctgtatgccacggtgactggaacggacactcctgtggccgcaatcgtccgcaccgtctccatggacggattgaccccaaagggatcggattatgcgcttccgaataacgctttcgcgaaatctctggccctctacggcttgaatggcggagaccatgcgacactgtacctgtatacgtcccgcaaaacggatgtcaccgtatcctggatcgactccaagggggcacagcagaccaatcagcaggagctgaaggcgaaccgcgcgtccgccatcgatcttggagacgttccaaaatccgctaccggcatcgccatagccgcttccgaaccggtgtctgccacggcgaagatttcagacgatggccccgatggacaatccgatttcgccctagtcaatgcgtccgctccggcgaagatctccgccatcgcggttcctgaccaatccaccgcgacggtaggcttcgtcaacaccgcggatggggatcggaccgcgatcgtgacggcttacgacacggacggcaaacaagtggacaggcgtgaaatcgccatccgtccctcggcctcgacgtcggtgcgcatcgccgatattaatgatggcgatgtcgccgccatccgtttgaaggatcccgcccaagccgtggtctggaatcttcgtgtcggacagaaagatgtgtccggtgcgaaactcgccggacttgccatcatcggcgccgtcgatttgaaggaggccagagagcaggtctgggcgaatcaggatatgactgttgtccgttgaaagtcacatgccccaatcaggatctatttcttccggacggcgtccgtagatttccgccagacgtgagaccacctcgtccctgattgcgaattgcaggtccatacggttacgggcatgcgattgcagcggcatgcggtacagcacgatacggggtggaatgccgtgcccggcgggaaatgactgcgatccaagatgcggaacgtcctcccaaggcgcgggatcggatggcggaacatcctccacagcgaattggaccggagctatgagctcaggccatgccccgttgagtctgcggatttgcgccaccagcatatcgtcgaacataccgcttctggtacggtaccggggcagtctggtaccaaacatgggcgtacgcgtgccacgtccatggcggttgcggtatatcggggtctcccaaggcatctgttgcatggtttctaccttatcagggcttattcgaaacatgcgataccatggtatgggctgctcgacaaggggagaaatgatcatggcggatatttccgtaccttattggaacatcgttgatgtcaacatgctgtgcgaaggcgcgcggctgattgggtttgacctcgacaacacgttggcgcggtccaagaaacctatgaaagcggacatggccgaatgcttctctgcattgacatcattgattgacgtcgcggtgatcaccggcggcaaatactcgttgctgcaaagtcaggtggtggacaggctgtccgaccatgccgacaagtcgaaacttcacctcatgccgaccagcggaacccgctactaccggtgggacgggcaacggtgggggaaagtgttctcccacgatctaagcgacgaggaccgtgccaaggcgaaggaatcgctggaacggaatgctcgtgagcaaggcatttgggccactcatgtctggggcgagcgcatcgaggacagaggcggtcagatcaccttttccgcattggggcagcttgcccccgtcgaggccaaggaggcttgggaccccaccaacgagaagaagaaccgattggcctgtgcagttgctgccgaactaccgaatcttgaagtaagacctggaggctccagcagtgttgatatctcacagcgtggcgtcgataagtcgttcgccgtccgtgaactcgcggatattctcgatatcgaggtcggccagatcgtgttcatcggagaccggatggaacccgacggcaatgattatcccgcggcgaaggccggcacaagggctgtcaaagtgaacggtcccgcggataccgtgaaattatgcggcgagatcattgccagattgtcccgatgacggagccggcgtgaatctgatggcgggttcattcgcgcatatggcgaatctgttgttcccacgaggctgtgcgggatgcgacaagcctgatgacgtgttgtgcgatgcctgtcttgcgtcattcgactgcgaactgtcccaaccattggaaacggctgagatgggtcgatggttcgcgtgcggatggtatcggggtgccgccagacagtcgattctggcatggaaagaccacggagacgaggaatgcgaccgtccgttctcggatgcgttgtgcaggcttgcggaacgcgccggtgtgattgacgccatggatggcgttcgtgagatctgcgataccatactggtcgttcccgcgccgtcgtcgattgcttccatgcgtcagcgcggacgacggcacatgatgccgctggcaaaacggttgtcggcgtttctacggtgccggacaggtttccgcgtacaggtatgcgatgcgttgacgaacaaaggaatcaaaggcaaatccgtcgagaccaagggcacggaacagagggcgcaacgccttaaggggcatgtcatggttcgtccgggcgtcacccttcaaaacaaggcggtgattctggtggatgacatcgtcacctctggagccaccatgcgtcgttgtgttgacgctctaacttcacagggagctttggtcattaccgtgctggcgttggcacacactccggccggcagacctttgacggcgtaaatcgtcactcgtcatcggaaatgtgatatttcggcaaagtgatttcgaaatcggcgccgcgcggatcatccaccactcgtaccgtgccgccatgcaactgcgccgcccatcgggcgattgacagtccaagaccggttcctcccgattcggtacctggtcccgtcttgcctttgacgaatcgacggaagatatcggaccgcgcttcttggggaatctgcgagccgaagttgacgacattcgtcacaatcgtgccgaaatccttgttttcatgcgcttcgatgagcaccgcggtattgtctgcggagtgtttgagcgcattggcgatgatattggtgaacaactggcgcagacgatcctgatcgccttccatttcgatgttgtcgggcacgtggatttcgatattgtgggcatgcccggcatcggcgatttccaacggttccacggtttcgtcgatgaaatccgcgaaattgaatttatcgatctgcaggctcgccgcaccggcttccatgcgggacaaatcaagcagaaacgcgatcagatccgacaaacggtgcgtttggttgagaatgctttccagattcgatggggtcggttccacaacgccgtcggccatgttctcgaccatggcctgcaacgcggatacaggcgtacgcagctcgtggctcacattggctaccatgtcccgtctcatctggtcggcatgctgcagttcctccgccatctcattgaaagacaaagccagctgtccgacttcgtcgcggctgttggcatcgacatgcacccggacggtgtagtcgccgtccgccatagcctccgcggcatcccgcatctcgcgcaggggagaggtgagtcctctagagaagaaataggtgatgcccaaagccacggcaagtgtgatcggcatggctatccacaggctcaatccgactttgagcaggaaccaagccatgatgaatgcgatgatggtggaaatggtgatcagcacgctcaattccattttgagcgaagagaacaaaccaatagggcgttcggtatccaacggattgaccgaacgccctggttttgaatcagtggtacgcataccaccaaatcttagcgcatcatactattcttccggcggttcgaacgcgtagcctacgccatgcacggttcgaatggtcttcgaacccagcttgtgacgtagcgccttgacatgcgaatccacagtacgggtgccggacgcatccacccaatcccacacttcctcgagcagcttctcgcgagtgagcacggacttcggcttgcgggccaaagtggccagcaaatcaaattccgttggggtcaaatgcacctgctccccattgacggtgacgatacgctgggccggatcgatgaccagagagccgaaatcaagcagtttctcgttttcggagttcttggcgatgaccttcgccctgtccacacgacgaagtagcgccttgcaccgggcgatgagctcgcgcatggagaacggcttggtcatgtaatcgtcggctccggcaccaagaccgatgaccttgtcggcctcgtcgtctcgcgccgtcagaatcagcacaggcacaggacgttcagccacgatgcgcttggtggcctcaagaccatccatcacgggcagcatgatatccatgatgaccagatccggacggagcgtggaagcggcctggacggcgctggcgccgtcggaagccacgcgcgcggtccaaccctccgcagtgatgcgctgcgcgatggcggtggccaaggtcggttcatcttcgaccaccagaacggtacgtggaattactgtggattgtgctgatgaattgagcatagcgttccgcctttctcagagttccggcttcaagaatactgctcccagtgccggaacggtgattttcgcggaccaatcacgggaatgatactcacccttgaccgccttgaaggtgccgttgtgaatatcggaaccgccgtacttcttatcgtccgtggtcagcacttcggtccacttgccgcccttggtgagcggaacctggtaatcctcccatgcctcgcccgagaagttcacgacaacgaccatctgctcgccatccttgccgatacgcacgaagctgagcgtgttatggtcggcgtcatcgctggtcagccattggaatccggcaggatcgaagtcctggctccacaatgcgggagacgccttgtacagggtgttcaggtcggcgacgagcttctgtacgccacggtggtcaggccaattgagagcatcccaatccaccgaaccgtcatgatcccattcgccgtactgcgccacctcattgcccatgaaggagagctttttgcccggatgggcccactggtaggcgaacagcgcgcgcacgccggcatagcgctgccagtcatcgcccggcatcttgccgaacagcgagcccttgccgtacacgacctcgtcgtggctgatcggcagcacataatgctccgagtatgcgtacaccatggagaaggtgatctcgttgtggtgccacctacggttgatcggctcctcgtgcagatactgcagggtgtcgtgcatccaacccatgttccacttgaggccgaagcccaaaccgccggcatcggtcggtgcggtgatgccgggatacgcggtggattcctcggcgatcatcatgatgcccggattgttcttgtacgcggtcgccgtggcttccttgaggaagtcgatggcctcgaggttctctcgtccaccgtagatgttcggatgccactggcccggcttgcggctgtaatccaagtacagcatcgaggagaccgcgtccacgcgcagcgcgtcgatatggtactcgtccagccagaagcaggcgttggccaccaggaagttgcgcacttcgcggcgtccgaaattgaacacgtaggtgccccaatccggatgctcgccacgggtcgggtccggatcctcgtacagaggcgtgccatcgaatctgccaagggcgaacgcgtccttcgggaaatgcgccggaacccagtccatgattacgccgatgccggcctcgtgcatcttctcgacgagatacttgaagtcgtcagggccgccaaggcgcgaatcaatcgcgtaatagccggttacctgataaccccacgagccggagaagggatgctcggccagcggcatgaattccacatgggtgaaaccttccttctggacgtaggggaccagcttgtcggccagttcgcgatagttcttcacatccttgcgccagctagaggcatggacctcgtagatgctgaccggaccgttgtgcgggtcggtcttggctcgctggtccatccagttctcgtcatgccacgcatggacggagtcgacgacgatggaaccggtgcgcggcggaatctcatgcgaacgctccatcggatcggccttcatgacccattcgttgttggcgttgaggatctcatacttgtaaatcgttcccgcttcgacaccaggaatgaatagctcccagactccagaggagcccagttcacgcatggcgtgggtgcgtccgttccagccgttgaaatctcccaccacacgtaccgcatgggcattcggagcccacacggtgaatgcggtgcccaccagctgttcgcccttgacgccgtcattggagcccaacggatcgtcatagcgcagcacgcgcgctcccaaagcctcccaaaggcgctcatggcgtccctcgccaaacaggtacatgtccaaatcgccgatggtgggcagataacggtacgggtcgtcggacaccacggtggaaccgtcttcatattcggtgctgatgcgataatcgggcacgtcgaagccgtcatcggtcttgatggccggaatgagtgccatgaaaacgccattgtgttcatgcaccgcctgggttcgggcattttcggtgatgatcgtcacggatttcgccaacggacgaagcacgcggatcgtgacgacatcctcatgctcgtcgggaccgagatgcccgccgagcacctcgtgtggattgtagaacgtaccgttgcttactgcatccaggtcgccctgtgcaacaggaacggcaacgctatcttctttgatcttggattctgtagccatgggaaaagtgtaagcatgaaatgcttgaaaattggcccgtgtcgcgtctttttttggttttttggcggatttttaggcaagtccaaccctgatggcacaataattcgggttttgtgtaagcttttcacggaggattcatgggttacaaggtcggcgacatggtcgtctatccgcgtcacggcgcagcgaaggtggaggccatcaccgagcgaacggtcaagggtgtgacccgagaatatctgcagctgtcggtgctgtcgtccgacgggctggtcatcaatgttccggtggagaacgccaagaaagtgggtgtccgagacatcgtcggcgccaaggaggtcgcgaaggtcttcgagattctgcgtactccgatcatcgaaaaggaaatgaactggtcccgccggtacaagctgaacgttgagaagatcgccaccggcgatgtgaataaaatcgccgaagtcgtgcgagacctcgcccagcgtgatgtcgacgagcatgggctgtccgccggtgagaagcgcatgctcaccaaggctcgcagcatcctgacttccgagatcgcgttgtcggagcatcttgatgagaatgaggcccagcgtctgcttgacgtgaaccttggttatgaaccgccgcgccctggcgacgaggatcatcacaccgaagctcctgaagaggcggccatggacactttggcgcgcgtcgaggcggagaacaagaagtccaagaagaagtaagggaatttccatgcgtatcggtcagggatttgacgcccatcgattcgcgtcccatgatgcaggcaagccgttatggcttgcctgtttgcgttgggatggtgacggcatcgaaggtgattcggacggtgatgtcgcagcccatgcgttgattgacgcgttgctttccgcagccggattgggtgatataggcatgcttttcggtgtcggttccgattccgccggtgccggcaagcacggcgacgagatgctccgcgcgacggttgcgtatttgcgtgcgcatggcatgaggccggtgagcgcaagcgtggtcgtcgtggccaatcgtccgaaaatcggcaagcgtcgtgacgaggcgcaacaggcgttgagccatgccatcggctgtgaagtgtcgctgacggccaccactaccgacggcatgggattcaccggttcgggcgagggcatcgcggccatcgccagcgccttggtggaaccgatcggctgatactttcgctacctgcggcgtgccgattcgattattttggcgacaatccagaacagtgtggaaatcgtcacgatgatgaagcttgggggagcggggaacatggcggaaaccaacagtccaccccaaatggagatcaaacagatcacggtggagacgaccatcgcggcgaatggggaccgtgagatgatgttcgcagtcgcggcgggcgtgaccacaagagcgaatatcagcaatgtgcccacggcgggcaccgcgatggtgatcacaccggccataatggccatgaagcagatgttcatgagattcaccggcacgccttttgcctgcgccacctgttcatcaagcgagctgaacagcagcggtcgatagataacggccaaaacggccagcaacaacacgtcgaaaaccgcaaatccgacgatctgcccgtccgtgatcgtcaggatggagccgaaaagaatcgattgcatctgctgcgaggcggaactggacaagcgtgcgaaaaacagacccatgcctgtggcgaacgccaatacggttcctgtggcgatttcgcgttgcgatgcctttttgcccagtgcgccgatcaccaatgctccgccgagagcgaacacgccgagaccggcactgaccggcagacccaacagcacggctccggtcgctcctggcagtccgatgtgcgccagcgcatgcgcggcgaacgtggaatgacgggcgatggtgaagtaacccatcactccagcagccaaggcgatgcacaggccggcgaggaaagcgtttgtcatgaatggcgcggtcagcgtgcccatccaatccggatcgaaggagaaagcggtttcgttcatgatcatgcctcctgcgaaatgcggttgtgttggtggaatcttgcgatttcctccggcgcgtgggcgtcgacgtcaatgtcatcgggctcatcctcgcttggagtgacgaacatatctccttggggagtggtgaccacctgcaccgtggtgccatatagatgggtgagcagcttcgaatccagtacctcgttcatcttcgcataatgcggatgcccgtcgagcagatatacggctccggtgagaatcggcagaagcatgttcaaatcgtgcgctactacttgaatggacatgccgagttctcggttgagtttggcgagcacgtgcactgtggcgcgttggctggccagatcaagattggcgagcggttcatccaacatgagtagttgggggtccgacaccagcgcttgggcgatggcgacgcgttgccgcaggcctcctgagagttccgacagccggtatctcgccttgtcctgcatgccgacgaattccagcgcattgcgtactttgtctttttgcaggcgggtgatgggatgaatgccgaaccttgccccggtcaggccaagcagcaccgactgttcggcggtgatgttcgattcgatgtcggatgcgtagctctgcggcacataccctatacggtgattcatggcgccggccggcttgccgagcacggttatgtcgccgtgggcgatgggaatcaatccgagttcggccttcatcatggtggttttcccggctccgttggtgccgacgatggctgtcaccgagccttgcgggatacggaaggtgccatgctgccagatgatgtgtccgccgcgtgagacccctgcgtcgtcgaattcgatacagaatgatgccttgtcgtgcatggctcgctcccttgataagtcaacgatagtattctcacaaacggtgttgacaatcattctcaataagaagcatgcatggacgatgaaaagtctcgtgatgaatccgcctggatcgtaaccgttgctggaaaaaaagagtccgccgatgtcggggaattactcgacatcggcgaatcgggggagggaggatgaccgtggctttatttaccggggtccgtctgccctgtgttgtccggcgttgcggcgtcggaatcggagtcgggattgtcgttcgacggctgctcgccattcgattcagagggagaggcgtccgaatctgatgatgtcgcatcatctttggagggaaccgcctcattcatttgcttgatgagctgcgcgatccatgaaatcaggcttttgctgtcggccggcatctgttccgtgacgtcgatgaccggcacatcggatttgtgtgcggtgccggtcagaatatttgtggcatcatccgccttctgaacattgttgatcagcatatccacttgatgcccctccagaatcttctggaagtcctggagttccttggacgagggttgcgagccttccgagatggactgcgtgtagctttcgggagtcttatcggataggcccatgtcgctgagcagataatatgcgaccggctcggtggctgcgtaggagacgttcctatgtgtatcggagaactctttcatgcttctctcgattaccgtctcgcgtctgttccacgccttgagtttgtttgtgaagtatttcttttgcttgggcatgatgcggctgtaggtgtcggcaagctccttcgccatggcgttgcgtgcgtcgctggagaaccagagatggggattgtctccctcaacggctccgaccatttgcgcggccgaaacggaaacggtgtctctttccaggttttttgtggcccaggagtcgtatcccgctccgttggacacgacgacctgtgccttctgcagggtgtcgacagcagtggtcttcggttcgaacgtgtgggcgtcctctgttgtggaggacagaatcgaggtgactttgacgtgcacgccgccgatctgctccgccaaagccccccactggttgaccgacgccaccacgttgatcggggtggtctgctcctttggtgtgtcgggtgccgttggttgatcgggctccgaagaagcgccaaagcaggaagcggtgcccagcaccgtgcacaatgtgattcccgcggcaaggatgcggaaaaatggacgctggtgagagcgcatgtcgattgccttcctcttgggtcgtccgtcgtttcggtcgcgtccatctcatatagcacatgcgcgacttacgactgaaaccaagatagcctacgatacttgcaaatgccaatacgacaagcgacttagcgaggaagtggaccacatgggaacaaggattgatggcaaaaaggtggcggcacggaccaaggcggacctcgccaaacgcgtggaactgctgaaggcgaggggaatccaacctgggttgggtaccattttggtcggatcagaccccggctccgtgaaatatgtcgccggcaaacatgccgattgcgccgaaatcggcgtgaattccatcaagcgcgagctgcctgagaatgcgacgttcgatcaggtcgtcgatgcagtccgccagctcaatgcggatcccgcctgtaccggatatatcgtgcagttgcccttgccaaggggaatcgacgagaacgccatcatcgatctgatcgatcccaagaaggacgccgacgggatgcatccgtataatctcggcgaacttgtgctgcatgcccgaggagacattgccacgccgttgccatgcacgcctcgcggcgtgatcgagctgttgcgcgcctacgacatcgatttggatggcaaggaggtgtgcgtgctgggccgtggcatcaccatcggccgtaccattggtctgttgttgactcgtaaggcggtcaacgccactgtcacgctgtgccatacgggaaccaaggatgtgcgtgaacacatgcgacgggccgatgtgatcgtcgcagccatgggagtggctggtttcgtcaaaccggaagacatcaaggaagggtcgattctcgtcgacgtcggagtatcccgcgtgttcgacgaggaatccggccgatacaaggtcaagggtgatgtcgataaagcctgttacgagaaggctttggcatatacgccgaatcctggaggcgtagggccgatgacgcgtgccatgctgttgcagaatgtcgtggagatggccgaacgtcagttgtgagtttcgcgatagtgctttcgggcgtgtcgtgacatgcgacacgcccgatttttgtgcatggcttcttgtagactttcgccttgtgtgtatttgcgcacacgtataactgaagaacgattttatccatccactattttgtaagaaaccacattaatggcagagaacaataacgaagtcgccaaggtcgccatcaacgacatcggcaccgaagaggacttcatcaaggcagtcgattccaccatcaagaacttcgatgatggtgatctggtcgaaggtaccgtcgtcaaggtcgatcatgacgaggtcctgctcgacatcggctacaagaccgagggtgtcatcccctcccgcgagctttccatcaagaaggacgttgatcctgacgaagtcgtcgaggtcggcgacaccattgaggcccttgtcgtcaccaaggaagacaaggaaggccgtctgattctgtccaagaagcgtgcacagtacgagcgcgcttggggcgacatcgagaagatcaaggaagccgatggcgttgtcgaaggcactgtcatcgaagctgtcaagggtggcctcatcgtcgacatcggtctgcgtggcttcctgccggcatctctcgtcgagatgcgtcgtgtccgcgatctgtccccgtacatcggccagaagatcaaggccaagatcctcgagctcgacaagaaccgcaacaacgtggtcctctcccgtcgccagtacctcgaggagacccagtccgaagtgcgcgagaccttcctgtcccagcttaagaagggccagatccgtgaaggcgtcgtgtcctccatcgtcaacttcggcgcgttcgtcgatctgggcggtgttgacggcctgatccacgtttccgagctgtcttggaagcacatcgatcacccgtctgaggtcgtcaaggtcggagacaaggtcaccgtcgaggtgcttgacgttgatctcgatcgtgagcgcatctccctgtccctcaaggccacccaggaagatccgtggcagcgcttcgcccgcacccacgttcctggccagatcgtcaagggcaaggtcaccaagatcgttcagttcggtgtcttcatctccgtcgaagacggcatcgaaggcctcgtgcatatctccgagctggccaaccgccatgtggagaacccggagaccgtcgtcaagccgggcgaggaagtcttcgtcaaggtgattgacgtcgatctcgaccgtcgccgcatctccctgtccctcaagcaggccaacgactccgttgatccggcttccgaggacttcgatccggctctgtacggcatgccggcagagtacgacgagcagggcaactacaagtatccggaaggcttcgacccggcaaccaacgagtggatcgctggttacgagaagcagcgtgaggagtgggagtcccagtacgccaccgctcacgatctgtgggagcagcacaaggaattcgttgccaaggaactcgagaacgccgaggcttccgcagccgaagacggccaggctccgaaggaagagaaggtcgaagaggtgtccaactactcctccgacaacacctccaacggcaccctcgccgattccgaccagctcgccgctctgcgcgaccagctgctcggcaagtgagtttcgacgaatcaaaataaactgattcgcgtaaaccgctgataaatggccccgcacctgatggtgtggggccatttgcgtatgttgcgagtcctcaaacattacaatggcggttgtgatgattcgaattgggttgaccggaggcatcgccgccggcaaaagcaccgtcgctacgcatctgcgtgaactggacgcgacgcttgtcgattatgatgtgctcgcccgaaaagtcgtggaacccggaagcgtgggcctgcaacgaatcgtggaacatttcgggccggatgcgatgaacgcgcaaggtggtcttaatcggcgatggatgtccgaacacgtcttctccgatccgaatgccgaatccgaacgtagaatccttgacgatatcgaacatccgttgatctacgatcttgcattgtcggaggaacggcaggcggtcgaaaagaatccggatgccgtggtcgtacatgatattccgcttttggcggaagtaatcgatgacatacccatgcgtttcgaccatatcgtaacagtcgaagcaccggaacagacgcgtgtggaacgtatgatgcgcacccgtggcatgagtgaggcacaggcgaaggcgcgtatcgcgcatcagcccacgcgtgcggcacgagaatccatagccgatgcggtgattgactcatcccaggatgtagaacacatgttcgactgtgttgataggctgatggaacagtggcgtaaggaagcgagacggaaccatgggattcaacattgaacgagtgaacaagccgtttgtggtcaaatctccatataagccttcaggcgaccagccgaaggccatcgaggagctggccacgcgcatcgagaatggcgagaacgacgtggtgctcatgggcgccaccggcaccggcaaaaccgccactacagcgtggctgatcgaacgtctgcagcgaccgacgcttatcatcgagccgaacaagacgctcgccgcgcagttgtgcgccgaattccgcgaactcatgccggacaatgcggtgagctacttcgtttcctactacgactactaccagccggaagcgtacattccccagaccgacacctacatcgagaaggattccaacatcaacgacgatgtggagcgattgcgccacgccgccaccgcgaaccttctgacccgtcgcgattgcgtggtcgtggccaccgtctcctgcatctacggtttgggaacgccggaagaatacgctggccgtatgctgttcctccaggaaggccagcagatcgaccgtgacgatttactgcgcaaattcgtggacatgcaatacaagcgcaacgacatcgccttcacgcgaggcacattccgcgtgcgcggcgacaccgttgagatcatccccgtatacgaggaactggccatccgcatcgaattcttcggcgacgaaatcgaccgcatctccacgctgcatccgctgaccggcgacgtgatcgcgcacgaatcgcaggtgcacatcttcccggcctcgcattacgttgccggaccggaacgtatggaacgggcgctcaaaaccatccaacaggaacttgacgagcgtaccgccgaattgcataagcaaggcaaggaacttgaagcgcagcgtctcaccatgcgcaccacatacgatctggaaatgctctcgcaggtcggcacatgctccggcgtggagaactattcgcggcatttcgacggacgcgcgccgggcacgcctccgcacacgctgcttgactttttccccgatgatttcctgctcgtcatcgacgaatcacatgtcaccgtgccgcagatcggtgccatgtacgaaggcgacgcgagccgcaaacgcacgctggtcgaacacggtttccgcctgccgtcggcaatggacaatcgaccgctcaaatggccggagttccaggaacgcgtcggtcagacggtgtacctgtcggcaacgcccggcgattacgaactcggtttgagcgacggcgtggtcgaacagatcatacgtccgaccggactagtcgatccgcagatcgacgtgcggccggtggaagggcagatcgatgacctgcttgccgaaatcaaagaccgcgtggcaaggaacgaacgtgcgctggtcaccacgctcactaagaaaatggccgaggatctgaccgactatctgctggaacgcggcatcaaagtcgaatatctgcattccgatgtggacaccttgcgtcgtgtcgaactgctgcgtgaactgcgtgaaggcaagatcgacgtcatcgtcggcatcaacctgctacgagagggcctcgatctgccggaagtgtcattggtcgcaatcctcgacgcggataaggaaggcttcctgcgttcctaccgttcgctcatccagaccatcggccgtgcggcgcgaaacgtgtccggcaccgtcgtcatgtatgcggacgacatcaccgaagccatgcgcaaggccatcgacgagaccaaccgccgccgtgacatccagatcgcctacaataaggaacatggcatcgatccgaagccgctcatcaagaagatctccgatgtcaacgacatgctcgccaaggaggacgtcgacacccagacattgctcggtaccggataccgaaacgcggacaaagccggcaattcgcatctcggcgtgccacataccagcaaggaggaatccggcaggcggcacgaggagattctcaaggccggattgcccgcacaggatctagctgatctcattcgacaactgtccgagcagatgcataccgccgcagaacaactgcaattcgagcttgcggctcgtctgcgtgacgagatccgtgacctgaaaaaggaacttcggcagatgacggaggcgagcaaatagttctcgaccggtcatacggcatccgtaccatagtggattatggctgaaacaccacttgtttttgaaatcgccacgtttgcggtgcttgccgtcttcttcgtggtggacctgttcatcatcgggcgcaagccgcatgtgccctccaccaaggaatgcgtgcagcatatcgcgttcttcgtggtcatggcgttgatcttcggcggactcatgtggttcttcgccggctcgaagcctgccatcgagttctactcaggttggctgaccgaatattcgctgagcatagacaacctgttcgtgtttgtcattatcatgtcgaatttcgcggtgccgaaggaactacagaaattcgtgctgtcagtcggcatcaccgtcgcgctcgtactgcgaggcatgttcattttggtgggcgctgccatcatctcgcgcttcacttgggtgttcttcctattcggcgcgttcctcatcgtcacggccatcaaactcgtcgccgggggagacgaggacgaggaataccatgagaacgcgttgattcacgcactgcgcaaggtcatcaagatcaccgatgaatacgacggcgaaaagctgcgtactatcaagaacggtgtgaagcattggaccccgatgctcatcgtgttcctgaccatcggcaccaccgacgtgatgttcgctttcgattcgatccccgccattttcggcctgaccaaagatccgttcatcgtgttcacgtccaacgtgttcgcattgctcggtctgcagcagctgtacttcctgctcggagagctgcttgacaagctcgtctatcttccgctgggcctgtccgtggtgctgggcttcatcggcgtcaaactcatcatggaggccctgcatggcaattcgctgccgttcctcaatggcggccagccgatttcctgggttccggaagtgcccacatggctgtcgcttgtcgtgatcgttcttgcgattggtggtgcggctttggcaagtgttattaagatgcgcaccatgaaagcgaacgaaaagtgacagtccggcaaacgttgggagaatagagcttttctattctcctacgaaattgtgagcgctcacaacacacctagttctgaggtggaagtgggcgctttttgctagtaagctatgccattggaaacagggtcgtcagatccaaaatcaatatcaacaagaataggcaggcattcatgcgtaaagccaagatcgtagataccatcggtcccgctaccgagtccctggaaggcatcaccagccttgtcgaagcaggtatggacgtcgctcgtctgaaccgctcccacggcactccggaagaccacctcaaggtctacaacaacctccgtgccgccgccaaggccactggccgcaacgtcgcagccctggttgacctgcagggtccgaagatccgctgcggttggttcaagaagaacgccgacggcgaggacaaggtccagctgaccgaaggccaggagttcgtcatcaccactgatgacatcgaaggcgacgagcacatcacctccaccaccttcaagggtctcccgggcgactgccatgcaggcgatccgatcctcatcgacgacggcaaggtccgcctcgaggtcaccaaggtcgaaggcaacaacgtgtacaccaaggttgtcgttgccggaccggtctccagccacaagggcatcaaccttccgggcgtcgccgtgtctctgccggctctgaccgagaaggacgaagaggatctgcgctgggccatccgcaccggcgccgacatcattgccatgtccttcgtgcgcttcgccaccgacatcgatcgcgcccatgagatcatggacgaggaaggccgccgtatcccggtcgtcgccaagatcgagaagccgcaggccctcgagaacctcgaggagatcgtcaaggcgttcgacggcatcatggtcgcacgtggcgatatggccgtcgagtgcccgctggaagaggtcccgctggccaccaagcgctgcatcgagctggctcgtcagtacgccaagccggtcatcgtggccaccgaagtcctcggctccatggtcagctccccggtcccgacccgtgcagaggcatccgactgcgccaacgccgtcctcgacggtgccgacgccaccatgacctccaacgagaccgccgtcggcaagtacccggcagtcaccgtgaacaccatgagccgcatctccaccttcgccaccgagcatggtttcgaccgcatcccggagctgaagaacctggatatgtcctccacaggtgccgtctcttccgccgccgtcgacctggccgacaagctcaacgccaaggccatcgtcgcctacacccagaccggttccaccgtgcaccgcgtgtcccgtgaacgtccggccaccccgatctacggcatcaccaacaatgagcacaccttccactggctggccctgtcttggggcaccgagtccttcctggtcgacgaggattaccatgacaagtcccgcaaggacctcatggttttcaccgacaaggtcctcaaggacgccggcaaggtctccgatggcgacaagatcgtcgtgctgagctccgcccagggcgaacaccagccgggtcgcaccgattccatctacgtccacaccgttggtgcctgcgactgagatttgaatcgtcgcgttaaacgctgattccataatcctcccattggttcccgatgggaggattattgtttttacgcgatgtccccgaatgatgacaacgccgagatttggcgcaaatcgcaatcatgtggtattcttccagagttgcgtgcaagccctcgtatcccaattggtagaggaagcagcctcaaaatctgcgcagtgtgggttcgagtcccaccgagggcacgtaagaaatcaatatcaatccaggcccgggttggggcatgttaggccggctttgggtgtgacagtggaaagagaccgacatggctgcagagaagaccacggaaccggacgaagtactcactgatgaggagctccaagctgctgcggctcccgagccggattctgccaataataacgaggcgcacaagcgcaccgtcgtcgttgccgaagacgaatccgtgaaccgcatggatttggtcgccatgcttgaggataacggctatgaggtcgtcggagaggccgccaacggtgaggaagccgttgaactgacccgtaagttccgcccgagcgtggtgtgcatggatgtcaagatgcctcgcatggatggcatcgaggccgctggcatcatctgtgatgagaacatcgctccggtcgtcatgctgacggcattctcccagtctgatttggtcaaaaaggccacgggcgctggcgccatggcgtatgtcaccaagccgtatgaggaatccaagctgctgccggctttggaagtcgccatgggccgtttcgccgaaatcaacgatctgcttgacaatgtcgaacgtagcgagtccaaactgcaggaaaccgaggaacagctgaagaaggccgaagagcagctgaagaaggccgaagaaacgctggaggagcgcaagctcgtcgaccgcgccaagggcctgctgatggacaaggcggacttctccgaacagggcgctttccgttggattcagaagacctccatggaccagcgcattccgaagaagcgtctggccatggccatcatcgccaagtatggcgaacagaagtcggaagcagaggatgagcgctaacacaccaactgtggaaggcacttcacgcggaacgctattggtcgttgacggccattctttggcgttccgcgctttttttgccttacccgtagagaatttcagtacatcatcaggtcaggccaccaacgcggtctggggattcgccaccatgctttcgcaggtgatcgatgccgaacatccagaccatcttgccgtcgcattcgatgtgaagggcggcacgttccgcaaccagatgctgccgcagtacaaaggaactcgcgacgcggcccccgaggaactgctcagccagctgccattaatccagcagatgctgacggccttgggcgtcacatacatcgaaaaacccggttacgaaggtgacgatgtgatcggcacgctcgccagcatgggcgaccaggcaggctaccgcacattggtgctgtccggcgaccgtgatgctttccagctgatcaacgacgacatcaccgtgctgtatcccggccaccatttcaaagacctcaaacatatgaccccggatgccgtgcaggagaaatatcatgtctctcccgcgcaatacccggatctggccgccttgcgcggagaaaccgctgacaacatccccggcgttcccggagtcggcgacggattcgcggccaaatggatcaaccagtacggcggacttgagcagatcatcgaacacgccgacgagatcagcggcaaaaaaggcgaagccctgcgcgaaaacatcgaacaggtcaaactgaaccgttccgtgaacgctttggttcgtgaccttgatcttggcgtgtcggtatccgacctgacatttggacaagtcgacgctggtcaactcgacgatctattcaccaagctcgaattcggtgttcggaccaagaatcgcgtgctcaaaacgttcaatgcggacaaaccatccggggacgtgcacgaatccagcaagctcgggctgccacatgtcgaagacgtcaacgatccgcatgtggtggagacatgggtccaaaaccatttccccgtggtgcaggaacatctgcacgaacgccatgaacgctcctccaacgacattccggaattcggcttcgaaatcgattcttcgacccgctgcacggacaaggtgaaacagtcctggacgctttacgccgaaggcacgagcaaacccggagaagcctctctttcggcattgatgatcgccgtgcacggcgaagccattcgcatcgacgtattcagtccggatatggtgcaatgcctgcaaaggctgttcgaccgctatcaccattccatggtcgtgcacggttacaaagaacatgcgcatctgctgggcagcatcggcgtggaacttccggaaccattgttcgacaccaagctcgccggatatcttgcccacccggatttccacgcggacacgctggaacaggctgcggcccatttccttgatctgcacatcgaagcacaagccgaagccgcgacacaggggaccttggacttcgacgagcctgaggaaaacgattccaagaacgacgagctgatactcacccgcaccgcaatcgtggggcttttggccgaatatttggccggtgtgctggataagcgcgaacaattcggtctcctcaaatccattgagcttccggtctctcaggtcctgcatggcatggaacaggtcggcgcccaagtggatatgacacgtctggtgcagatgcgcgaccaacttgccgccgacgctgcccaggcacaggaaacggcgtggcagttcgcgggggagcaggtgaacctgcaaagccccaaacagctgcagaagatcctgttcgaagacatgggattgaaaccgacgaaaaaaaccaagtccggttcatacaccaccaatgccgcggcattgcagaccttgcgtgaccgctcgtacgataacgaccgcgcatgccagttccttgacgcgttgctgatgcatcgtgaaaagaacaagctcaagcagatcgtgcagacgttgatcgacgccacaaaccgtcatgacggtcgcatccacaccactttcgaacagacggtggcagccaccggacgattgagctccgtcgatccaaacctgcagaacattccgaaccgggatcccgcaggtcgtgagattcgatccgcgttcgtgccgggagagggcttcgaatcgttgctgagctccgactactcgcaggtcgaactgcgcatcatggccgacctttccggtgatgaggcgttgatagaggccttccgctccggcaaggacttccataagtatgtggccagcttggtctacggcattcccgttgacgacatcacgtccgatcagcgtagccacgtcaaggcgatgagctatggacttgcctacggtctgagcacgtatggacttgcccagcagctcaagatcaagcccaaagaagccgaatcgctgaaaaaccagtatttcgccacttttggcaaagtccatgaataccttgaatcgcttgtctcgtccgcacgcgaaaaaggatataccgaaaccattttcggaaggcgcaggtatttccccggtctcaaatcgccgaaccgtgccgtgagggacgcggccgaacgcgccgcgttgaacgcgcctatccaaggctcggcggcggacatcatgaaaatcgccatgattcgtgcgtatgacgcactgcaggaagcgaaccttggaagtcgcctcatactgcagattcatgatgaacttgtggtggagatcgcgcccggtgaggagaagcaggccaccgcgctggtgaaggatgccatggagcatgccgtcaccatggccgttccgttggacgtatcgacgggcatcggttccgattggcaattggcggcccactgatccgttcccgtcggataatcgaaggctgattaaaaaagaaagaaggaagattgtggcaacgctgaagcaggtcgtggatgtgcttgaaacgctgtatccgctgcgatacgcggaacaatgggatgagccgggactcatcgtgggagaccttcgccacgacgtgcgcaacatcgcgttcgcggcggacccatccatggcggtgatcgaccaggctatcgccggaggcatcgacctgctgatctgccaccatccgctgttcttccgttccgtgcatgcggtctccggactaggattccgtggtgagatcgtccggaagctcaacctcgccggttgcgcgctgtgggttgggcacaccaatgccgatgcctcctaccgaggagtcagcatggccgccgccgacgcgttcggcctgatcgaacagcgtccgctggtacccatcgaagatccgaaagccgaacatccggtcggattgggccgtgtcggccggttgcaggagccgatcgcattgcgtgatttcgcccgtcgtgtggccgacgcgctgccatacaccgaacttggcgtgcaggtgtgcggcgaccttgacgcgacgatcggcacggtggcggtattgccgggctcgggcgattccctgttcgatgaagtgcgtgccgcaggcgtcgatgtgtatgtgaccagcgatctgcgccatcatccggtgaccgatgccatcgagcaggcgcgctatgaggcgtccatgcgtgccgcggacatcgaactcggccgaggcgacgccactgttcgtccgatgttcatcaacacgccacacagcgccatcgaatccatatggttccaatacgccatgggcgatgtgcctcgtgccgtatctgaggcgaccggagacatccccaccgtccgctggatttccatgaacaccgatccctggaatctggtactgccgtcctgcgggcaggaacgctgaacgacgatgtccgatacgaccagcatggatatgtcgctgaacgaatccagcgatggcgtggacatgaccagaccggccacagtactcagcagagagcacgtgtatcaaggcgcgattttcggcgtggaggacatgcgtatcgcgttgcagacacgagacggcggacaaaccgtgatccgcagacaggtgatgcggcacgcgccctgtgtggtcatgctggtgcatgactgcgcgcaggatttgtacttggtcgaacgagaataccgtgtcggctgcgacgccttcgcctacggtctgccggcaggactcatcgatgacggggaagacgtcgatgcggccgcattgcgtgagctgcgcgaagagaccggcgtcgagccaatcgacgaaaacagttgcgatatcgaccatgtcgggcaattctattcatccgaaggcatgaccgacgaactggccaacatcatggtggtgcacctgcgccactggcaggccgtcgaacggcatttcgacgccgacgagcatgtcgaatctgcttggatcccgtggaagcagctacgagacacgcacatcacggcctccaattcggagatcgccattttgcatgagcaaattcgcagaatgcggcaacaatagcggcctgcaggtttcgaattgtaaaaacaatcgccggaataaacgaaataacgaattcaactcgcaaaacgtgcgatacttgaattatgcaaatcagacctggatcgatgtatccactcggtgcgagctacgacggcgccggcgtgaatttcgccctcttctctcaagtggcccagaaagtcgagctttgtcttttcgatgaggaagaccgtgagacccgagtggaaatgacggagcagaactcctacgtatggcataactatctgccgggaatacaacccgggcaacggtacggctatcgtgtgtacggtccgtatgatccagcaaagggcctgcggtgcaacccgaacaagttgctgctcgacccgtacgcaaaagccatcgagggaaacatcgacggtgacgaaagcctctattcgtattggttcaaaagccctgaggacgtcaccagcatgaatacgctggattccgcgccgcataccatgaaatcggccgtggtcaatccgtatttcgactggggcaacgaccaacatccgaacatctcctaccatgattcggtaatctacgaagcccatgtgcgtggcatgaccaatctcaacctggacgtgccgccggacatccgtggaacctacgcgggcctcgcatatccatcggtcatcgaatatctgaggaagctcggcgtcaccgccatcgaacttatgccgatccaccagttcgtcaacgacagcttcctgcaggaaaaaggcctgagcaactactggggctacaacaccatcggcttcttcgcgcctcataacgcgtactcaagctccggacaacgcggcgagcaggtcaacgaattcaaatccatggtcaaggcctaccatcgcgccggcatggaagtgatcctcgacgtggtgtacaaccacaccgccgaaggcaacaacctcggcccgaccctaagcttcaaaggcatcgacaacggtgcctactaccgtctggtcgacaacgaccgacgccactacttcgacacgaccggcaccggcaactccctgctgatgcgctcgccgcacgcgctgcagctcatcacggacagcctgcgctactgggtcaccgaaatgcatgtcgatggtttccgattcgatcttgcggccacgctggcccgccagttccaggaagtcgacaagctgtccgccttcttcgacatcgtcgaacaggatccggtcatctcccgtgtcaagctcatcgccgaaccttgggatttgggttccggcggctatcaggtgggcggcttcccgtccagctggtccgaatggaacggccgctaccgtgattgcgtgcgtgacttctggcgttcgcaaccatcgacgctaccggaattcgccagccgtctgatgggcagctccgacctgtatcagatgaacggccgccgtccggtggcttccgtgaacttcatcaccgcacatgatggcttcaccatgaacgatttggtgagctacaacgagaagcataacgacgccaacggcgaaggcaatagggatggcgaaagcaacaaccgttcctggaactgcggtgtcgaaggcccgaccaccatcaaggacgtcaacgacctgcggcaacagcagatgcgcaacatgttcgcgacgctgctgtgcagtcagggcattccgatgatctgcggcggcgatgaggtggcacgcacgcaacagggcaacaacaatgcctattgccaggacaacgccatttcatggaccaattgggatcttgacgatagtcagaaggatctgcttgagttcgtttcgaagctgattcatctgcgactcgagcacccggtgctccaccgtcgtcgtttcttcaccggccgcgagccaggagacccggacgataagattccgcaggtcgaatggatggaccacaccggttccatcatggacatggaagattggtccaatacccacgcgttctcggtgatgatctatctgaacggttccgatattccggaagccgactggtatggcaaccagatggtggacaataacttcatcctgattttcaacgcgcattacgagccgattatgttcaccttgccggacgagcggtatggcaagaaatggcgtctggtcgtcgacacgcataatccgaagggtccggaactcaactatgaggccggcttcgcgatcacggcgcagtcgagaagcttcctgttgctgatgagcgatagaaagcccaccacaaagaactacgatttctgatagccatgagaacaggcgaggtgccatccgtacgggtgacacctcgccgtattgtttgtggactgtgctcgtgaaccgttacgagaattagacttccgacgagagtcgggaaacggttccaggaacggtttcgctgacctccgcaagatcctcgacggattctggccgcttggtttgcgccagaataagctgcgtctgcacacgatcggattcgatggccgcaatctgccgtgaaaagatgatgaaccagcccagaaacatcatgccggcaagagcctcgacgttcgtcaacgtgttacgccccgccaaccactggaacccggcaagagccccgatcacgatagctaggtctgaaatcacatatactacttttgaaagctgcggggccagccaaggcagcgcgatcatcagcacgctcatcaggcagggaagaccgcgggcgaatacgttgtgcagaatcggatgcggcgtgtaacggaacatgccgatgccgatgaaggcgatgcctgcgagcgtcagcatggtcgatagcagaagaatccgcgccttgaagtgtttgggagcttctttttcatcgcttgcagacagatactgcatctgcagacggtgcgtggtgatgagctccgaaatcgcgaaatagctgatgatgacgatgcagacgccggccaacatcaatgtcgaattgaacatacgagcagcaaaagtggttcgatcgcccaattgggagaaattgttgttgtaccagtatggatcatcggacgtcaatcctgcgatgctgacaccggaaaccacgaagaacggcaacaaggatgcgatggtcttggcattcatgagttccgcctgtacgaacgtgacatagcctacgacccccgagatcgcggcgcagagcgcagtcagatagccttttaacgtgcgcaaccccatcatgttgctggcaatggaaagcagcatgaacgccgtgacgaaaatggtcgacgcgtagaccacggacaaagcgagtatctcgaagatacggcgaataggaatggtccagccatgtttcaacgtcattgacctggagttgcgcgcataccccaaggtgaacgagatgactccacatcccgcggtgattccggcacacacggtgaacaggcgttgggtgacacgccagatggcgggagcgaattgcagatataggtccatggcgatccatgcaagagtggcgcatgccatgaaggaaatgatgcctgaagcctcggcttgctgatgacgtcccatgcgcgttccctccagtatttgccattctagcctgtcgttgtcctaccatacgctacaatggaaactcgtgttcacctgccacgtgcgggagtgcatgaacgggctgtagcgcagtttggtagcgcgtctgctttgggagcaggatgtcgcaggttcaaatcctgtcagcccgacaacgaaagtaatgtcctccgcaatcggatagattgcggaggacatttagttatatacgcgatcgcatcagtcctgaatgacggtgccgacaatgccggagacgatggccataatcagcgatccgattacggaccaccagaatccatcgatggttactcccacgtcgaacaggcttatggccagccaagacgcaagctccatgaacagccagttgatgattaacgcgattagtccgaacgagagaatcgaaaatggcaatgcgatggtgtgcacgatcggtttgatcgacgcgttgatcaacgcaaggaacaacgcgaacgcgccgatgccgagaatgggtggttcgccaacggcgtgcatgccgggaagcagtgtgaccatgaccccggccgcaatggtcaaaaccaaccaacgtgaaatgaaatgctccatgacagcatcgtattacattgcgttgtcttatgaaaaaggaatgtatttgtggaacatgccaggaagacgacctatgcgagacgggcgcggcgttttccacatggtttggttaccatgaaccatatggaagcacttcatgagaacctgtggccggcaccgtatgccggcaaaccgttgaacgccactgtggtggtaccgggcagcaaatcactgtcgaaccgttatctcattctcgcggcgctcggacatcgacccgtgcgattggtcggtctattgcgttcacgtgacaccgagttgatgatggacgcgttgcgcgcgttgggagtgcgctgcgaaatcgacgagcaggttgacaccacggttacagtggtgccgccgtccgacggccggttccacggtggtacgaaggtgttctgcggtcttgcgggaacggtgatgcgctttgtgcccggtcttgccatgttcgcggacggtcctgtggctttcgacggtgacgagcaggcgtacgcgcgtccgatgaagccggtgttggacggtcttgaacagttgggggcatgtatcgaataccacggcgaggaaggtcgactgccatttacaatcactccacctcaaacggtgagccagtgcgctgagccgagcgtggtcagcattgattcttcgggatcctcgcagttcatttcaggactattgctcatcggctctcgagtgccaggcggtttggaactgcatcacacgggggagaagacgccgagtttgccgcatattcgcatgaccgtggccgatctgcatggttccggcgtgcgtgtcaacgcagacgaacacgctcgcgtgtggaccgtgcagccgggagccgtgcagttgcccgaaactgtgacggtcgaacctgacctgtcgaatgccgccccgttccttggcgcagcgctcatcgccggaggaaccgtgcgcgtacctcattggccggaatccactacgcaacccggaggcatgcttccgggatatttggaacgtatgggagccgagatcagcttcccggtgattgacgacgtccggtactgcgaagtgaccggcaacggtcatgtcagcggcctaggtgatttcgacttgacggcggcaggtgagatcgcgccgtcgcttgcagcgattctggtttttgcggacaagcctacccgcatgatcggcatcggtcatttacgagggcatgagacgaaccgtctggaggctttggccaacgagattacgcgcgttgggggagctgcccacgaactgcccgatggattggagataacccctgtgtcggcgaatcgtcttagaccatccgtgatggagacttatgccgatcatcgtatggccacattcgcggcgatgcttggcctacgcatcaaaggcatccaagtgaagaacgtcgccacgacggcgaaaaccctaccgaatttcgtggatctgtggaatgacatgcttgtttgacggatatgcaaaagtgacgtcgggggacgttcggtccgtctgacgagagcggacttgtttccgtaacataacggaagtggctttccacaagaatagtttgtggaaagccccttccgctatgcgtcaagcctgcgggctcactcccattcgatggttgccggcggcttggaagtgcagtcaagcaccacgcggttgatctgacggcattcgttggtaatacgcgtcgagatggtggcgagcacgtcgtacgggatacgcgaccagtcggcggtcatggcgtcttcggacgacaccggacgcaacacgatcggcgagccgtaggtgcgttcgtcaccctgcacgcccacggaatgcacgtcggcaagcagcacgaccgggcactgccagatgtcgcggtcgaggccggccttggaaagctcctcacgtgcgatggcatcagcttcgcgcaacaggtcaagacgttccttggtgatttcgccgatgatgcggatgccgagacccggacccgggaatggctgacgccagacaatctcatccggcagaccgagttcggtgccaatggcgcgcacctcatccttgaacagggtgcgcagcggctcgatgagctggaatttgatgtccttcggcaggccgcccacattgtggtgcgatttgatgttggccgcgccatcgccgccgccggactctacgacgtccggatacagcgtgccctgcacgaggaatttgacttccttgccggaggcaccggcctcttcgatgacctgacgctgcgccttctcaaaagtgcggatgaacttctctccgatgatcttgcgcttcttctccggctcgctcacgcccttcaatgcggtgaggaagtcttcggaggcgtccacggcgatgagcttgatgccggtggcctcgacgaaatcatgtttgacctgctcggcttcgcccttgcgcagcagaccgtggtccacgaacacgcaggtgagctgctcgccgatggccttatgcaccagagccgccgcgacggcggagtcgacgccgccggacaggccgcaaatcacctgggcgtcgccgaccttctcgcggattttcttgacctggtcctcgatgatgttggacgcgttccagttatcgccgaggccggcgcacttgtgcaggaagttctcgatgagcttctggcccatcggagtgtgcttgacttccggatgccactgcacgccgtacagtttgcgggactcgtcctgcatggcggcgaccggtgcgccttcggtgtgggcgagcacttcgaagccttccggcgcggtcttgacggccacgccatggctcatccacgtgctttgctctgcgggagagccgtcgagcagaccctccgccttgtcaatggtggtttccgttttgccgtattcgcccagggcggccttgtcgacatccgcgcccaacgcgtatgccatggcttggaagccgtagcagatgccgagcaccggaacgcccgcgtcgaacagcttcttgtcgacgcgcggagcgcccggttcgaacacggaagcggggccaccggacaggatgatggcctgcggatccttggccagcatctcatcgaccggcatggaatgcggcacgagctccgaataaacattggcctcacgcacgcgacgtgcgatcagctgggcgtactgggctccgaaatcgacaacgagcacaggacctgcagccataacactctccctttaatatgaggtatcaagaaacggacaatactaactgctctattgtgacgttgcaaggagacattggaaacacgtgaacggagaatgaacgaatctcacaattgcttactcccacctactcaacacgccgcgtgtgtatctagggaaacgaacgtgggaaacatatgttaaccgactaaaaacgttgattttgagccgtttttcaatctttttgatagagtgtgaagtacgcacaaaaatcccgataaaagcacacatttgcgtacagaaaaataacaattgaacacacagtcgcaaaaaaacagcaaaaagtcgaaccgcgctcgtaatatgtgcaagtgactggaaatgaggcataccgcgtaaccgcaaggttttaggcatggctcatgacctaaggaaataaacaatcgcacatcacagtgcaggagtacaggagtacacatgacgagtcctgttattggcaccccttggaagaagctgaacgctccggtttccgaggaagctatcgaaggcgtggataagtactggcgcgcagccaactacctctccatcggccagatctatctgcgtagcaacccgctgatgaaggagcctttcacccgcgaagacgtcaagcaccgtctggtcggtcactggggcaccaccccgggcctgaacttcctcatcggccacatcaaccgtctcattgctgatcaccagcagaacactgtgatcatcatgggcccgggccacggcggcccggctggtaccgctcagtcctacctggacggcacctacaccgagtacttcccgaacatcaccaaggatgaggctggtctgcagaagttcttccgccagttctcctacccgggcggcatcccgtcccactacgctccggagaccccgggctccatccacgaaggcggcgagctgggttacgccctgtcccacgcctacggcgctgtgatgaacaacccgagcctgttcgtcccggccatcgtcggcgacggcgaagctgagaccggcccgctggccaccggctggcagtccaacaagctcatcaacccgcgcaccgacggtatcgtgctgccgatcctgcacctcaacggctacaagatcgccaacccgaccatcctgtcccgcatctccgacgaagagctccacgagttcttccacggcatgggctatgagccgtacgagttcgtcgctggcttcgacaacgaggatcacctgtcgatccaccgtcgtttcgccgagctgttcgagaccgtcttcgacgagatctgcgacatcaaggccgccgctcagaccgacgacatgactcgtccgttctacccgatgatcatcttccgtaccccgaagggctggacctgcccgaagttcatcgacggcaagaagaccgagggctcctggcgttcccaccaggtgccgctggcttccgcccgcgataccgaggcccacttcgaggtcctcaagaactggctcgagtcctacaagccggaagagctgttcgacgagaacggcgccgtgaagccggaagtcaccgccttcatgccgaccggcgaactgcgcatcggtgagaacccgaacgccaacggtggccgcatccgcgaagagctgaagctgccgaagctggaagactacgaggtcaaggaagtcgccgagtacggccacggctggggccagctcgaggccacccgtcgtctgggcgtctacacccgcgacatcatcaagaacaacccggactccttccgtatcttcggaccggatgagaccgcttccaaccgtctgcaggccgcttacgacgtcaccaacaagcagtgggacgccggctacctgtccgctcaggtcgacgagcacatggctgtcaccggccaggtcaccgagcagctttccgagcaccagatggaaggcttcctcgagggctacctgctgaccggccgtcacggcatctggagctcctatgagtccttcgtgcacgtgatcgactccatgctgaaccagcacgccaagtggctcgaggctaccgtccgcgagattccgtggcgcaagccgatctcctccatgaacctgctcgtctcctcccacgtgtggcgtcaggatcacaacggcttctcccaccaggatccgggtgtcacctccgtcctgctgaacaagtgcttcaacaacgatcacgtgatcggcatctacttcccggtggattccaacatgctgctcgctgtggctgagaagtgctacaagtccaccaacaagatcaacgccatcatcgccggcaagcagccggccgccacctggctgaccctggacgaagctcgcgccgagctcgagaagggtgctgccgagtggaagtgggcttccaacgtgaagtccaacgatgaggctcagatcgtgctcgccgccaccggtgatgttccgactcaggaaatcatggccgctgccgacaagctggacgccatgggcatcaagttcaaggtcgtcaacgtggttgacctggtcaagctgcagtccgccaaggagaacaacgaggccctctccgatgaggagttcgctgagctgttcaccgaggacaagccggtcctgttcgcttaccactcctatgcccgcgacgtgcgtggtctgatctacgatcgcccgaaccacgacaacttcaacgttcacggctacgaggagcagggctccaccaccaccccgtacgacatggttcgcgtgaacaacatcgatcgctacgagctccaggctgaagctctgcgcatgatcgacgctgacaagtacgccgacaagatcaacgagctcgaggccttccgtcaggaagccttccagttcgctgtcgacaacggctacgatcacccggattacaccgactgggtctactccggtgtcaacaccaacaagcagggtgctgtctccgctaccgccgcaaccgctggcgataacgagtgagcctaggcttatttggcctgattgcttgataaaagccccaagggattgttcccttggggctttttcgtattacggtgcgatatgcttggcttaaaacagcaaaaccgctagcgcgtgtcagttaccgtttgcacattacaattgctcattgtgcgaacgatgtggtatcgcacccgaataatgtgaagtacataggagacaccgtgagttttaccagcgtcaccatcatcagtcccgaagcggctaacggccgtaatgttgtcgcccttggagtcaccaaggcacttgccgcagccggcaagaccggagtgttccgtccggcggtctgcagaaaagacaccttcacggacgtgctgatcgaagcttccaatgccggtttgagccgggaacagtccgtcggcgtgtgccccaagcgcgctcgtaacgataaggaaggttcgcgggcggatatcgttgcggcctacacccaagccgtagaaacagcccgaccggatgccatggtgattgtcggcaccgacaggtcagcagtcaatgatcccgcgatgttctctttcaacgctgacttcgcggcagacctccaatcgccggtcctgctggccgtatgcactatcgaacgcacaccggaacaagtcaaaagcacggttgaggcatccaccaaggtcatcgaagacgccgggagcaaagtcgtcggcgtgttcattactgggtgtgacgacacgcagccggatccgctcaaagcatgcttcgtcgactacccggtgccggtgtggacgctacctgccgtcgatttcaatgacgatgacgccatcagcaaggcagacgaagcgttcgcgacgaacgtcgacgccgcggaactgaccgcggtactcgaatcgccattcgacgccccgaccacaccctatgctttccaatacggtctgctgggcaaggcgaaggcggacaagaagaccatcgtgctgccggagggcaacgaggatcgcatcatcaaagccgccgattatctgctggaacgcgacatcgtcgatctgatcatcgtcggagacgaaaacgccattctcgcccgtggtcaggaattgggattgaaatcgcttggcaaggcgaaattccaagccaaggatgatgaaacggtgttggaacccatggtggcgaagctgtgcgagctgcgcgccaagaaaggcatgaccgaagagcaggcgcgcaaacagctggccgatgacagctatttcggcaccatgcttgtggtgatgggcatggcggacggcctcgtgtccggttccgtcaactccacggccaataccgtgcgtccggccctgcaggtcatcaagaccaagccaggaacatcgttggtatccggagcgttcctgatgtgtttcaaggaccatgtcgccgtgttcgccgactgtgccatcaaccttaaccccaatgccgagcagctcgccgaaatcgcgatccaatccgccgaaacggccaaggcgttcggccttgaaccgaaggtgggcatgctgtcctattccacgctgggctccggaaaaggacccgacgtcgacctcgtcgaggaagccaccaccatcgtcaaagacaaggctcccgaccttgcggtggtcggatcgatccagttcgacgcggcatggtctccgaccgtggccgcgaccaaagccaagggcgatccggtggcgggccatgtcaatgtgttcgtattcccggatctgtgcgcgggcaacatcgcatacaaggcggtacagcgttcctcgggagcggccgccgtcgggccggtgctgcagggtctcaaccgcccggtgaacgatctgagccgtggcgccacggtccaggacatcatcaacaccatcgccctgaccgccatcgaagcccagtaatcgggcattttgtagcaagcaacgagtaatctaaggttttggaaagtcgcgtaagcggcacatcgattaacacatggaggatgcccacaatggcgaaaaccgtccttgtcatcaattccggttccagctctatcaagtatcagctggttgatcttgaaaccggcgaaggtatcgcttccggtctggtcgagaagatcggcgagccggttgacggtcattacaagcacgagtacaacggcgagaagcatgagctcgaagagccgattcacgaccatgagcagggtctgaagcgcgtgctcggcttcttcgacgagttcggcccgaagctcgccgacgcaggcatcgtggccgtcggccatcgcgtggtgcagggtggttccattttcccgaagccggctctggtcaacgacaagaccatcggccaggtcaaggacctcgccgtgctcgccccgctgcacaacggtccggaggccaagggcgctgaggtcatgcgctccctgctgccggatgttccgcagatcttcgtgttcgattcctccttcttcttccagctgccgaaggcttccagcacctacgcgctgaacaaggaagtcgcccagcagtaccacatccgccgttacggcgcccatggcacctcccacgagttcatctcctccgtcgtgccgtccgtcatcggcaagccggccgaaggcctcaagcagatcgtgctgcacatcggcaacggtgcttccgcctccgccgaaatctccggcaagccggttgagacctccatgggtctgaccccgctggaaggcctcgtgatgggtggccgtaccggcgacatcgatccggccgtcgtcttccacctgattcgcaacgcccacatgagcgtggacgaactggacaccctgttcaacaagcgttccggcatgatgggtctgaccggcttcggcgacctgcgtgaagtgcatcgtctggtcgaagagggcaacgaggacgccaagctggctctcgacatctacgtgcaccgcatcgtcggctacatcggcaactacaccgctcagatgggtggcgtcgacgtgatcaccttcaccgcaggcgttggcgagaacgatgacgtcgtgcgcaagatggtctgcgacaagctcgctccgttcggcgtcaagctggatgaggagaagaacgcgacccgttccaaggaaccgcgcatcatctccaccccggattccgcagtcaccatctgcgtcatcccgaccaacgaggagctggccatcgcccgcaagtccgccgccatcgcagaagaaggcaaggactcctacggcaacgtcttctccaagtgagtgacgtgtcacgtttcggctggtagaggaacgtgacggcaaacggtatgaatctgcgccgccgtgcctgataatcgatatcatcggtcaatcaggcacggcggcgcagtgcgttgggcccccttttccgcgattcgcaagggattgcttggtagtacgatacgacaggttgcactgtaccgtgcaatgatgtaagagagaacggttggttattcgtggctgctaaacgacgtttcgtcggtttggacgggcttaaaggcatagcccttattgcgattgtgctgtatcactgcgatgagctttcgcttcaaggcgggtttttcggtgtggatgtgttcttcaccatctccggtttcctgattttctcatcgctgctcaatcgtatcgattcaggtaaaggcttggaactgggggagtacttcctcaaacggttccgccggatttatcccgcgctgtttgctcttatcccgatctcggcgacgttggcatggctggtgaaccgcgacatgcttgtcggcatccggaaccagatcatgaccgtgcttctgggatgctacaactggtatgccatcagcagcggagccagctatttctcccagatgaaccctgacatattccgtcacctatggttcatgtcgttgctcatgcagttttatctgatcgctccattcgtggttttgctgctgcgaaaaatcatcatcagatgggctccggtatgcatactgacagcccttgccggagcaagcgcggcatccatgggactgctataccactctggcgctgaccccacacgtgtgtatttcggcaccgacacgcacgccatgggcctatggctcggtgccgcgctggcttggatactgccgattctcagacatgagcatgggcgagccaatgaatcgcggataatggaacgattccataagatatggattcaattcggcccgatagttgcctttggctcattgctggcattgctgtggatgatgcggcatatcactcaaggcccagcggcgttccatggcggtatcttcgtcgcctccgtgcttgctgtggtgctgatcgcaggaaccataccattcggatcctggatgcaggatctgcttgtgttcaagccgcttgccgctttgggccattattcgtatggcatttatctgtggcattggccattatggctgctgctgagatccctgttgccccagtggggcgcatggcatgccgacaggctgctgtccttcaccttcatcctcaccgtgctgttcgcgttcgcatcttggcgactgttcgagaagccagtcgctcgtgcgggattcatcgcgttgattcgtccgatcagtggagacgaagccgagcattgcggccgtctgatatccacggtcgtggtgctggcatgctcatggagcttctgcggatacgctgtggcgacggcaccggaacaaaccagtgtggcgcaatccttgggtatcagttccaggctgttgcagcaacgcaatcatgccgctttggaacgacgcagaacaccgatgccaaggaagccacgacataagatgccggatggttcgcaaatggccgccatcggagattcggtgatgctggcgtccagcaaaggattgcaagacacgttccccaacatcattgtggatgccgaagtctcacggtcgatggcgaagggacagggtcttgtcgatcaattgaaagcgcaaggaaatctgcgcccctgggtcttggtgggacttgccaccaactccgtggtgaccaatgatcagcttgacgatctgctgaatgatgtcggccccgatcatgtgctggtgctcattaacgcgcacgctcccgtttcatgggttcccggcaccaatgccgtgttgaagcaattcgccgcggcgcattccaacaacgtcgtactggtcgattgggacgggaccatttcccagcatgctgacgaacttgccggagatggcatccatccgggaatgtccaatacgatctacgcgcaggcggtcaaggattcaatcgccgcttggatcaagcaagggcactgattgatgcgttgacgacttccatacgaggtccgccacatgccgtcgcatatgaatgatccccattccgtggaaatcggaatggggatcattcatatgcggacgatgccgatattagggaaatcaggcctcctgatgctgaggagcggacagaaagtgctcctcgctaggcagaacggcgttgagaatcacagccaccacgaacgacaccgcgatgcagttggaagcgaagatggactggaacagcgccgggaagttggcgaaaatgtcgccgacctgggtgaaaccgatgccaatggtcaggctcaacgcggcgatggtgatgttgcgctgcgtgtaaccggcctcggaaatcatctggaatccggacaggatgatattgccgaacatcatgatggtgcagccgccaagcacagcctgcggcagggagttgaagacctctgcaacggccggaacgaagctggcgagcaccaaaatcagaccgccggaaagaatcaccttgcggttgaccaccttggtcatcgccaccagaccgatgttctgcgcgaacgaagtcaatggcaggcagccgaacaaaccggacacggaggagatcaaaccgtcgccggcaatagctccggcggtttccttgtcggtgggttgacggtcgagaccgaccttggtaagcgccgctgtgtcgcccaacacctcaaccgaggaaacgacatacagcagagcgaaggagataatcgcgcccggatcaaactcaagcttgaacggcatgaaatgcggcaccgacacgacctgcagattggcgaaaccggagaaatcgacctttcccatgaaaatcgcgaccacatagcccacgacaaggccgaacagcacggaaagctgcttggcggtgcccttcatgagcagctggaacgcaaggcaagccaccagcgaaatcaggccaagcgtcagattctgccagctgccgaaatccttcgcgccggaaccgccgccgaagctcgtggcgccgacggacaggagcgaaaaaccaatcgaggtgacgacaatcgcggaaacgatcggcgggacgaaacgacgccaatacttggccgtcaaaccaagcacgacctccaacaggccgccaagcaccacggcgccggcgactgcgccataaccctgatgctgcgcgatcgacatggcggccgcgacgtaggtgaaggaaatgccggtgaccatcggcagacgggaaccaatcagccacacaccgtacagctgcaggcaggtgccgagacctgcgaccagcaggccggcctgaatgatggcggcggactgcgcggcatccatcttggcggccgtggccaccaggaagataggcgcgagattcgccacgaacatggccatgacgtgctgcaggccgaacggaatgcccttccagaacgacaccggtgcgtcaagactgctcaacgcctcaaaagacacgccttttttagtgtcttttgccttcgtctttttttcggttttctctgtgttcttctcttcgctcaactgttacatcctctcttataatcgtttgagcgtactgaaaaaatcaggagcggaattcgatggtgccgttttccggatccatcgattcgacgattgccagggaatcgacgtcgtacccttcctcacgcagctggtcgccaccgccttggaagcccttttccactgcgatgccgatgccttccacagtggctccggcctcatggcacagctcgatcaggccttttaacgccttgccgttggcaaggaaatcgtcgatcagcagcacgtggtcgccttcattgagatagcgcttggacacgatgacagggaactccttctgcttggtgaaggaatacacggtggtcgtgtactggtcgccgtcaagattgatggactgcgccttcttggcgaacaccaccgggacattgccgaaatgacgggccacgacacaggcgatgccaatgccggaagcctcaatggtcagaatcttatcgatggtcttgcccttgaaatgctcggcccaggcggcgcccatatggtcgaacagctcgacatcgcactgatggttgaggaacgcgtccactttcagcacattgccgggcttgacggtaccttgttgcgcaatgcgctcttcaagttccttcatgaaaccccttaatcttgtcggccgcgaaagcggcatcagatgatggcatacggcgagccgtatataggagttcagcatacgcgcctcaattgaccgtgcgagtcgtacccctgacctgctcatgtgataaacatgaatgctgcgaacaaatgtttgaatatgagcgtgcgcgaagaaaagaggaatcggtggaacagagcatgggacctgtgatgtgcgatccgcggagcctgatagagggactcaacccccaacaggaagaagcggtgaaatactacggccaggcattgctcatcggcgccggcgcaggctcaggcaagacccgtgtgctgacacgtcgcatcgcatggctgctggcgcatggcttctgggcaagcagcatcctcgccatcaccttcaccaacaaggcggccgcggaaatgcgtgaacgtctcgtgactttggtcgggccggaagccgaacatatgtggatctccaccttccactccgcctgcgtacgcatcctacgccgcgacggcaaggaaatcggccttaaatcgggcttctcgatttacgacaccgcggacagcgagcgactggtcaaactgatcgcagccgacctgaacatcgatacgaagcggtatacgccacgcatgctgctgggcaagatatccgactgcaagaacgcgttggttttctggaaagaccagctgaaaaaagcgaactgcgattacaccccgggacagcgcggataccaggtgagcgccggcgacgtcgacgaactggtcgccgtcgtctacgccgaataccagcatcgtctggcgctcgccaacgcagtcgacttcgacgatttgatcatgcgcaccgtggaattgctccaaacctgcccgcaggtgagcgaatactatcggcacaggttccgttacatcttcgtggacgagtatcaagacaccaaccatgcccaatatgtgctcgtacgtgaattgtccggcatcgattcggacgaacagcccgacccgcaggcgaggggagcgggccgtgtgggaccgagctggattaccgtggtgggtgattccgaccaatccatctacgcgttccgaggtgcggacatccgtaacatccaagacttcgaacaggatttcccgaacgccaaaaccatcatgctcgaacagaactaccgttcgacgcagaccatcctcgacgcggcgaacgcggtgatcgcgaaaaacgaaaaccgcaagccgaagaaactgtggacggcgcttggtcaaggcgacaaaatcgtcggctatgccgccgacaacgcacagcaggaagccggatggatagcgaacgaaatcgcacgaatccacaccgaggaagacgtcgcttaccgtgacatcgccatcatgtaccgagccaacgcgcagtcacgttcgctggaagaggccatgatcaacgccaatctgccgtatcagctggtcggcggcaccaaattctatgaacgtagggaagtcaaggacgccatcgcgtatttgcaggccatcgtgaatcccgcggataatgtgaacgtgcggcgtatcctcaatgtgcctaaacgaggactcggcgcacgcgcggagggattggtggccggctacgcggacgcgcatggcctcacgttcttcgaatccattgaacatatggaccagattgaaggcatgacaggccgtaccaccaaaccgttgggcgcattccgtgatctgatgcacgagctggccgatttcgccaaggaacatgattcgaaaccatccgaagtggtggccgaagtattggataaaagcggtcttctggaggaattgcaacgttccgaggatccgcaggatgcttcgcgtgtggacaatctttcccagttgcagtccgtggccgccgaattcgaacagaacacgccggatgccacgttggccggttttctggagaccacggcattggtcgccgactcggatcagttgccgggagagggcgaggattccggcaaggtcacgatgatgaccttgcatacggccaaaggtttggaatatccgtatgtgtttcttacgggtatggaacagggtacgttcccgcaccagcgtgccatggaggacaccagcgagctgtccgaggagcgtcgtctggcatacgtgggcatcacccgtgcgaagcgtcggctatatgtgacccgtgcggcggtgcgtgcccaatgggggcaggccaatgacatgatgcccagccagttcctggatgagattccggatgaactcatcgattggaaacgtcgtgaggccggtgtggagcgcatgcgcgccagctggggagatgacgacgagttcggcgggtgggacgatgatgacgatttcggatccacttccttcggcgaatcgatgtacggatcgtcgacatacggttcctcatcgtatggttctggttctcgcggatcgcattccacttatgggtcgtctcatggatcgcacagctcgtatggttccggacggtcctcctacggctcgggaagccgccgtttctctggcggattgcactctggctcgtcctcatacggttcgtatggctcatcccggtcgtcatacggttccggcaagccctccggcaaatccggtaaggtcaccacgcgccgcgccaagccaaaggatctgacgaaatcggctccggcaagttcgttggacggcaacaacggattgagcatctcggatttccagataggcgacagaatcacccatgaccattacggtttgggaaaggtcatcgaaacgcaggacaagggcgcgaattcggtgatcaccgtcgatttcggcacggatggcgtcaaacgattgctgcttcgtgtggcgcctattgaaaagctctgacggcttttccaataggcgcccctcgtggcggcgccgttgtgggctcataacacggattgagtgaaaaaacaagtcttttctttcggagcatttgttgcgataatcggcgatgtttgcttttcgagaggaagaaccatgccaagaaaactgttcgccgcgatatctcagattgttctgggcgcgctgattgtcatcgccccgcagaccttcgcgcatgtgtgtgccgtcaaagacatgcccatggcatgccgctacaccgctcgggtcgctctgggactgggtgtcgtcatcgcattgctggcaataatcggatttttcgcgccaagccgggtcagggtcggattggatctcgccaatgccgtgctgggcgtgcttgtcgttctggtgccgaccatgctggtaggcgtatgcagaggctccatgatgcattgccatatggtgacgatgccgacgcttatcgtattgggcgtgctgctggcggtgctcgcagcagtcgccgtatatctcgatctcaagccggcaaagcgtggctgacgtgccgcatatcacccttgcgaaactaccgctggccaatctgcgtcgcaaaccattccgcacttcggcgcttgtcattgtggtcgtcatgctcactgtggcgttctatggaggcgcactgctttccatgaacctgaacaatgggttgaacagcatgcgggaacgtatgggcgccgatctgatggtcacgccgcagaacacgaaaaaccaggctgaggcgttgcttacgggaaactcttcgagcacgttctacttcaccaatgacattggaagccaaatcgccgaagcggacggtgtgggcgaaagcacggtgcagacgtacatctcctcgcttgcggcagcctgctgcgacgaaaaggtgcagatcatcggcttcaaccccgacaccgacttcgtcatcactccttgggtggcttcgcaattcgacggcacactccgtcgcggccaaatcatagcaggcgccagcatcaacgtgtcggacaacaatacggtcaaactgtacggtcatgaattccccgtggccgcgcaactggccgataccggaacgtcactggacaattccatattcgtgaacatggacacggtgccggatgtcgtttcctattccgcgcaggtcggacatgccgcgattcctgaagaatacgccggcaaagcggtgtccgccgtgctcgtcaaagtcaaggacggatattccgcacaacaggtcgcctcgaatatcgcaaaagccacggggatcaaaagtttgggatatgtgtatccgggcggtatcacggctacgacgaaaacgaatctcaaggtgattatccgctatgtggcggtgttcatcacggtgttctggactatgggtttggtcgtgatgttggcggtgttttcgtcggctatgaacgaacgcaagcgtgaattcgccgcgtaccgtattctcggcgccgatcgtgcgaccctggtgggcattatcgtcaaggaatcggcgaccatcggagctattggaggtgtgatcggtgtgacctgtacctcgttggtcgtgtttccgttcagtggtctgatcgctaaggaacttcaattgccgtatctgcagattggcgtcggtaaagtggcggtactgatagtcgtcgctctcctgttcgccgtgcttacgggcctggtcgcatccctcgccacagcggtgcgtctttccgccccacaggcatacctgacgctgagggagggggagtgatgccggaacagcccatattggaggttcgtggccttacccgtgaattcgtacgccgaggtaaacctttccccgcggtggatgatgtgaatctcacgctcgatccaggcgaattcatggcgatcgtcggcagatccggaaacggcaaaagcactttgctcaatctcgtcacgggattgctgaaacctacatccggttcgattctgctggccggtaacgaggtgaccacgttaaacgacaaacagatgtcgattttgcgcaaccgcaccatcggcttcgtcacgcagatccagacactattgccgaacctcaccgcaatcgacaatgtggtccttcccgcagtgctgcatcgcaacccgtctcggtatgaaaccgaaatcgatgaacggacgaatgacgcacaatcacaggaacagacggcgtcttccgtcgtggtcgatggccttcccgacgtcatccaaccagcttcgacgcagacggcttcttcatctcagcccgaccatttgacgcaacgcgcgcaacatctgttggatcaactgcttgtaggcgagcttgcgacatgctatccgaaggagctctctggtggcgagatgcgccgcgtctccatcgcccgagcgttgatgaacaagccgaaactgctgatcgccgatgaaccgacaggagatctggatgccgaaagcaccgcaatcgtcatgcggctgctgcggcaagtagcggatgacggtacctcggtacttatggttacccatgatccggacgcgcttgcttatgtggaccatacctatcgtatggataggggagtgcttactcgggcctgacgtttttaagacatgccgatgtaggtgaatcggagcatctcgtccgtcccccatgtgtatgattagcgattggtgtgcgcccggaaggacgtatgccgtctggagtcttagcccatcagtgggtcggcggccatccgtggtgttctgcattgcgggtcaagccgttcgcgcattgcgcgaagaagcactggagaggctggctcagcgtatgccggacttcggcatacgttccgttcagacaacgacagaacaaacaaaggattaaaccaatgacgaacgttcagcgttcccgccgtcaggtgcgtctttcccgcgccctcggcatcgctctgacccctaaggctcagcgcatcttcgaaaagcgtccgtatgctcctggcgagcacggccgcacccgtcgccgcactgaatccgattacgcagtgcgtctgcgcgagaagcagcgtcttcgcgcccagtacggcatctccgagaagcagctccgcgccgcttacgagaagggcacccacaccgccggacagaccggcaacgccatgctgaccgatcttgagacccgtctcgacgctctggtcctgcgtgcaggcttcgcccgcaccaccgcccaggctcgccagttcgtggtccatcgccacatcctcgtcgatggcaacatcgtcgatcgtccgtcctaccgcgtcaagccgggccagaccatccaggtcaaggccaagagccagaccatggttccgttccaggccgctgccgaaggtgtgcaccgcgatgtgctgccggcggttccgggctacctggacgtcaacctgccttccctgaaggccaccctgacccgcaagcctgaagccgaggagatcccggtgcaggtcaacatccagtacgtggtcgaattctacgcccgctgatctggatcaccatactgtaagaacatacagtttaaggacatacagcgaaagcctcgcagccgttacggttgcgaggcttctcgttttttttatggcgtttccggcggcatgtcgtttggctgattccacaggtaccatggaaaccatgttgcttcatcttcatctggtccgtcacggacagacgttcttcaaccgatataacagactccagggatggtcgaattccccgttaaccgatgcgggacttgccgatgcggacaaggccgccgccaaactccgggacattgagttcgccgcggcatactgctccgacaccacacgcgcccaggtgacggcacaacggatcctcgatgcgaacgaagccgcaggacacgttcgtccgtcactggtcagcgacatgcatttccgtgagcagttctacggttatttcgagggacaggacatgtccgtcgcatggaccgctgccggtggtccccatggtgcgaagaactacaacgacatcgtccgcaaatacgggcttgccgccacccgcgactttctcaaagaagccgatccgttccatgacgccgaatccgataacgagtattggcatcgtgtggaggacggcttcgctttgattgcggacaaccctcggcttaaggacggcgaccacgtgctgcagatctcccacggcaatacattgttgagccttatgcaccgattcgccccggaaggatacgatttgagcgaacgtccggccaacggttcggtgacctgccttgattttgacacgaacgaacccatggaccgcgcggtgagtgtggtctcgtacaaccagtgaacgtatttgccacagtcgtggctttttactagtcttatgcgggtattgtgttcgcgggcaaccgtggagctgaaaagaggtacaagatgggtgttggagagatcgccggtctgattgcggcaattgcattcgcggtgcttgccggtttcatgatctacccgctgatccgtctcggcaaattgttcgaccagatcgcgcagaccgtcaaagacaccggagaccatgcgattccggcgcttgacgagagcgtgaccacggtgcagcaggtgaacaagtccctggaggatgtcaacaagatctccgccgcggcgtccaccacggccaataatgtcggcgcgctgactgatctatatggatcgttcttgggcaagcccgtcatcaaggttgcgtccgccacctatgcgttgaagtccactgtgcagtctttcttggctaagagagacgtcaatcacgcggcaggcaataagggggagtgatgttcaagcgtcttttctgggtctccatcggcgtgggcatcggtgtcgtcgctgtcacaaaagcgcaggcatacgttaaagccaacacaccggacaccgcccgccaattcctgcttggtcccgaccaggaccatgtgaccatgcgcacgcttgaaggtctggtcaatgagttcaatgccacgcgtcgagcccgcgaggctgaacttaacagcaaatatgcggcgcggaacgagtagtcgttttccgcccgacagatacgctcaagcaaccaatcacacgtttggaaggcatcaggcctccaacaacaaaggagctcaaatccacatgcgcacttctgaaatcgcgaagcgctttcttgactatttcgaacagcacgatcatcttgtcgttccttcggcatcgttgatttctccgaatccgaccactctgttcaccatcgctggcatggttccgttcatcccgtacctcatgggtgagcagaccccgccgaagcaccgcatggcttccaaccagaagtgcgtgcgtactctggacatcgacgaggtcggcaagaccacccgtcacggcacgttcttccagatgcttggcaacttctccttcggtgattacttcaaggaggaggccatccactatgcgtatgagctgctgaccaccccgcaggataagggcggctacggcttcgatccggagaaactgtggatgaccactttcaccgacgacgaggaagcccgctcgatgtggaagaacgaaggcgtcgatcctgaacatatccagatcatgggtatggaagataacttctggaccaccggtggccctggccctggcggtccgtgctccgaaatctatgtagaccgtggtccaaagtacggtgtcgaaggcggcccgatcgccgacgagaaccgttacattgagatttgggatctcgtgttcgaaaactacgaggtcgacaacgtcaagtccaagaccgacctgcatatcgtcggcgagcttgagaacaagaacatcgataccggcgccggtctggaacgtctcgcctatctgatgcagggcaagcagaacatctatgagaccgacgaggtcttcccggtcatcgaagccgcgcagaagctttccggccgcacctacggcgatgacgaggccatggacgtgcgtttccgtatcgtggccgaccacgtgcgttccgcgctgatgatcatgtccgacggcgtccgtccgtccaacaacggccgtggctatgtgctgcgccgcctgctgcgtcgaaccgtcaaggccatgcgcgagctcggcgtgacagagccggtcatgccgaccttgctgccgacctccaaggccgcgatggaaccgagctatccggagcttaacgacaccttccacgacgtgtccgaagccgcctacggtgaggaggacgcgttccgccgcacgctcgaatccggcaccgagatcttcgacatggccgtgacgaaggccaagcagggcggctcggatctcgtgtccggcgaggatgccttcaagctgcatgacacttacggcttcccgattgaaatcacgctcgaaatggccgccgaccagggcgtgaaggtggatgaagccaagttccgcgagctgatggccgaacagaagagccgtgcccgtgcggacgcgctgaagaagcgccacaacgtggatttgtccgtctatgacgacttcaagaagaccctgctccagccgatcgacttccttggctacaccgacatgtccgcacgtgccaaggttctgggcatcatgcaggagggcaagggttccgttcccgccgtcaccggcccggccaacatcgaggtcatcctcgaccgcacgccgttctacgcgcaggccggcggccagctcgccgatcagggcgagattctgtccgacgatggcgcggtgcttgaggtcgacgacgtgcagaagccgatcaaggaccttatcgtccaccagtgccgtctgaccgaaggcacgctggttgtgggcgccgaagtcaacgcgaacatcgatctcgagcgccgtggagccattgcacgttcccacaccgccacccacatggtgcacaaggcgctgcgtgaggaacttggtccgcaggccacccagcgtggctccgaagacgctccgaaccgtctgcgcttcgatttccaatggtccagcgcccccagcaaggacgccatgaacgccgtcgaagcccgcgtcaacgagaagcttcgtgagaaccttgccgtcaccactcaggaaatgaagttcgatgacgccatcgctcttggcgccatgcatctgttcggcgagaagtacggcgacatcgtgcgtgtggtgtccatcggcgaggacggctggagccgcgagctctgcggtggcacccatatcgaccacgtcggcaagatcggcgccatcaacatcatgtccgaggcgtctatcggttccggcgtgcgccgcgtggacgcggtcgtcggccagggcgcgtatgagttcaacgcccgcgagcacgcgctggtttcccagctttccgacatggtcaacgcccgtcccgacgaactcgccgagcgtgtgaacatgctgcttgccaagctcaaggaatccgaccgtcgtcttgccgcaatgtacgagtcccagcttgcggcctctgtgccaacgctggtggctgaggccaaagcttcctcggctccggtcaaggtcgccaagaagaacgttggacatttcggctccttcgacgcgcttcgcaagaccgtgctcgacgtgcgcggccagctcggcgaagatgctccggtcgtggtggctcttgccggcatgaacgaggacggcaagcccatggtcgccgtggcaaccaacgaagcggcacgcaagcaaggcatcaaggctggtgatctggtccgtggcgcttccaaggttcttggcggtggtggcggcggcaagccggacttcgcacagggtggcggcgcggacgccaccaagatcgacgaggcacttgaggcattggccggccaggctctgaagggctgattctccaagcatggtttggcttggtatcgatctgggtgatgctcgggtcggacttgcgttgtccgatcccgagctcaccctcgcacatcccataggcaatattcaagtgtatggggattctttccgcgcgttggatgaagtcatcgacgtcattggggacgagtcggtggaccatgtggtgattggcctgccgttgctgctgaacggcgaagaggggaaaagcgccaaaaaagcgagacgctggtccgtcaatcttgaaaaacgactgcatgcggccgtggaggatgaatcatattcggtgacgcgggttcccaccattgaattggtggatgagcgtctgacgacagtgaccgcacatcatcagttgttcgatgcgcgcatcggcggacgcaagcaccgtccgatggtcgaccagcaatctgcggtggtgattttgcagacggcgctcgaccgaagcagagagtaaggggagagagacctttgaccgataatctgaacgattttttctccgataacgcgcagtgggtcgatgatacgtcagcgggctcgtcattcgatgccgcgttgccgccgcaaccgccgaaatcgcgacgcgacatgcgtaaacgacgtgagcaacaacgtcgtcgtcgctatgtcacaatcatcgcggctgccgtcgttgtcattcttgtcgtcgtcggcggctttttcggtgtgcgcatggttaaacatctcaggcaaatgaacgccaacggctcgcaaatccagattgaggattacaccggttcgggagacaaagacacgacgttcaccgtggaaaccggacaaggcgcagccgaaatcgcacgaaatctggtcaaggcggacatcgtcaaatccgaatcggcgttcacctccgcagtcgcggccgccggcgcgacgctttacccgggttcgtacgcgttgaagacgcatatgaaagcggccgatgtcgtcaagatcctgtccgaccaaagcaaggccggcggtttcgccgaagtcaaggccggcgaacgggtgtccgatgtcatcgccaacgcggccaagatgtcaggcaaggacgtgtccgaattccaagcggtcatcgacggtggcggcgcgggcattctgccagatgaagcgggtggcaaattcgaaggatggcttgagcccggatcctacagcgtccaggacaagtccgccaaggacatcctcaaggaaatggtcacggcacgcgtcaacaaactggacacattgggcgtgccagatggaagcgaacgcgaacgtatcatgaacatcgcgtccatcgccgaatccgaggcatgcaatcctgacgattacggtaaggtggcgagggtcatcctgaacagaatcgaccaggacatgccgttgggcatggacagcaccgttgcctacgggttcaacaccacaggcagcaagctgacagacgagcagcttgaggatggaagcaacccgtacaacactcgcgtgaacaaaggacttcctccgacgccgatcagcaatcccggcgattccgctatccaagccgcgatgaatcctccggaaggcaaatggctgtacttcgtcaccaccaacctcaagaccggcgagacgaagttcgtggaaaccgaagacgaattctggaagattcgcgacgaatacaaaagcaacaacgcgaatgccaactgacggtatcacgcattaacacaacgcgtgcatcgcgatgcttatcgccccggccacgacaatggtcggggcgaacggcgtcttaccggcgaatcgcgtatgcttctgcgggtcgaaccgtgtccaaatcgcaagccacagcagccccagcacactaatcgcaaaccaccagaacaccactggaaacaggccgaacatgcctacggccaagccgataagcaacgtcgtggtgacgtcgccgaatcccaaagcccctggcttgatgagcgcaagcgcacattgcagcacggcggataacgcggcgaacaacagagcctgcaatgccagaaacagtgaattaacggacaacgcatacgtgatgtccacaatgacctgcgccaaacaccctacggcgatccacatgcgtggaatgcgtcgtgcccggatatcctcaacgctgacggccattccacagagcagactcggcaggcaaatcatgtaccacataccgttaagatagtccacgaatcgtatttggcagaaaaggagtgttggcatgttgcgctggcagacagcaggtgaatcgcacggcgaagcgcttgtcgccatgatcgaggggctgcctgcgggcatccacgtcactactgaggatatcgtcggcgcattggcacgccgacgtctcggatatggccgtggtgcgcgcatgaaattcgaacaggacaaggtccgcatgctcaccggtgtgcgtttcggcgagaccatcggctctcccgtcgccatcgagatcgccaataccgaatggccgaaatggaccgaggtgatgagcgccgatccgcttgaccatgacattccgcgcgaaggccgcaacgcgccgctatcccgtccccgtccggggcatgccgatctgactggcatgcgcaagtacggtttcgacgacgcccgtccagtgctggaacgttccagcgcacgtgagaccgcgtcgcgtgtggccttaggtgaggtcgccaagcagttccttgaacagacgttgggcatacgtaccgtctcccatgtgctgtcaatcggtggtgctggcatcaccgacccgcagaatgcggtgctgccgaagcctgaggacctcgaagcattggacgcttcgccggtgcgcacattggataagacggccgaacagcagatgatcgcacgcatcgacgaggccaaggagaacgccgataccttaggcggcgtgatcgaggtcgtggtatacggcgttccggctggaatcggcacgtacgttgaatcggaccgcaggctggacgcggcattggccagtgccgtcatgggcgtccaggccatcaagggcgtggagatcggggacggtttccttgaggcgatgcgtcccggctcccaggcgcacgacgaaatggtggttggcgacgatggccgcatcacacgtctgagcaatcgtgcgggcggaatcgaaggcggcatgtccaacggccagccgattgtggtgcgtgccgcgatgaagccgattccatccattccaaaggcgcttcgcaccgtcgacgtcaccaccggcgaggcggcccaggccatcaaccagcgttccgacaacaccgccgttcccgcggcggccgtcgtggccgaggcgatggtgcgcctcaccatcgctcaatacgtgctggagaagttcggcggcgacagcgtggccgaaaccaagcgcaacgccgaatcctatgtggcgtcctggccggagcacatgaggtgaccgattcgatggctggaatgcgtagacccgtcgccgtcatcatcggcatgatgggcgcgggcaagacccgcgtcggcaaggaagcggcgcagatgatgcaactgccgttcgccgacgccgacaacgagatcgaacatgatgcgggaatgaagattcccgaatatttcgaaaggtacggcgaaccggagttccgtaagctggaaagcgacgttgtgcttgacatgctggaggatttcgacggcatcttctccttgggcgggggcgctccaatgaccccgtccatccagcaggggctcgccgaatacatcgccgacggcggcaaggtcgtgtatttgatggccgatccgaaggaagccatggaacgcgccaatcgcggcggcggccgtccgatgctcgacggcgacgccaacgagcgttggaagaagttgtacaaggaacgcgacccggtgttcagacgcgtggccaatgtgcaggtgcgcacccacggacaaaccccgcaagtggccgcgagaaagctgatggaaatgatcgatcaacgtatcgtccacgtcaccggatccaccatcgaaccatacgatgtgtgcataggcgaaggtgtgatgagccagcttgcgcaggtgctgggggacaagcctgccaaagtggcattgattcacacccaggcggtgcaacggcattccgaccgcgcgcgcacgctgttgcgccagtccggttatgacgtgcacgacatcgtcattcccgatgctgaagccggcaagaccatcgaagtggccaacggcatctggcagcgtctgggggaggaaggcttcacccgttctgatgcgattgtcggtctcggcggtggcgcagccaccgatctggccggtttcgtggccgccacatggatgcgtggcatccgctacgtcaactgcccgacctcgctgctggccatggtcgacgcctccaccggcggcaaaaccggcatcaacactccacaaggcaagaacctcgtcggctcgttctatacgccggccggcgtgctcgccgacatgggagcacttgcctcgttgccgaacgacatcttcatcgaaggtctgggcgaagtggcgaaatccggtttcatcatggatccggagattctgcgcatgcttgaagaccatgccgacgagctgcgctcgttcgacggttcgacgttccttgactccgatctgaaggatgtggtcgccgaactcatcgaacgtaccgtgacggtgaaggcgtaccatgtgtccgccgacctcaaagaagccggattgcgtgaattcctcaactacggacatacgcttggccatgccatcgaaaaactcgaacacttccgctggaggcacggcaacgccgttgcggtcggttgcgtctatgcggccgaactgtcccatctgctcggctacatcgaccaggatctggtcgactaccatcgttcgctgctcggctcgctcggcctgccgacatcatggaacaatggcagctgggatgatgtgctggcgctcatgcaccgagacaagaaggcccgcggcaacaaactgcgtttcgtcatactcggctcgctcggccatcccatccacctcgaggatccgccggcggacgccgtcgaggaggcgttccgacgcatccagcggtaggacgcaatcgcaagaacgaacacaaaaggaagcaatatgaccaaagtagtggttgtcaacggaccgaacctcggccgtctcggagtgcgccagcctgacgtatacggcaagcaggatcttgagaccctgcgcaaactgtgcaccgaatggggtcatgaactggggcttgacgtggaggtgcgtcaaagcgacgacgaggccgagatgattcattggatgcatcaggccgcggacgagaaaacgccgatcgtgatgaatccggcggctttcacgcattactcctatggtttggcggacgccgcgcacatggtgatcgacgagggactgccgcttatggaggtgcatatctccaacccgtccgcacgcgacgagttccgcaagcgttccgtgatctctccggtggccaccggtaccatcaccggcatgggattctatggctacaagctggcaatcgaagcggttgcgcacttgttggaagaacgctgacatcgacattccgtcatggattcagccggatgcctgtctttaaggcatccggctttttcgtgccaatgaggacgacgcatatcccggtctccccggattggtatacagtgatattgcaaacgtatgcaaaccgggagcatggcgaagtgacgaagaggtcgatgactatgggcgcaatcgcaagaagaatcacacgtgtcattacggcggtcgtatgcgtcgcggtatcggtcggtgtctcagtcgccacgcttcacgtgccgacacgtgaaggcggcggggaacgtttcaatcccgcgcgataccgcagcgacgtgatcgtgaccatgttccaagccaattggaaatccgtcgcccgcgaatgcggcgaagtgctgggacccgaaggcgtcggctacgtacaggtctcgccgccgcaggaaagcatccaaggcacgcagtggtggacgagctatcagccggtaagctacaaacttgactccaaagaaggcaccgaagctgaatttaagaacatggtccggcaatgcaaggccgcgggcgtcggcgtgatcgcggatacggtcatcaaccacaccaccggcgtcgacaaaacacaagggaccggcaccgccggaagcccctacgacaataaaggctatttccctgaagccggatacacgccatcggacttccatgccccctgttctatctggacgtaccgcgacgccgaaagcgtgtggaactgccaggtatcgggtttgcaggaccttgatacatcaagcccgcacgtgcgcgacgtgctgtctgactattttgtgaagcttctcgactacggcgtcgccggattccgcgtggatgccgtcaaacacatgcctccggaagacgtgctggccatcaagaaactcgttgcgaagaaatccggacgttccatgaacgacatctggtggacgcaggaagtgattggcgacaatgcggaagccgccgaaatccaaccgaggaactatctcaaaaccggccaggtgaacgaattccagtacgcatatcggcttaagtccctgttctccaactcgctggcaggcggaagcctgtcgatcaaagacattccgcagaacatcaccgacagtggcaaggccagcgtattcgtgacgaattgggataccgaacgcaacaacatgacgctcacctacaaggacggcgacgcctaccggctagcgaacgcgttcatgctggcctacccgtatggcgcccccaacgtgttctccggatacgaattccatgacaccgactcgggagcttcaggcgccactgcgaccagcgtgcccgatattgactgctccaaagactccggctggagctgcaccgaacgctggcctgacgtgcacggtatggtcggctggcataatgtcgcaggcgacgcgccgctctccgattggcaggatgacggcgacaacatgatcgccttcggtcgagggggacgtgccttcatcgccatcaacaattccgtgcgcacacgtactgtgacgtaccacacggctttgccggcaggggagtattgcgatgtctacgcttccgccgactgttccggcagcgtgcatgtgcgtttcgacggggatgccacactgacggttcctgccggtagtgcagtggccttccatatcgccgcgacaccgtataccgtgagacaatgattgcaatcgtttgctgttttttgcagctatttctgaatgttttctgcttgacttgcagaaaaaaattttgattgcagcaacaggttgcacttcggcatatatgaagtgcatgtgcagcagagggtcacgctgtttcattgccacgcgcagccattgacatacaattaactctgattcagagtgtaaacgtatgcatattcatcgtcgagtggattctgaatcatccgcgtggatgcggatgtccatggcgcatacgttgccggtcgcggcgcctgccatgggcgcttgaaccggcctcacagatgagaacggagaacgatggtcgttcagacgaaccgtccattaggccgtgtggtggcgatgggcgtcaccgcggccatggcgtgcgcttcgttggtcgcggcaccgatcgtggcccaggcgcaatccaaaacgcaggccaatcaacagaaagatgtccaggtgattgcgttccagcagacgtggaacacgatcgccaaggaatgcaccaacacctatggtccggaaggtgtggcctatgtggaggtctcgcctccgcaggaatccatccaaggcacgcagtggtggaccagctaccagcctgtgagctacaagctcgactccaagctgggcacggaagccgaattcaagaacatggttcagcagtgctccgcggcaggcgtgggcatcatcgccgacgtggtgctcaaccagaccaccggcgccgacgtggccgccggagaccagaagggcgtggccggcagcgaatacaacggctccaccggcagctacccgggcttcgccaccaagcagtacccggacggcatcaccgccgccgacttccacagctgcaccaagaacatctccgactacaccaatcagaaggaagttcaggaatgccgcctgagctccatgtgggatttcaactccgaaagcgagaaggtgcaggacatccagtccgactacctagcctcgctgtggaacgccggcgtgcgcggcttccgcatggatgccgtcaagcacatccacactgacagcgtgaaggccatcaaggagaagttcgccaagaaaatcggcaagaacgccaacgacatctactggattcaggaggtcatcggcaacgcctccgaggccgcgggcatccagccgagcaattacgtgcagaacggcaccgtgaccgaattcggcttcaaatccgagatgaaccagaccttcaaggacaagatcgccaacctcaaggggctgagcgatcgcctgagcaaggatctgtcctccgaggacgccaacgtgttcgtcaccaactgggacaccgcccgcaacgagggtgcgctgacctacaaggacggcgccaagtaccagctggccaacgcgttcatgctggcctacgactacggcaccccgcgcctgctctccgactacaagtgggacgtcaacgacaacggtgcacccggagcgaccgcgacctccgtgcccgacgtggatatggacaaggcatgctccaccaacgattccgattggaactgcgagcagcgctggacctccacccgcggcatgatcgccttccgcaactatgtcaacggcaccaaggtcgccgattggcaggatgacggcggcgacaacatcgccttctcccgcggagccaagggcttcatcgccatcaacaacggcaagaaggacaaggacgcctcctacacgacatccctcgccgacggcgaatactgcaacgtgtacgccaccatggactgctccaagaccgtgaccgtcaagggtggcaaggtcgagaccacggtgccggcgcactccgccatcgccctgtatgccggtgctaccaaggcctcgcaccccgcagcctccgccgccaccgatccgtccgatcccgacgtgagccaggaggaggatgacgccctgcccgacgacagaagcgtcaccatctactacaagcccgccaactctgagtggaagaccccgaaggtccattacggcctcggcaacgattgggagcagccggaagccgacatgaccctcgacgcgcagggttactacaccgccaccatcaacaccaagggcaaggcgatcgacttcgtgttccacgacaaggacaccgatggttgggagaacccgaaggacggcagcaactaccatgccaacgtcggcatcacccacgttggcgtgagcgagcaggccgcaaccgtcggcaaccccgaatccatcggcgccaagacccgtctcgtcgtgcactacaagccatccagcgcttcggacaaccgcggcgtgtacgtgtggggcaccgatgtgaacggcggcaacatggacgccaagcaccacgccttcaccggcactgactgctggggcaaggtcgccgtgctcaatttcgacggcaagtacgacaagttcggcttcctcgtcaccaccagcgattggaacaagtacggcgccgaccgtagcgccaccgtgagcgccgacggcaccgccgaggtgtggatcgacggcaccaagtacccggaccagggcgaggcgaccactgtcgagacgcttgattcggcaccggccgattacgcctgcaaggccaacaccgtcaaggtgaaggtgcactacaaccgagacgacggcctgtactacaacgccgaggacaccagcaccactgtgccgcagtgggatatctggacctgggcatccaattggaacggcggtgccgctaccttcaccacccatgacgattggggcgagatcgcggagtactccttcaccaactacacctactacaacaacgacggcgcttccgatatcggcatgctgcgccgttacggtaaggacgcgtggaaggccaaggacccggacgacgccgatcacaggatcccgtccaacgcgctcgtgttcgacgccgacggcaacgcctccgccgaagtgtggctgctcggcggcgacgccacggtgtatacctcccgcccgtccctcggcgcgaccatgaagtccgccgagatctccggcaccaaccagctgtccgccaagctttccaagaaggtctccacggatgacctgaaaggcaaggtcaccgtcacggacgccgacggcaaagccgtcgatgtcaagagtctcaaggccgacggcaccaaggtgatcatcaccgccgacaaggatctggacgttcgcggcaagtacaccgtcgagatcaagggcttcggctcccagaacgccatcgccggttcggtggtccgcaccgacgccttcgacaagaagtacgcctacagcggcgaggatctgggcgcgaccttcaccaagaagcagaccggcttcaaggtgtgggcgccgaccgccgccaaggtcgagctcatcacctacaagtccgccgacccgaatgccgagatcgatcagaccatcgacatggcaagcgaaagcaagggcgtgtggagcgccacggtgaagaagcttgcctccggcaccgcgtactcctacaggctcaccttcgccgacggcacggtgaacacctccgccgatccgtacgccaccgcggccgtcgccaacggcgagcgctccgtagtgctctccaagaaggccatgggcaaggcgggcaagcgcatgccggccttcggcaagaccaccgacgcctccatcgccgagatgaacatccgcgacttctccatcaacccggcctccggcatctccgccgacaagcagggcaagtacctgggcgtggtcgaatccggcacgaagaccgccaagggcgcgacctccggcctcgactatctcaagtcgctgggcgtcacccacgtgcagatcatgccgatgtacgattacggttccgtcaacgagaccggcgacctgagctacaacgccgatggcgcgcagaactggggctacgacccggagaactacaacgtgccggaaggctcgtactcctccgatccgagcaacccgagctcccgcgtcaccgaaatgaagcagatggtcaagggcctgcacaagaacaacatccgcgtcatcatggatgtggtgtacaaccacgtccacaatgccgcgaaccattcgttcaacaagacggtcccgggctactacttccgctatgacgacaacggttcgctcgtcaacgactccggttgcggcaacgacaccgcctccgaacgtgcgatgatgcgcaagtacatcgtcgactcggtgacctactgggcgaagaactacaatatcgacggcttccgattcgacctcatgggtctgatcgacaccaagacgatgcaggaggttcgtgctgccctcgacaagatcgatccgtccatcatcgtgctcggcgaaggctgggacatgaactccacgatggacaagagcgagatgaccatccagccaaacgcctaccaggtcgcttcggacggcaccaacaacggcatcgcgttcttcaacgactcgatccgcgacggcctcaagggttccgtgttctccgacaccgacaccggtttcgtctccggcaaggccgatcaggaaagcctcatcgcccacaacgtgctcggctgccagtacgacgccgacgccatcaccacctgctggaacggcaatgcgcaggaccactacgcggatgccggtcaggtggtgaactacgccgagatccacgacaacatgaccctgtacgacaagctcaggaagtccgtgcccacggatgacgaggccaccaccgaggcgcgcgccaagctcgccgattccgtggtctacctgtccgaaggcatcccggccatccagctgggccaggagtttctgcgcaccaagggcggcaacggcgacagctataacgccggtgacgaggtgaacgccatcgactgggatcgcaccacgcagtactccggctccgtcgactacgtcaggggcctgatcaagctgcgcaacaggatcgctgccctccgccagaccagctacagcgacatcaacgccagcgtgaccatgctcaagtccgccaacggtgtcgtggcctatcaggcgaaggactccagcggcacctacgtggtgatcttcaacgccaacaacgatgccgccgccatcgatggcgtcgaggccggcaagtacgaggtgctcgccgcaaacggcaccgtgtacggcgacgatgatgtcaagagcgtcaccgtccgcaagggctccgcatacaccgctggcgcactgtccgccaccgtgctcaaggtcgcctccgccgacgacgtcgttcccgtgattagcggtgtgaacgagtcgacgaccatcaccgtcggttccaagttcgatccgatggcgggcgtctccgccaccgacgacatcgacggcgatctgaccgacaagatcaaggtcgagggcaccgtggacgccaataaggtcggcgactacaagctggtctactccgtgaccaactcccgtggcaagaccacgaccttcacccgcacggtgcacgtccagaagcaggccgtcaccccggccaccgataagaacaatggcaagatcaacggcaaggccgacaatacaaaggaaaacgcggagaaaagcgcggcgcagagcccggcaacaggctccaacgtcgccggaatcgccttggccgtcatggtgctcgccgttgcggcgggcgtgttgatcgtcctccgcaggaaggaggccggcgaccgataaaatcgcaatcgtctgactgtatttcctgaatttccgaaaggcgggaccgcggagcaatgcggtcccgccttttcgtatcacgatggaacacgccgcgtcttgcgccgctgatagactgaagttccatggttagaagacaacatggcaattctcaagaacacgtcaccaaacatattttcgtcactggcggcgttgtctcctctctcggcaaaggcctgaccgcctcctcccttggacgcctgctccgtagccgcggcatcaaggttttgcagcagaagctcgatccgtacatcaacgtggatccgggcacgatgaatcctttccagcacggtgaggtctatgtcaccgaagatggcgcggaaaccgatctcgacatcggccactacgagcgtttcctcgacgtgtacctgagccagaaggccaacgtcaccaccggccagatctatcaggaggtgctgcgcaaggaacgcgccggcgaatacctcggccagtgcgtgcaggtcatccctcacatcaccaacgaaatcaagtcccgtatgcgcgcgcaggcgtccgatgacgtcgacgtgatcatcaccgaaatcggcggcaccgtcggcgacattgaatcccagccgttcctggaggccgctcgtgaagtacgccgcgacctgggcgccgaaaactgcatgttcgtgcacgtctccctggtgccgtacatcgccgccgcgcatgagctcaagaccaagccgacccagcattccgtcatgatgctgcgccagctcggcatctccccggacgcgctcgtgctgcgttccgaccggccgctcaaccagtccatcaaggacaagatctccctgatgtgcgacgtggactccgaaggcgtcgtcaactgcgtggacgctccgagcatctacgacgtgccgaagaccctgttcgacgaaggcctcgacgcctacgtggtgcgtgaactcggcctgccgttccatgacgtcgactgggacgagtgggaggacctgctcgaacgcgtgcaccatccgaagcacgaggtcaacgtggccatcgtcggcaagtacattgacctgccggacgcctacctgtccgtcaccgaggccatcaaggccggcggcttcgccaactgggccaaggtcaacgtcaagtgggtggccgccgacaagtgcgccaccgaagaaggcgccgcggcggccctcgaccaggtcgacggcatcgtgattccgggcggcttcggcatccgtggcatcgacggcaagatcggcgccctgcgttacgcccgcgagcacaagctgccggccctcggcctgtgcctcggtctgcagtccatggtcatcgaatacgcacgcgatgtcctcggcatcaccgacgcgaactcctccgaattcgatccggattgcgccaacccggtcatcgccaccatggaagagcagaaggacatcgtcgccggcaagggcgacatgggtcacaccatgcgtctgggctcctacccggcggaactggaggaaggctccattgtcgccgaactgtacggcaccacgcatgtcaccgaacgccaccgccaccgttacgaggtgaacgtggcctacaaggatcgtctgcgcgaaggtggtctggtcatctccggccagagccctgacggcgaactcaccgaattcgtcgaactgccgcgcgaggtgcatccgttctacgtggccacccaggcccatccggaattcaagtcccgtccaaccaagccgcatccgctgttcgcgggtctggtcaaggccgctctggaccaccagcaggcgcgctgagacgatttgagcgcataagctcgattcatcgcaaagcggaagaccgaatctgcatggtcttccgcttttttgtaaggcaaatcacgggcgaatactgtcgaatttcgaataaggtctagtgtttcgctgtgtgttctgttaggttgtcataggtatcaatgagtgaatggaggcagcgtacggtggcagagaaccaagcgtccaacgccgcggccgacgtggagatgagccagtatgtggctgatcgcacgcgcgtgaacgaagacaagatcaagcaggatgacgagattatcgagcaattcggtgactacaactacggctggcacgatacggacttcgccggcgaggcggcgaagaaaggcatcgacgagaacgtcgtgcgtgccatctccgccgacaaacacgagccggaatggatgctggaaaagcgattggaagggtatcgcgatttcatcgaccgtccaatgccgcagtggggcgtcgatttgaaggacttcgacgccgacgatttcaagtactacgtcaagccgatcgacaagcaggccaccacctgggaggaactgcccgacgagatccgctccacgtacgacaagctcggcattccggaagcggagaaaagcagactcgtctccggcgtcgccgcgcagtacgagtccgaggtcatctacaattcaatccagaaggaccttgaggagcagggcgtcatcttcgtcgacaccgacaccgccgtgcaaaagtacccggaactcgtcaagaagtatttcggcaaatgcattccgagcaacgacaacaaattctcggcattgaacaccgccgcatggtcgggcggctcgttcgtgtacgtgccgaagggtgtgcacgtggacatcccgctgcaggcctacttccgcatcaacacgccgaatatgggccagttcgagcgcacgctgatcatcgctgatgaaggctcctacgtgcattacgtggaaggctgcaccgcgccgatctactccaccgactcgctgcattccggtgttgtggagatctttgtcgaaccgcatgcccgtgtgcgttacaccactgtgcagaactggtcgaacaacgtgtacaatctggtgacgcagcgcgcctacgtgcgtgagggcggcaccatggaatgggtcgacggcaacatcggctcgaaagccaccatgaagtatccggcatgcatcctcgccgagccgtacgcgaaggccagcaccatgtcgttgggtttcgcaggcaagggccaatatcaggacacgggcgcgaagatgattcacctcgccccgcataccagctccaccatcgtggcgaagtcgatttcccgtggcggcggacgttccgcataccgtggcctcgtcaaaatcgtcaagggcgcggaagggtcctccaattcgacggtctgcgacgctttgctcgtcgacgaattcagccgttccgacacgtacccgcatgtggatgtgcgtgaggacaacgtctccatggcgcatgaggccaccgtttccaaggtctctgaagaccagctgttctatctgatgagccgcggcctgtccgaagacgaggccatgggcatgatcgtgcgcggcttcgtcgaaccgatcagtcgcgagctgccgatggaatacgcgctcgaattgaaccgtttggtggaattgcagatggaagggtcggtgggctgatcaccatggcacaaactcaggaaatcaatatccccgtcgcggatccgtccgatccgtacgcgaacccggcggccatgccgtcgtccgcggaccgcgctccacgctcattcgacatcgaagcgttcgccaagccggaccgcaaacaggaggactggcgctacacgccgatagagcgcatcgaggagttcttcgatgtgttcgaaccatccaatgaaacgcaggtcaccgtttccatgatcgacgggtcgccgcttgccgaaggcgtcacgtatgccgaaggcacggtgggggacaccggcacaggcatcgtctccaagccgaacgaccgtgtgtccgcagtcgaatggaattccggcaaacgcgctggaatactgaccatcgacggtgagatcgaccagccggtgctcgtcaaaatgcatggcaccggcagggacctcgacgcgttccacctgtcgatcatcgcagccgaccgcgcccatgccgacgtggtcgtcgaacatgacggcgacgcacgtctcgccgaaggcgtggaaatcaccacaggcaaggactcccacatttccaccaccttcatccaggaatggaacaaggactccaaacacgtcggcaaccagcgcatccacgtgggcgaggaggcgtccctgcgccattccgtggtcaccctcggtggtgatgtcgtgcgcattcgcatggaccaggacttcggcggcgaacagggcgacctcaacatgctcggcatctacttcgtggacccgggcgagcatatcgaacaccgcacgatggtggtgcataaccatcccgaatgcaagagccgcgtggtctacaagggcgcgctcgacggcaagggagcgcactccacatgggtcggcaacgcgctgatcgagcctaccgcgccgggcaccgactcctacgagctcaaccgcaatctggtgctcaccccaggtgccatcgccgattccgagccgaatctggaaatcgaaaacggcaacatcatcggtgccggccacgcctcatccgtcggacgattcgacgacgaagagctgttctacctcgaatcgcgcggcatctcggaaaacgaggcacgcaagctcgtggtgcgtggcttcttcggcgagctcgtcgaggaaatcggcattccggcgatttccgagcatcttatgaacgtcatcgacaagcgcctggcccgcggcgaaagcgacgcgatcgcacaggtattggaagagaaataatcgtcaggagaaaccatgtcaacccttgaaatcaaagatctgtacgcgcacgtcgaaaccaaggacggcatcaagccgattctcaaaggcgtgaacctgaccgtcaactccggtgaaacccatgccatcatgggccccaacggttccggcaaatccaccctggcatacacgctggccggccacccgaagtacatcgtcgactccggccaggtgctgctcgacggcgaggacatcctcaagatgaccccggacgagcgagccaaggcgggcatcttcctggccatgcagtacccggtcgaagtgccgggcgtgtccatgaccaacttcctgcgcaccgccaaaaccgaagtggacggcaaggcgccggccatccgtacatggacgaaggaactgtccgaagccatgaagcggctcaagatggacccgaagttcgccacccgttccgtgaacgaaggcttctccggcggtgagaagaagcgcgcggaagtgctgcagctcgaactgctcaagccgaagttcgccatcctcgacgaaaccgactccggcctcgacgtcgacgcgctgcgcatcgtttccgaaggtgtgaaccgtgccaaggaagccaaccagttcggcatcctcatggtcacccactacacccgcatcctgcgttacatcaagccggacatcgtgcacgtgttcgccgacggccacttcatcaagaccggcggtccggaactcgccgacgagcttgaggagaccggctacgacgcatacctgccggaaggctccgattcggaaagcgcattggcatgaccgatttcgcagcgatccgcagccaatttccgattctcgaccaggaaatccacggccatccgctggtatacctcgattccgccgcgacatcgcagaagccgcagtgcgtgatcgacgcggaatcggacttctaccgcaccatcaacgccggagtgcaccgaggcgcgcatgagcttgccgcgcgtagcaccatggcgttcgagaatgcgcgcgccaaagtggccaagctggttggcgccgattcggcggaaggcgaagaggagatcgtcgtcaccgccggcgccaccgcaggactgaacctgttggccaccgcattcggcaacgcgtcgcttggacgcgggggagaggccgccaagcgtttcgcgttgaaaccgggcgatgagatcgtcgtcaccaaggcggaacaccattccgtgctgctgccgttccaggaacttgcgctgcgcaccggcgccacgctcaaatggttcgacttggacgaggaaggccgtgtgcgttccgacaccgcgaacgaagtaatcaccgaccgcacgaagatcgttgccgtcacgcatgtgggcaataccacaggagcgattaccgacatcgcgccgattatccgccgcgcccacgaggtgggtgccgtgttcgtgctcgacgcatgccagtccgtgccgcacctcaaagtggatttccacgctttggacgtcgatttcgccgcatggagcgcccacaaaatgtatggcccgaccggcgtcggattcctctatggcaagcgtgaaatgcttgaggcattgcctccggccaatttcggcggatccatggtggagcttgcctggatggaccaggaagcccagtacatggagcctcccgcacgattcgaagcgggcacgcagccggtggcacaggtcgtcgccgccggtgtcgccgccgaatggctgatgaacatcggcatggaaaacctcgaggcgcacgaacgcaccatcaccgacgaactgctcaaaatgggcgatatcgacggcatccgaatcctcggaccccgctccaacaaggagcgcatcggtaccgtcgcgttcgaagtcgaaggcgtgcacccgcacgacgtcggccagttcatcgacgcgcagggcatcgccatccgcgtcggacaccactgcgcgcagccggtgcaccgacacttcggcgtgtatgcctccaaccgcgcgtccagcggcatctacaattcggtcgaagacgcgcaggccctcatcgaggcgctcggcaaagttcgtccgttctttggagttgagtaacgaaatatgagtgattttgagatgtccggaagcgaccttgagcagatgtaccaggaagtcatcctcgaagccgcgaagaacccgcacggcaaggagcatttcgcacctgacctcgcttcggaaaatgcctcgcatgccgccgaaaccacggtgcagaccagccacgaatactgcacgccgggagaatcgcaccaattcaacccgacctgtggtgacgaggccaccatccatgccgaagtctccgatgccgagccatacaccatcgaacggctcgtatgggatggccacggatgctccatctcccaagccagcctgtccgtcatggtcgatctcgtcgaaggcaaaaccgtggacgaggccatgaaacttgccgaaaccttccataagcttatggagtcacgcggcaaaggactgaatgacgaacaggccgaggaatccttggaggacggcatcgtcttccaaggggtctcccagtatccgatgcgcatcaaatgcgcgctgctcggctgggagggcatgaaggacgccgtggccaaggctctggccgcgaaagcctgagccttcaactcggcgtttggaaaaacactagtgacaaaccccaagcgacgcgctattcttgctcaacagatacaagcaacgtccatcaacagtttggagagacaatgagcgacaccctggtacccgaaccgcaggcgtcgatcttcgattccgtgaccaaggccttgggcaacgatgaggacgcggcccgtcgcgtcatgctcaatccgaacctggccaaagggttcaaggacggcaaaccggtgaacaaggaatccaaaaaagacgggcaggacatttgcggctgcggcaatcatgccgacgcgtgcggatgctcccaaccgcaggatgacgacattccgctgaaagccgtcgacgatatcggacgtgccacggcagctgacgtgaaagaagccctgcaccaggtcatcgacccggaactcggcatcgacgtcatcgaccttggtctggtttacggcatcgaaatcgacgaactgggccgagccatcatcacgatgacgctcaccacgccggcctgcccgctgaccgacctgatcgaagacgaatgcgccagcaccctcgccggtctcgtcgaagaattccgcatcgactggacctggcaacctcgttggacgatggacaagatcacgccggaaggccgtgaccagctcgccgcgctcggcttcaatttcgacaatctgccgaaatactgacgtttgctgcggttgccgtgcagtgaaccgcagccgccaaacgtaagaaaaacggaacaacatacgaaaggcgcgcctcccgaacggggaagcgcgcctttcgtattacgacgtatgtcagtcgtcgaccacggtacccttcggcaccacggtgatgccttccggcgtgacggtgaagccacgcgccaaatcatgctcggtatcgatgccaacggtcgaattctccgtcaacacgacgttcttgtcgagaatcgccttgtagacccgcgcgcgacggttgacgaccacaccgtcgaacagaatcgaatcgacgacctgagaccacgaatggatgcgcacgttcggcgacaggacggaatggtgcacctcgccgccggaaacgatgacgccgggggagacgatcgaatcggtggcatggcccaggcggtcgcggccggcatgcacgaacttcgccggcggcaggttgccggacagcgtgtagataggccattcggtgttgtacaggttgaactccggcacataggagatcagatccatatgcgcatcgtagaactgcttcagcgtgcccacgtcacgccagtaggcgtggtcggtcggtgtggctcccggaatctcgttggaattgaaatcgtagacgccggcctcgttgcgtgccgcgaaatacggcgcgatgtcgccgcccatatcatgcttcgtatcctcggccttctcatccaacgaaagcgccgcgaacaaggcatcggtgttggccacatagttgcccatggaggccaggatggaattcgggtcgtccggcagtcccgtggtggtctgcggcttctcctggaagctcttgatcatattcggatgatcgggatcgacctcgatcacaccgaactggttggactggctgatgggctgacggatgccggcaacggtgaattccgcgccggattcgatgtgctgctgcaccatctgctggaaatccatgcgatagacatggtcggcgccgacaatcaccacgatgtcgggctgcacgtcctcaatgatgttgatggtctggtagatggcgtcggccgagccgagataccaatgcttgccgagacgctgctgcgccggcacaggggagacgtagttgcccaacagcggcgagaaacgccatacagtggagatatggcggtcaagcgaatgggacttgtactgggtaagcacgaccgtctgcatgtagccggaattcaccagattgctcagcggaaaatcaatcagacggaacacgccgccgaatgggacggcaggcttggccctgtccctggtcaatggcatcagacgggtgccctcaccgcctgccagcacgatggaaagaatctttgggttcttcgccatgggaactcctctctgagagcgtcttgcgacaccgtacgcacggtcggtccgcttcatcacgaaaccgcttacgcacactatgattgcataaattcagcaaatcgcaaggagtttgcagcgcgagtcttgaaaatttccagttcgtttcagcaacgtttcaccatgcgttcatgcgcgtctcacgcatgatggtccactcgacgcgtcgcatagaaggcgaccgcgcttgatgcggcgacattgagactgtccacgccgtggctcatgggaatcttcaccgtaaggtcggcgcgggagatggtgtggtgcgacagtccatctccttcggtaccgaaaatcaacgcgagcttgtcaatatggtcgctttcagtctcggcgttgttgagacggcggaccaattcggccaaagaaatggaatcatcctcaagcgccatcgctacggtggtgaaccccagatcatgcagttcccgcatgccggtgaacggccaataatgcttgtcgtcccctccgatgcgcgtccacggcacttggaacaccgtgcccatggacacgcgtgccgcgcgccggtacaacgggtcgccacaggacggagtgacgagcaccgcatccacgtcgagcgccgcagccgaacgcatgagagcgcccacattcgtgtggtcgacgatattctccatgaccgcgacccggcgagcgccacggcagacctcttcgacgctgggcagggaccagcgtttcatcgcggcaagggctccgcgatgcagccggtagccggttagacgtttgagctgctcaggcgaagcgacatacacgggaatgccatcgccccaacgtttctcgatgacatcgaacatgccgctcatgccgtcgatccacgactcctcgaccagcagggaaatcggctcgcgtccagcggccagggcacggtctatcactttgggcgattcggcgatgaacaatcccttgctgggctccagcctgttgcgcagctggatttccgtgagattcacataagccgccacacgctcgtcgtcgatggagtcaagatgaatgaaccgcattgcccgtattccgccaatctttcgtcagatacaagaaaaccccttgtctccaaggggtttattccggtgtccggagcgggacttgaacccgcacgcctgtataaaataggcactagcacctcaagctagcgcgtctaccattccgccacccggacaggtgcgttgctcagcggcaacgaatgaaaactatagcagttgaaatccatgatgcaaatcctggcgtgtcgcgataggtccgatatgggttatgtggggttcctgataggctcggaagctatgactgatgccctttttctgcttgatacggaccatgacgacgtaccggtgaacagcgacgagctcaacgccggatggaggctgacgcttccctcatccgtacgcaggcacgccatccaggccatgcgattgaaggacggcgacgaactgcagctttccgacggcaggggattgcgcatccacgccgtactgcgcgacgcgcagcagggaatcgcggaagtgctgcgattcggcaaggagccgcagccggtcaccaggctcgcgctggtgcaggctctcgccaaaaccggccatgacgagcaggcgatcgatatggccacgcagatcggcgtcgatcaggtgattccctggcaggccgaccgttccatcgccaaatggaaggcaggacgtactgacaaaaagtggaggcaggtgctggaatccgccaccgaacagtcgcgcagatcgtggacgccccagctggacgattgcgtgaccagcaagcaggtggtcgccatctgcaagcgcgcatgcgtgcatggcgacatggtgatcgtgctgcatcaagatgccacgaagacctgggaacaactggaaaccggtatcgccaaactgtccgatacgtgtctgaaggacggacgtccgcgcaccatatatgtgctcgtcggtccggaaggcggcatcagcgacgccgaagtcgaggcgttcacgaaagccggcgccgaagtgtgcgtgctgggaagcaacatcctacgtgcgtccaccgccggtccggtcgcgctgtcattgctcgcgcgagcattgggacgtttcgtctgatcccggctccattgcgtgaaattgccggaatcgccccgtttcctgctggtgtagcatggtagcgaaggtttttccaataccgataaggagcgttatgagcgacaaggattgcctgttctgcaagattatcgcaggtgagattcccagcgagaaggtgtacgaggacgatgccacctacgccttcaaggacatcaatccgaaagccaaggtgcacgtactgatcgtgccgcgcaagcactacgcgaacgtcgccgaactcgccaaagaggatccggcacagctcgcccacatggccgaagtggcgcagaaaatcgccgaccaggagttccatggcgccttccgtctgatcttcaacaccggaatcgacgccggacagaccgtgttccacgtgcacgcccacgtgcttaccggcgaaaagctcgacgaatagtccacatactgcctaccgccaataccgacatcggaagaggttctgtgcccaccactacacgcaccatcgcgataccccaacagcttgatccggtgaccgtgctcggccctgtggacgaggtgcttcgggaagtcgaacgtgcgttccccgacctgaccatcatcgtacggggcaaccgcatcgccatcatgtcgcattccagcaaatccgaatcccaagccgcccaagccgaacaggtggttgccgatatcatccaagccgcctataccgcgccgatggacgccgataccgtccgtcgcatgctcgaccagaacgtgcttaaaaatccggtccgcgccacacatcccggccacggccgcgtggtggaggaattgcgcatggccggcaggcaacagtcgcacgcgtcccatcgtgaggaaaccgcagacaggcggcgtcctcacgtgccgggcgtcatcaccttcgcgctcggcaaaccggtccgtgccaaaaccgccggacagatagcctacgtcaacgccatcgaatcgcacaccatcaccttcgccatcggaccggcaggcaccggcaaaacctatcttgccgtagccaaagcggtacgtgctttccaagacaggcaggtccggcgcatcatactgacccgtcccgccgtcgaagcaggggagaacctcggcttcctgccgggcacgctcaacgaaaaggtcgacccgtacctgcgaccgctgtacgacgcgctgtccgacatgctcggagcggaccagctcaagcgatacatggacgacggcaccatcgaagtggcgccgctcgcctacatgcgcggccgcacgctcaacgacgcgttcgtgatcctcgacgaggcccagaacaccaccgaacagcagatgaagatgttcctgacccgactgggattcaacaccaaaatggtcatcaccggcgacgtgacccaagtggatctgaccgtgccgaaatcaggtctggccaccatcgaacgcatcctcgacggcatcgacgacatcgccttcgcccacctgaagcccgaagacgtggtccgccacgcgctcgtgggcaaaatcgtcgccgcctacgacaggcacacggccatagcgggagaccacagcagaagcgcgcgtgccgcatcatcgcaaccattcgacgacaagaacaaggaaaacgcataaatgagcgttgaagtgacgaacgaaaccgcctggcagatcgacggcaaaatcttttccgacctcggcgtatgggtcatgagccagatgagggtcagcacacaatccgacctgaccatcatgttcgtggacccggatcccatcgcccaactgcacatgcgttggatgaacctcgaaggccccaccgacgtcatgagcttcccaatggacgaactgcgccccggagacggcggaaccgaaatggaaggcgtgctgggcgacatcgtgctatgcccgtgggtggccgcccagcaggcgctcgcggccggccacagcaccatggaggaaatgatgctgctgaccatccacggcatcctccacctgctcggatacgaccatgtcacacccgaacaggaacggcagatgttcggcttgcaacgccagctgctattgacgttcttcgcgcttcgacagggagccggcgcgcgggcgacgcttcccgccggcacgccggatgcgctcgccgaatgggaccgcgaacacggggccggcggcaaaacggccaaatgacggcatgatgcatcatccgacggtttcgaaagtgggggttgacgaaccatggaaacaacgactatcacgatgattgcgattctcgtcgtcatcgcattgctgctggtctggctgtcgctgtcgatggccgcgacggaaggcgcggtgggacgtgtcacgagggcaagtctgaacaacctcattcttgagattcagacggatacggaggcgtcgcaattcatacgcgacaagaagatcaaacgcatccacaaggtgcagcggctgatcgccgaccgctacgcgaccgccggttcatgcgcgttcttccgcatcacctgcaatgtgcttgacggtgtgttggtcgccgcgatcgcgtcgttgtgcgatgcgccgttatgggcgggactgcttgtcggcttcgtgttcgcgctggtggtcgcggtgatttcgctgctggtccgtccacgtagcgcgggcgcctccaaaccggtcgatctgatgctgaagcatgccgatgcggcgtcggtcgcggtggctttgacgccattcgctaaaatcggcggacagaaggatgcgaaacgtcattcgaatgatctgtcggacgatgaggagcttgaaaaaatccaactcgaacaagggcgcgccaccatagatcgtctggtcgaggcgaatgatttcgaccctgaggtttccgaaatgctgcgcaacgtattgacgttgtccgaaacgttgacgcgtgagatcatggtgccgcgcactgatatgatttgcatcgaacgcggggagacgctggagaacatgctgaaattgtgctcccgttccggattctcccgtataccggtcatcggcgatgatgtggatgatctggtcggcgtggcatacctgaaggatgccgtgcgcgccacggcgttcaatcccgcggcgatatcccgcgatgtcgaatccatcgtccgtgacccgatgctggtgcccgaatccaagccggtcgacgacctgttccaccagatgcagcgcacccgccagcatgtggctatcgtcgtggatgaatacggcggcatcgccggcctggtcaccatcgaagacaccatcgaacagatcgtcggcgaactggaggacgagcacgaccgtacccagcatgccgatccggaacaaatcggcgagaacaaatggagcatgccggcacgcacgcccatcgccgacttggaggagatcttcgaaatcgacatcgacgaggacgacgtcgacacggtatacggtctgctcaccaagctgcttggccgcgtgccgatcgtcggttcgacggccgtcaccaggggcctgcgcctgaccgcggtcgactccgcgggacgccgcaagaaagtgtccaccatcgtggtggaaccggcccacgtcgagggcgtggacgaaactgaacaacacgaagaccatacgaacggtgccgaagaggcatcccatgacgacaaggattccaaggacaagcatgactgacgcagatgtgaccgaaccggcttcccagcattccgacgccgaagcccccgttccatatcgttccggcttcgtcgtggtggtcggacgtccgaacgtcggcaaatcgacgctgatcaacgcgcttatcggcacgcagatcgccatcgcctcatcccgtccggagactacacgtaaggccatccgcggcattctgaccacagacaacgcgcagatcgtgctggtcgatacccccggtatccaccgtccgcgtacgctgctcggacagcggctgaacgatgtcgtcgacgaatcgctatccgatgtcgacgcgatcgccttcctgctgcccgccgaccaggaaatcggccccggcgacaaacgcattctgagcaggctgcgttctgatttcgccgtcaaacgcgacgacggcacattcaaatggaaggtgccgctgatcgccatcgtcaccaaaatcgacgaattggaccgaagcgctttgatcgacaagctcatcgaaatcaacgagttcgccgacttcaccgacattgtgccggtgagcgccctcgagcacgacaatctcgccgaagtacgcaacgtgctggtggagaacatgcccgaaggaccgcagatgtatccggccgagcaaatcaccgaagaacgtccggaagacaccatcgccgaactgattcgaggcgcgttcctggaggaattggatgacgagctgccgcattcgctcgccgtggtggtggattccatcgaatatccggaagacaacgacagcggcgaatcctacgcgggcaaggcgcaggtgattgtgtcgatctacgtggaacgtgattcgcagaagccgatcatcatcggacataacgcggagcatctggtacgcgtcaagaagaagctgcgcaccgcggtcaaccgcatcgtcgggcagaaggccaagctcgacctgcatgtcaaggtggccaagggatggcagtcggatcctaagcagcttgagaagctgggcttctaagccgcttaggatccgcttcgcggcgaagctgctcacttcgcctacggtcaacccactgggctgcccgtttgacggctcagccaagcagcttgagaagctgggcttctgattttttccgggtgggaacaataaagcctgccgctgtttatgcggcaggctttcttatgctctaagcttgttggtgctggatggtcacttcttcttggtgtacatttgcgtgttcagcagggtggcgtaacgcttgatcaccttcggacggatgaccttcatggaagcggtcatcaaaccgttctcctgtgtgaactcctccggcaggatgatgaacttacgcacggattcggcacgggacacgccctcattggcctgatcgacccacttctggacttcggcgcggacggccgcgttgctggaggcctcctccatcgacatatctcggttgagacccttgctttccagccatggacgcaacgcttcctcgtcaagcgtgatcagcgcggagatgaacggacgcttgtcgccaagcaccaacgcctgagagacgaattcgcaacgcttgatgacatcctcgatcgggccaggggagacgttcttgccgccggcggtgatgatgagatccttcttgcgtccgatgatgtacaggaagccatcgtcgtcaatgcggcccaagtcgccggtcttgtaccagccatcctcggtaaaggaatcctcggtggcctcgccgttcttatggtacttcgggaacaccgaagcgcccttgacctgaatctccccatcctcggcgatacgcagctcgaaaccagggaacgcgatgccgacggaaccctgatgatacggcacgccaagcacgttgaacgcgcacggcgcggtggtttcggtcaatccgtagccttcgtagaccggcacgccggcaccacggaagaacgccaacaactccggatcaagcggcgcaccgcccgcgacgatccacttggcgcgtccgccgagcacctcacgcagcgaggcatagaccaccggatcgaacgccgcgcgacgtgccttggtaagcgttccggtcttccccttggtgctgacttccttcatataattctgcgcggcgaccacggctgcggcgaaagcaacgcccttggcgccatgaccggccttctgggaagcagcgttgtacaccttctccagcacacgcggaacaacgatcatgatggtcggcttggccacctgcaaatcggcggtcaatgtcttgatgccctgcgcgatataaatatgcagattgcttgctacgcagatgtagttgatggcacgggcgaaggaatgcgcctgaggcaggaacagcaggacggtgttcttcttgtcatgcagcagttccggcatataatcgggcagattgaacgcggtggcgcaataatgctcatgcgtcatctccacgcccttcggcgcggcggtcgaaccggacgtgtacacaatggagcacagatcggtcttctgcacggaatcgattcgcgcatcgagcgcctcatcgctcacaccggagccatacgccttgatctcgtcaagaccaccggtctcgaagcagacgatgtgctccaaagtcgggcattcggtttcggccccgtccgccttcgccttcatatcagtggtttccacgaccagcagacgcgcatcggaattgttgacgatattgcggatctgctcggcggaatcggtatcgtaaatcgtggcgagcacgccgccgcaggccatgacggccgcgtcgaacacatcccaatcgtaggaggtgcggcacatgaaagccacgccatcgcccttcttcaaaccataatgcagcaagcccttcgcgacggcgcggatgtcggcgagcgtctcatttgcggtcttggtgtgccaatcgccatcttgcttgaacgtgtacaatggttcgtcgcccatacgagcggcgcggtcggcgtagatatcgtagatggaggtgccttcgtctagcggcggattgccctctgtcttcgtggtcaacagtccggtttcagggtcaaggaacgtggtggacgggtatcccggtccccattcagcggtgtgcggcagctcgatatggccatcgggggagaggatgctgttcgggtcgttgtaatccggtgtattgccggaatcgtcgctgaccgggtgcacgaaatcgttgcccaagcgcaacgccttccttgcgagattagtggcctgcttgttcaacgaggtgatgatggacacgtgactctcctacgtatataaacggtatctaaagaaggaatgatagcccgtcgcgcgcgacacgtcaccttacggtagcgtaaggtgacaggccatcagggaaacgggcggcgcatgccggatacagcccgtgattcgaaagatgaacgattgcggccgcgatgttgccgtgtacgttacacttgggcgctgtatctgttcattagatttctttaacgaggaagaaagggcacctatggctgaaaaagctgaagccaccgtggtcttcggagttctcaacgagacttccgaacacgagtcccgtgttgctctgacaccggatatcgtaacgaggttgcgtaaatcaggtgttacatgtctgattgagtccggtgcgggcgtcgcatcgcactacgttgatgaagattatacgaaggcgggcgcgcaggtcgtctccgccgacgatgtgatcgcacgcgccgacgcgctgggttttgtggatcgtccaagcaatgagctgctcgcccgcgtcaagcagggcacatggatcattggcatgttgggatcgttcaccgatgccgattacgtcgccgcgatcgagaaggccggtctggtcggcgtcgccatggaaaagctgccgcgtcagctgagctccgcgcagtccatggacgaaatgacgtcgcagaactccgtgatgggctacaaggccgccatcgtggcagccaacgcgtacggttccttcctgccgatgatgaccaccgccgctggcaccatccgcccggccaaggtgcttattctgggcgccggtatcgccggcctgcaggccatcggcaccgccaagcgtctcggcgccgtcgtcaccgcgtacgacgtgcgtccggcatccaagggcgaagtcgaatccttgggcgccaagttcctcgaccttggtcttgacttctccaagggccagggcgaaggcggctacgcacgcgcgctgagcgccgaagagcaggcccagcaacaggccgcggtcgatcagaaggccgccggcttcgacatcgtcatcaccaccgccaaagtgccgggacgcaagcctccggtccttctgaccaaggccggtgtggccggtctgcatcgtggcgccgtcatcgtcgattgcgcggcaagcgaccttggcggcaacgtcgaaggctcctccgtcggcacccaggtcaccgacaacggcgtgaccatcatcggcgccccgtatctggccagcggcgtgtccaccaccgcatccaacctgctgagccgcaacgtggccgacgtgctggcgcatttcgtgcgtgacggcaagctcgccatcgacctgaacgaagagctcgacaacgccatggtcgtggccggccgcggcgaggaagccgagaaggaagaggagtaaagcaatggatatcgtcgttgcgatcacactgttcgtcctcgcgctgctcatcggcgtcgaggtcatcggcaaggtgcccgccaccctgcacaccccgctgatgtcgggcgccaactccatccacggcatcgtcatcgcgggcgtcgtcatcgtcgccgcgcacgccaccagtccgctcgcctgggtgttcatcttcctggccgccgtgctgggcacgatgaacgtcgtcggcggctacgtcgtcaccgaccgcatgctggagatgttcaagtccgacaagggcaagaagaaggaagaggaggccaagtaaatgggtaccctggccgaaatgctgagcacgccgctcggcgtcatcgaatggttcgtctatctgctggccgcagtgatgttcgtcatcggcctgcacctgatgaactccccgaagaccgcccgcaagggcaacatggtctccgccatcggcatggtgttcgccgtggccatggccttcatcgtgctgttcgcaggtgaggcctccaacggtttcaagcatggcgtcgcagtcatcgtgctgattgtcggcatcgtcatcggcgccgtggcgggcgtggtctccgccaagaaggtcaagatgaccgacatgccgcagctggtctccgtgttcaacaccgtgggcggtggcgccgccgcgctcgtggcattgaacgacatcctgacctccgccgaaaccccatccatcgtggtgctcatcaccgcgggtctgggcatcatgatcggctccgtcaccttctccggctcgctgatcgcagccggcaagctgcagggcatcaagtgggtcaagaagctgagcctgccgggcaagggtttctggaacatcctgttcgtcgtgctcaccatcgtgtccttcgtgatgttgtgcgtgcagccgaaccagcgtctgctctggtcgatcctgaccaccgtgttcgccctgtgctacggcctcgtgttcgtcatcccgatcggcggcgctgatatgccggtcgtcatctccgtgttgaacgcctgcaccggcaccgcagtggccatgtccggtctgaccatcaacaacatcgccctgatcgtggccggcgcgctcgtcggtgcggcgggcgtgaccctgtccatcgccatgtccaaggctatgaaccgtccgctgctgtccgtcttggctggtggcttcggcggctccaattctgcggcgggcgccggagaggggctggagggcaccatgaaggaaacctccgccgacgatctggccgtccagctcgtctacgcagagaaggtcatcttcgtgccgggcttcggtctggcccaggcccaggcccagcgtgagctcgctgaccttggcaccctgctcaaggaccatggtgtcgaagtctcctacgccatccatccggtggcaggccgtatgcctggccatatgaacgtgctactcgccgaggccaacgtcccgtatgaggagctcgtcgacctggatgacatcaatccgcagttcccgcaggccaacgtggctctggtggtcggcgccaacgacgtgaccaatccggccgcccgcaagccgggcaccccggtttccggcatgccgattctcgacgtcgacaaggcgcagaacgtggtggtcatgaagcgtggccgtggcaccggttatgccggcatccagaacgagctgtacttcgaagacaacacgcagatgctgtttggtgacgccaaggcgagtctgcaggccgtcatcgcagcggtcaaggaactcatcaactgacggaccggctcgtcgcctacgcgaagatcaggcccttcctctttttggaggaagggccttttgttattgcgcaagttgtccacagacaggtatgggggtgtggataggtggaaattgtccacttattcacttttttcaaaggattgtgacggagaggtggacggatatgcgacagtaggtgcatctctacgacgaaggagttgcatatgacagttgccgtggccacgccattcaatatggacgaacaggctttcctgcaaacgatggatcggctgatcgagcgcttcgaccggtacagctcggggcgttgtttcgcggaccttgatcggatacgtctcgaacacgatatggaaggtccgctttccctgttcgatgacgtggtgcacgagcttgcggatgacttgttcggcggcacgtcatggccggtgaatctcgacatggatatgatcatattggatcggttccaaataggctatgatgccgaattcttgaccggatgccgcaatgtggttcgtaaatacggcatgagcgcatggctgtatgaaatgattaatgatgcttccgtcgcggtggcgacgcatcggccgagcaacaggatgccgttccagcttggtctgttcgatacacgtgaggtgttccgaaggaaaaagaccaaggggaagaagagcggaggcggaaggaggaaacggctcgaatgcatgatggaatacctgcgacagacctaccgtctggccgcatacactctgttgcgatggggagggggcgagcctagggccgctgatgcggcgctgatggttctcgcttatgggggattgggtatgtgtatgctccgcgatgatccgaaagtggtcgaattgggatgtgatcccgatttccgatacaggcatgtatgcgcccagttgcaggatatgcggatcaaggcggatctggaatatgcctgttctgtggatctgagcgtcaccagctcattggaatatccggcttgcctcgatgccagatatctgtatgacgccgaacacattgtggaggcatatcggaatctgtgggatgagaacactaagcccgtcgcccaactactggccgagatcgaggacaatggcgtatatgaagtggaggatatatggaaagacccgctctatctgcatgaccttgccatctcccttatggggccgtcggcttcgggtcttctccaggaaggcttcagactgcgtgatcgaaccatgttcgagaatggtgtcaaagaacttgacagccaggcacgcaatgtgaggaaggctggtctgctgcttacccttgccggatatatctttttcgccgaaccggaggatcgcatggatgcgatgctcgcttcgcacaaggatcgcaaacgcatgttggacaactatgaaaagcttggcgaaatggccgcgaccatcgccttgtaccgtcttcctcgggatcgcgaatcgcttcgggcagtgcgggccctgctcatgcatgagacgggcgtgtacgcggacaagatgggagagctcatgggtctcgccgacgagccggacggggaagacgaagccaccgctccggtcatggggtgaaagacggttttccgcatattggacatgacaatgctttgggattgactctacaaccattgtaaggtttagccttcctgctggaagacataggccgaaacgggaggataagagacaacccatgggaaagaacctgacaacgggaagcgtgttcagaacgatcgtcaccttcgcgttgccgtatctgctgtcgtatttcctgcagacgctgtacggcatggccgatctgttcatcgccggacagttcatcggcatcgacggcatcaccgcggtggcgaacggcagccaggtgctgtacatgctcaccgtggtcatcgtgggtcttgccatgggcgcgaccgtcaccatcggccgtgcggtcggcgcgaacaggctcgaccgtgcggccaaggccatcggcaacgtcatcacgctgttcgcaggaatcgcgttggcgctgacggtcgttctgctgttgaacgtgcacaacatcatctcgctgatcggcgtgccagtcgaagccgtcgagggaaccgcgcagtatctgaccatctgctatatcggcatcccgttcatcgtcgcgtacaacattatcagctcggtgttccgtgggatgggcgattcgaaaagccccatgtatttcattgcggttgcatgcttctgcaacatcgtgttcgactacctgtttatgggctggctgcgtcttggtccctcgggcgcggcattgggcaccacactggcgcaggccatcagtgtgaccgtgacattggtggcgattcgccgccggcgtacgggcatcagactgaagttcggcgatcttcgccccgatagggccatgctccgcggcattctcggcatcggagtgccgacggcggttcaggacggctgcatccagatcgccttcatcatcatcacggtcatcgccaactaccgtggcctgaacgatgcggcagctgtcggcgtcgtcgaaaaggtgatcagcgcgttgttcctggtaccgtcgtccatgctggccacggtatccgccgtctcggcgcagaacatcggtgccagcaggatggagcgagcgacgaagacactgcgatacgccaccgcgatcaccgtcgtctacggcatcgtcatatcgattgtggtggaactgacggcgggctccatcgtcggcctgttcaccaccgatgcgacggtaatcctgctgggaacacagtacatccgcagctacatcgtcgacagcatcttcgcgggcatccacttctgcttcagcggcttcttcgccgcatgcgggcgctcctatatcggattcatccacaatatcgtggccatcaccctggtccgtgtgcccggggcgtatctggcatccaagctgttcccgaacaccttgttccccatgggcgtcgccgcgcccgccggatcgctgctttccgtgctgatctgtcttggcttctacgcgtggctcaagcgtcacggcgtaatttcggagaaggcgcgtgcatgacggcgagtgagcgaagtggagggcgcgacgctttgccgggtgacggcagactgttccgtataggcaaggttgcagatatgttcaatgtgtcgctgggcacgcttcggcattatgagcgttgcggcttgctggaacccgaatatatcgacccgcgcaccgggtaccggtattacggtgccaagcagttcgaggtgctgaacacaatccggtacctgcgtgtgctggatatgccgttgacgcagatagccgagttcctgcacaatcgcgacgtgcatgtcatcgaggacaagcttgttgcacagaaagccctgatcgagcgcaaacagcatgagctggaaatggtccagcggaagatcgaccatcgcttggagcggctgcgggacgctgagcagtccgaattcgacgtgatacgtgttgtgcggcaacccgcctgcaggatcgtctggatcagggattcaccgaaggtcgactcgtatctcggcctggaatattcgatccgcaagctggagcagcatcagaaggattcgctggtcttcctcggcaaggtcggcgtcggcattgacaaggaatcgttggaacagggcggatatgccgattacgggttggtgttcctattgcttgacgacgaggacgaatatgagggcgacaccgtggcattgccggagaccgattgcgtgcgcatccggttccgggggagtcatggcgatgcccccgaccggtatcgcgagctgatatggtacaccgcagagcagggtctcgacatcaccgggttctcacgtgagatcgcgttgatcgatgaagggttgacatcggatcccgcccagttcgtgaccgagatctgcatcccggtgcgctagccactttccggcgacgtgtggcgctacttggctttctccttcagagtcggcgcaagggtgccggccagcgcgcgctcgcccggcctggccaatgggccgaccagttcatgcgccgtgtacggctcctcaagataggcgatgtcggattcgctgagttttactccaagtgcttcgatgacatcatccacgcgctccgtcttcgagcagccgacgatcggtgccgtgacgtccttggcccaatgccaggcgagggcgatccgcgccatcggcacgccgagccgttccgcgagcccgtgcacgcgttcgatgatcggcatatcctgcgcacgtgcctgatcgtacttgttgcgcatggtgccgtcggtggtgccgcgtttggaatcggaatcccaggacggatgggtcagatggccggacgccatggggagtatggggtgagcgccatgttgtactgacggctgttcggtggcgtcggcatcgatggtccactgatggaattacggggaggtcttgccgaaactcataccgccaaggcagaccttggaaacttggatgccggaccatcccagtggggcgtagctcatgtcagtcatactgaagctcttctgccgttgatgttcggaaggtcagcatatcccgtttcgattggcagaaccaatacctcgcatgaatggtttgatatgcaatcgacgcatggaacgatataccatactcacattggacattctttttcgccgggcgttgaatagggaacggtacagagcataaatgaaaggacgggtcgacaatggaaaatccgagcgcattcccgatgggagaaccgaacgacggcttcgcgcagtacttcgtgggacagagctaccttgctccggtgctcgagactccgcagattgccatccataacgtgaccttcgagccgggttgccgcaacaactggcacatccatcacaacgcggcgcaggtactcatcgcggtcggcggttgcggctactaccagatcgagggacaggagccaaaggagctcaaggccgggcaggccgtctgcatccccgcggatacgaagcactggcatggcgccgcccccggcgaatcatgctcgcatctagccttcatggtccctgcgggcgatccggcatccatgagcaacgaatggctcgagccggtggatgccgaagcctacggcaaacttgcctgaggtctgttgttcttatatggagggccatcctgcaaaagtgggatggccctttttgttgttcagggcgataacggtttgaagccttgcggcgagtggcgtcatgcgaggaaatccgcaagcagattgcacaagtagcttgtgtaagtgctatggtggccagctggaggcaatcgaaatggatacgaaagacgaatattcgacatcggatgtcgccatggaattggcgattgcggtcagcaggctgcaagctcggatgaagcatgaggccggcatcgcggaacggggcatcaccgcttcgcagcttgccatgttgaagcggctggataccgagggagaactgtcggtatcgactttggccgcgtacgaacacgtatcgcaacaggccatcacccagcgtcttgaactactgaggtccacagggtatgtcacacagcatgccgattcgaaagatcgtcgtcgtcgactggtcggcttgaccgatgaaggacatgcgttcctcgcccacgtaaccgctagccaaacaacttggctggcgcatgccatcgaatatgcattggatgacggcgagcgcggggacctcgccgctgcgaccacattgatcgaacgcatcgccgccacggaatcgctgccgacgggaggcgacacgcgatgaagacggctgataagacaagagaaactcccgcgtttcccaagaccttcatcatggcgatgatatttggggtcggtctcaaccctgtcaacagcacgcttatctcgacggcgctcgcaccgatttcacatgatttgcggattgatgccggaagggcgaccctgctgatatctgcgctgtacctgacatgtgccatcgcgcagccgacggcgggcaagctttctgagatcattggtcctcgctcggtgttcatggccggtgcggcattggtcatgattggaggactactgggtggtttcgccccgaatctcggcgtgctgctgacgtcgcgtgtgcttattggtgcgggcacatcctgtggctatcctgctgccatgctgctggttcgcagacgggctgatcgcatgggattggcggaaccgccttcgttggtcctttccattctcgctatggtgggactggtgctcatcgctgtcggtccaccgttgggcggcctgttggtcacctttttgggatggcgctccaccttcttcgtcaacgtgttggtcggcatcatcacgattgtgctgggattggcaagcatcgagcccgatgcgaagcatgaacatcgcatgaccgtatccttcttcatcgcgcatctcgatgtcatgggtctgttgctattctccatcacaatcagcgcgctgctgattgttcttatgagtttgcctactttcgacaaggtgtccggttgcgtcactgtcatcgctttgttggcttttgtcgcgtgggagttgcatgcggcaacgcctttcgtcgatgtgcgttcactcgcggcggatagtgcgatgacgttgaattttctgcgtgcgatgctcaccatgcttggcgcttatgtggtcatgtacgccttgccccagtggctggaggatgcctgccatatgaacgccggtgtttccggcatgttcatcattccgatgggggtggtggcgacagtggcttcgttatccatcgcgaagaagccgatagtgcgcctgccgttgatggtgtgctgttcggcgatggtggcggtgggcatgttgttggcttgcacgtcatccgctggcatggtcgtattgccgttgaccgcctccgctgtcgcgggactggtgttgggactcagcatgtcgaccagtcagaccgtgctatatcgccgagcggcatccgagcatattggcacgtcgtctggtctgctgcgcacgtccatctatatcgggtctatcggtgcgtcctcattgagtggcgtgttcttcggtgagacggtcactgatggagggctccacggcattggcatcacagttgcggttttgggggtcgccgcgctattggcgacggttatggatcgtacgttgcggtagtccggggaagttgtccgcatcgtgaatgatggtacggacggcctcgcgtgccggatatactggactgcggtgatgggactcgcctgaagccgttacaggcttcgaaccgcaaacccgctgatggttcctacgacatagggtgtgctgtaccttatggctttcagcggttgtggcatcgccattcttccatgtctgtcatattggttcggcacctcgctggaaagaagatacatggcacgacaacatatcattcgagtcgatctcatatgcgtggtgttccttgggggatgcatcggaaccgcattacgctacgcttgttcggtcattcccgactgcggcgcattccatatcggcacattcgcggcgaatatggccgcctgcttcgtatacgcggcgctttcggcatggctgggaggaacccgcagaatcgtgggacgcgcgaaggaatatgtgaaccgtggatgtggcatgggcatgtgtggaggattgtccaccatgtccactctcgccctcgaggaattcactatgctgcatgacggcaaagccatggattgtgcggcgtattgttgcacgaccttcatcgtgggctgtctgctggcatacgttggcgcgcatgtcgggctgcggtttgccggtactgagcataacgatggtgatcgccatgccatgggcaaggaggcggactgatgaataatgcggtcatcgccgtatcggtgtgcctgtgtggtggtctcggcgccgccgcaaggtatgtttgtgattccgttatcaaagcttcttggcataaggcatttcctttgtcgacctttgtgatcaacagtattgccggattcctggcaggcgtgattgcaggtctgtactcacgccggtttctgtcggatcccgcgcatgtgatgttggcgaccggcttccttggtggattctccacattctccaccatgatgaacgaatccgtgacgttgttgcgcggtgggcggatcaccgtgttcgtgggatatgtgctgacgtcggtggtggttcctgtgatggccgcggcattgggatattgccttgtcgtctgagactggagcgaggacgttgactcggggcgtcgtttcattgtctctgggtatggatggtttatggattaccgcgacgcggattggatagttttccatgaaaacgaggaaaaactattgtcttttccgtgtttcctcgatacattggtggctggccgcccatgacaatcgaaaggactgaccatgacgcagcagggcatgtcgaccaagtcgaggcatctgaccattcccgatctcatcacgataggtgtgttcactgccttgtatttcgtgctggtcgccgtggccacgctgttcagttccgtggctttgatgggattcggcatgattcttctgcctgcggtcgccgcattgatctgtggttgcgtatatatgctcctggttgccaaggtcggaaaattcggcgcgattagcgtgatgggcatcgtcgtcggattgttcttgttcgtatccggacatttcatcctttcccttgctgcgagcatcgtgtttccggtcatcgctgatgccatcgctcgcgccggggactatcggagcaagacaggtatcctggcgagttatgtcgtgttctgctatgggctgaccggtccgattctgccgttgtggttcatgaaggatgcctatgtggccagtctgcaggcccgtggcaaggactcgtcctatatcgatggtgtgttcgcacatgtcaataccggcacgtttttcattgccatgatagtggtactggtatgtgcgttgctcggaggctggtttgggcagcgtatgctgaagaagcattttgcgaagaccggcatcatctgatggccctggacccaagaaccaaactgtacctagtggcattggccaacctgttgctgttcttccatgtcgacgtggttgtggagtcgcttacagtattgctgcttcttctgccactgctcggcgcgggacgatgggcggctgcggtacgcttcggttgcatctatgtattgctactagtggggacttgggcatcgacgcttgacgatggcggcagctggttgcatatgtttggtttgctttgtgtcggcatccggatgatgatgccttgtctgattgccggcatatacgcattcaccacgactacggccagtcaattcgtgtgtgccctgcggcgcatgcgcattccggagacgattgtgattccatgtgtggtgtgcatccggttcttcccgacaatccatgacgattaccatcagattcgtgacgcgatggcattacgtggcatcgcccaggggacattcgccctgctccgtcatccggctcagtctttggaatacatcctgatgccgttgttgatgaacgctacgggggtcgcccaggatttgtccgtagccgcactgaccaaaggaatcggcattcgcgggcctcatacatgtcataccgaaatccgcatgcatggcattgattgggcatggatggtcatctgcacggttcctctggcattgggcattggaggagcatggtgagtatcggaagtgatatcaatcggatagtcgcatggacgcaacggtgctcattcgcatatcatgctgatgaagctgctgaggtcgatgcgctgaatgacatcagctgtgccataccgcaaggcgagattgccatcttatgtggacaaagcggctgtggcaaaaccacgtacacacgtttgctcaatggtctgatacctggtttctattccggcgatttgcagggcatccatatgacgtgcggaatccgcgccggattggctcctgtggaaagctatgtgggacaggtgggcagcgtattccagaatccgaagacgcagtatttcaatgccgattccaccgatgagctggcattcccctgcgagaatacgggcatgtctcccgcgcggattcggcaacgcgtgcatgatgtcgcggagcagtttcacatcaggcatctattaggtcgtaggatcatgacgctttcaggtggccagaagcaacagcttgctgtcgcggcatcgaccatgctggctcctggactcatcgttatggatgagccgacaagtaatttagatatggtggcgattcgcaggctgcatgacatggtctcccgattgagagctgatggaatgaccatcgtcattgccgaacaccgtcttgcatggtgcgcggatttagcggaccgtttcatagtgttcgatcacggtacgattctcggtgaatatgaggcgtccgattttctggcgatgtccgaacagcgcgtcgcggcattaggattgcgcgccctcgatgacagaccatacaggcttgccgtgcatcgtaaactccaacatggaggcattgcgcccgacgaggacaagcgacaggtcgtcattggtgtgcgcggcctgagtgtaggccatacaaagcggggacttctaggccgcaagacacccgtattcgcacgtgatattcccgatttcgacattcacgagggtgagattcttggccttatggggtcgaacggggttggcaaaagcactttggcacgtacgctatgcggtcttgccgctccgttgaacggcatggtgctattgaatgggacgaaagcgagccgcggcgctttgactcgtgccggatttctcgtcatgcaggacgtcaattaccagctcttctccgatagtgttcgggaagaggcattactgggacttgatgggatggatgacgctgtgcgtgaccgatgcgatgctgtgctacgagacctcgacctattggattccgtgcagcgccacccgatgagtttatccggcggtcaaaagcagaggctggctatagcctgcgctttgatgagcgataagcgattcattgttttggacgaaccgaccagcggactggaccggttgcatatgacccaagtcggcggacttctgcgaaagctcgcggaccgtggcaaagcggtgttggtcgtaacacatgattatgagcttgcagcgctatggtgcgaccgcatcatagcgctggaagacgaactgcataacgaacagggagaagaagaggatcgtctggcatggacttcaatgtgaacgattggctgggagactggattagcttcgaacatttgatcaacaatcatgacccgaaccttgaccgggcttggaaggattcgacgaatgccatgcgatccaagccgctgttcgcgatcatgatgctcggcgatgcgcgacgcttctgggcaaaagcctgcaaaacctcgggcaaggagtggcgattccgcattggtggatggcatatcgaacagccgtccgcagttggcgacgatgatgctgtcgcaggctttaacctgacttggctggacgaaaaacgcacccccatcacaacacatgaatatcggctcgatcatgtgcacgacaaggggctggaaggcaaaccctgctatgtgttccacgctagcgatgccgatgactccgatcccttcgccgtactcatcgcgatggaccccatgcctgaacgttccgcgctcagacacgggggactgctcagtcatctgcattttcaatatgcctctgatgaaggcggactcatcaaaggtactggcaaacaagccgcactccgccatcgcatgtggtatcccaccatgtgcgccgctgaagggacgttacttgatcaatgcaacatcgtacgtgcgctgcatcatcttcaagcatggcgggaactgcctgtcccatcatcagactgactgcagatgtccgaagatggggcaatatcagcattgcgacgattgtaggtatcgtccagtgacgctttccggacatgaggcgatccgagaaggcgctccctcgcatactacgcgtccgcctgcttcaccgccgcccggtcccatatccaccacatagtccgcattggcaatcacgtccaaatcatgttcgatgacgaccaccgtcgcgccattcgctacaagttcatcaaacacgtgcagcagcacgcgaacatcaagcggatgcaagccgattgtcggctcatcgaacacgaataccgcatcatgctgtttccgccccatctcgctggccaatttcaaacgctgggcctcaccgcccgacagcgcgggagttggctcgcccaacgcaagatagcccaaacccaattcatgcaacgtggcaagcttcgtttggatcggtttgacatctcgtaagacaggcatggcatcgtcgacggtcattgtcattaactgcggcatcgaatacgccactccgtcggtgcaggggagcttcagctcggcgattgcatcggaataccgcgagccatggcatgccgggcattcgatatcgacgtcaggcaggaactgcacgtcgagcgaaatcgatcccgtgccgtcgcacgtcgcgcaacgcagcttgccagtgttataggagaatgcccccgctttcagaccgatggtccgcgcagcatctgtttttgcgaacgcgcgtcgaagatcgtcatggacgccgcaatatgtagcgacggtggaacgtatgttcgcgccgataggcgtggcatcgataagatgtgccttggacacaccgtccgcctcgaggagccgcacctgcgtcggctgcggcgacctgtcgatccgcgactgcaaagcgggcatcaacatctccagtaccatcgtcgtcttgccggaaccggatacccctgttacggcggtcagccgtccacggggaatatctaccgataacgggccgacggtatgcagacggtcggtttccatatgaattcgtcctgcggagaagatttcatgggcgtcaatgttgtcacgcacacggtcatgaacgttgccaccctgggcaaggaacggcgcgatgcgcgattcgcgggtatcaatcacctgcggcaccgttccctgcgcaatcacctgaccgccctttgcgccggcacctggccccatctcgatgagataatcggtttcggccagcacccgagtgtcatgatcgaccactaccacggaattgccatcagccaccaggtcacgcatgacaccgagcagtccgtcgacattcgcgggatgcaacccaatcgacggctcatccagcacatataacacgcctgtggtgcgattgcgcacggcgcgggcaagctgcacgcgttggcgctcgccggtggacagcgtggctccggcgcggtccaaggacagatacccgagaccgagttccaataaacgccgtgacgtattgaggaacgattcacagatggcgctcgccatggtgtgcatatgtggttccagcgattccggcacggaccctacccaggaaacgagtgcgtccagagacatcgcggttgcctgagccagattgatgtctctgatacgtggctggcgggcgcgttcggaaagtctggtccctccgcaatcgctgcagggacgctctttgaggaacctcgcaacacgtttaagccctttttcgtccttggctttggtgagggcgttctccacggtgtatacggcgttgtagtacgtgaagtcgagttcggcgaaatcgtcgccttttttcggcttgtataggatgtgcttcttgatggctgggccggcgaacacgatatctcgttcttgttcggtgagttggttgaacggtacgttggtacgtactcccatggccccgcatacttgcttcatcaaatcccacatcaacgatccccacggcagcacggctccctcgtcaatgcttttcgactcatccggtaccaaggcggaacggtcgacttccctcatgattccggtgcctgagcatgtcggacacgcgcccgcggcgttgaatgcgagatcctccgctgatggcggatgcatgagtccgccgcagaacgtgcaatgcatcggaagctcggcggcaacgttcatcgtgggttggttgcgtgctccgcagtgttcgcacacgtgcgatccgatccgggagaacaggaggcgcagactgttgagcagttcgctcattgtgccgaacgtggaacggactccaggcactgatggacgctgatgcagtgccaatgccgccggaatatgacgcacctcgtcgacggttgcgcggcttgcctgggtcatacgtcttcttgtataggtcgatagcgcttccagatagcgtcgtgatccctccgcgtacagcacgccaagcgcgagggagctttttcctgagcctgagattccggctatgccgaccatgctgttgagcgggatgtcgatgtcgacgtctttcagattatgtacgtgggctccgcgcacttcgatacatgaggggagtggccgagacacttgtgtttcgtatgcaaagatagaaggagacggtttcataccggcaattctatgcttgccatatggttatcacatatacggatgaaaagaaattcaccaaggaacagacccagcgactgtttctttcagtcggctgggtgtccggtcaatatcctgaacggttgcataaggcgttgatggggtcatccaccgtattcagcgcatgggatggcgaacgtctggtgggtctggtgcgagtgcttgatgacacggagatggtggcatacatgcactatgtgctggtcgatcctgaataccaagggcgcggcattgccggacatcttgtcggcatggtcaagcagcgataccacgattacctgtatatcgaggttatgtctgaggaaagcaagaatgccacgttctatgagaagcatggattccatattatggaggatggcgtcgccatgcagatatgcaatccgggagaacggcactgacggaacgggcatcgggcatgtcttgagaacttcgggcggtgaggggcgccatctttcgccggaggcgtttccattaccgcttatattttttggggttcggctgtcagatcttgaatgaacgacggatgaatccgtatacggtgtcccagtagcgtttcggatccacggcggagctttccatatgatcggcgtccggaaccagcagacgttcgcggtcgatgctggagcaggcgttgtagttcatgtcgaggaaacgtgggctgaccatgcggtcctttcctccatggatgaacagcatcggaatgaccgtatgccgcaatgacggtatgcaggacgcttcggtgaaatcatagccggcacggcgcttgcagatcagacccgccgcgtccacacatgccgaggcgagaagctttggcatgtggaacatgcctcgcgcgctgtctatgaattccatgcgggcggaagtgtatccgctttcggcgattgccgcgatgacattgcgtggcagttccggcgtgccggtcgtcatcatcaccgtcgtggctcccatggatcctccgaataggagaatgcgtgcttgatcgtcgctatccacaatcagccgtatccaatcaagcagatcattgcgctccaaccatcccatgcctacatatcgtccttcgctcagatcctgggcccgttgggatggtgcgaggacggtgaagcccatgcgggcatagcggtgtgcccatttggcttgttcttcaggggctccggtatagccatgcacgcagatggcatatatatgcggcgtcgggtcgatgcaatccggatcgaagagccagccatgcagcttaagcccatcgcggctggtgatggataccggctgtttcgtttcggaaaaccattgctcggcctctttggcctcgccttggttcatctttccctcgcgatccggagcgatcagcgcctgatggaaaatggaatgcttccactgcgtgtcgatggcaaagcggaacagcatatgtgctgacgccgcgagcaatcccgtcgctgcgacggtcgtgacgccagtcgcgagctgaatgttgcggatgagcgcggaatggtcatgcgtcgttgccattttctgattccttaccactggttggtgcttgtctgactacgattgtacgtgggtttgcgcatagtccgcgttttatgcaccttgctcctctgattgcagggaaatgtcagcgcaccatgtatactagataactgttgtcttggcgagggaggttccgcctccgttatcgacttggcgtatgatatgaaactccttgggttttttatgcggctcgtcggtgcgccgaaacataagaacgatgtatcaaggagatattgattatggctaccaccatcactcttgaaggcgctgcccgtaccgagttcggcaagggcgctgcccgccgcatgcgcgtcgccaacctcattccggccaccgtgtacgccggcggcgaggatccggtcttcgtgcagctgccgatgaaggagaccaccctgtccctgcgtcacaccaacgctctgttcaccatcaagtacggcgacgagaccaagatggccgtcgtcaaggatgttcagcgcaacccggtgaagcgcatcgtcgagcacgttgacttctacgaggtcaaggccggcgagaagatcgacgtcgaggtgccggtgttcgtcgaaggcaccccgaagggcgctgctgtcgcattcgtcgacatccaggagctcaaggtccgcgccgatgtcgccaacctgccggagaagatcgtggtcaacgttgatggcctgaccgatggttccaaggtcttcgccaaggacgtcgtgctgccggaaggcgtcgtactcgatgtcgaggatccggaagaatccgtcgtcaccgtcgaggtgccggaagatgccgcaccggttgaggccgctccggctgctgacgccgctgccgctccggctgctgacgctgagtgagccgtatcgttgtctatactggctgctccacaagcatgaggtagccggtgaggaaggggtccgtatgggccccttcctgctttatgaggatcgttatctcatatcgcgaacgccggttatcgaaagcgtttatggtgtgagagagtacataccagaacccggcgccacaagcgccggagaccaataaccgctggccgcctttgggtggctgatgcaactagaagaagtaaagaatgactgaacagaatcatcacgatccggcggagcttgacaagctcgccgagaagttcaccgtgctcccgaacgacaacccggcatccgacgccaagcgtgccgaactcatcgacaagccggctttcggtcaggtcttctccgacaacatggcccacatgacctggaccaagggtgaaggctggtcggaccgccgcatcgagccgtacgcgccgctgaagatggacccgggcgcatctgttctgcattacgcccaggaatgcttcgaaggtctgaaggcctatcgtcacgccgacggctccacttggctgttccgtccggatgcgaacgccgagcgtttccagaactccgccaagcgtctgtacctgccggagctgccgatcgacgacttcatcggctctgtcgccgccctcgtcaagcgcgatgtgaactgggttccgtcccgtcgcgaatacacgctgtacatgcgtccgttcatgttcgcttccgagccgttccttggcgtgcgcgctccgcaggaagtggattattgcgtgatcgcctccccgtccggaccgtacttcccgggcggcgtgaagccggtcagcatctgggttgaagacaagtggttccgcaccggccctggcggcactggtttcgccaagtgcggtggcaactacgccgcatccctgcttggtgagtacaccggcatcgaccacggctgccagcaggtgtgcttcgtcgacgccgccaccaagacctaccttgaggagcttggcggcatgaacatgatggtcgtgcacaaggacggccacgtggaaaccccgtccctgaccggcaacatcctgccgggcgtgacccgccgctccctgatccagctcatccaggacaacggccacgacgtggtcgagaccatgatcgctctggaccagctgcttgaggacatcaagtccggcgaagtcaccgaggtgttcgcctgcggtaccgccgccatcatcaccccgatcggtcgcttcaagtccgagaagttcgatgtgaccgtcgccgacggcggttccggcgagttcaccctcgcactgcgcaaccagctgctcggcatccagcttggcgagatcgaagacccacacaactggatgtggaaggtctgctgattttcccgttagcgattattagctgacatatagctgtaatggccgccggagggtggcgcgtgcttcaggccaattcacatggtctggcaatgtacgtgccgccctccggctcttttattgcagctcttgccccatattgtgctatttttaacagctggttggaaaagaaatatgtgagggaaggggagtggccatggaagtggcgctggaaagcaacggcttcttcataggtatcgaatatctggcgaccttctgctgcggcatggtcggcgggctcgccgccgtacgcaaaggctatgatatttttgcgattctcgtcaccacatggctcaccgcattgggtggtggcatcattcgtgatgtgctgctcggagcgcttcctcccgcaggcgtctccgacaaagggctggtgatcaccgcactgctcgcagctgtggccgtagccatcatttatcccgaagtcgacaagctcaaatggtccatgctgtcattggacgcgctggcattgggtctttacgccgtcaacggcacatccaaagccatgatgtaccacatgtccggcaccacggcagtgttcctgggcatgttcacggcacttggcggcggactcatccgtgacatgctcatcaacgaggtgcccatggtgatccgcgacaagcattggtacgcggtgccttcagccgttggatgcgtattgacggtactcgtatgtaaaggagtgaacgagggaatcgtcagttttcccgccgaagtcttgcttgatgtgctgattgtggtgctgatggtggccatgcggcttatctccgtgtttttcgacattcaattgccgggggctttggccaggcataacacctacctgccgagcgaagccaaatatctcaaacgtccggtcatccatcccgatcggaatgatgacgatatcaagcgtaagtgagcattttcaacagagtacgaaatgtaaaaaagaagaagccccgcaggttttcctgcggggcttcttacaagctgtgagttacgaaaactcagagagcgttgatggccacagcgagaccggacttgcggttggcagcctggttcttgtggatcacgccagcgccggcggccttgtcgagcttctgggctgcgaccttgtaggcggcttcggcggcggccttatcgccagcggcgatggcttcgcgggtggcgcgaacggcagtcttcaggctggacttcacggccacgttacgcttgtgcgccttctcgttggtgagaacgcgcttcttctgcgacttgatgtttgccactatttctccaaacgacgtttgctataaggacatacaaacgatgatgataacatggcacgcggataaatcgccaatgcgtataagagtgtcgcggaaggacatgccgacactaccagttagaatcgtttgcgtcgaatatttccagaggaggatggcgtgggccaacagcataatcagcccgggtacaccgatcagtcgttgatccgcaacttttgcatcatcgcgcatatcgatcacggcaaatcaacggtggcggaccgtattctgcagttgagtggcatcgtgccggagcgcgagatgcgcgatcgcttcctcgaccgcatggatatcgagcaggaacgcggcatcaccatcaaatcgcaggccgtgcgcgtgccgtggacggttgacggcaccgaatacacactcggcatgattgatacccccggccatgtggacttcacatacgaggtgtcccgagcgttggccgcatgcgagggtgcggtgctgcttgtcgacgccacgcagggcattgaagcgcagacgctgtccaacctgtatatggccatcgaccatgatctggccattatccccgtgctcaacaaaatcgacctgcccagcgccgaacccgacaagcatgccgaggaaatcgccggcctgattggttgtgacccgtccgacgtgttgcgcgtctccggcaaaaccggagaaggcgtcgccgaactgctcgaccgtatcgtcgccgaagtgcccgcgccggcgggcaacccggacgcgcctgcccgcgcgctcattttcgactccgtatacgactcctatcgtggcatcgtcacttacattcgtatggtcgacggtgaactgaaatcgcgcgagaagctgcacatgatgggtatcggcatgacgcatgaccccatcgaaatcggcgtgatcagccccgacatgatgcccaccaaggcgcttggcgcaggagaggtcggctatgtgatcaccggagcgaaggacgtcagccagtccaaggtgggcgacaccatcacctccgccataaatccggctaccgagccgctcgaaggctaccgtgatccgcaaccaatggtctacgccggcctgttcccaatcgacaacgcgcaatatccggaactgcgcgaggcgcttgacaagctcaagctcaacgacgcggccctcatctacgaaccggaaacctccgtggcgttgggcttcggcttccgttgcggcttcctgggcttgctgcacatggagatcgtcaccgaacgtttgagccgcgaattcgaccttgacctgatctccaccgcgccgaacgtgccgtacgaggtcaccgcggaagacaattccgtgcatcgcgtcaccaatccgagcgaattccccgaaggcaagatcaagaagattgtcgaaccgatggttgccgccgacatcatcacgccgaaggatttcatcggtgcggtgatggacctgtgccaagaccaccgtggccagatgggcaccatggaatacatttccgccgaccgtgtggaaatgcattaccgtattccactcgccgaaatcgtcttcgacttcttcgaccagctgaagagccgtaccaaggggtatgcgtcgctcgactaccacgaggatggcgaacagtccgccgatctggtgaaggtcgacatccttattcaaggcgagaaagtcgatgcgttcagcgccatcgtgcaccgtgacaaggcgtacagctatggcgtgatgatgaccaagaagctgcgtgagctcattccgcgtcagcagttcgagattcccatccaggctgccatcggttctcgaatcatcgcacgcgaaaccatccgcgccctgcgcaaggacgtgctcgccaagtgttacggcggcgacatctcccgtaagcgtaagctgctcgaaaagcagaaggccggcaagaagcgtatgaagatgctcggccatgtggaagtgccgcaggaggcgttcatcgcagccctgtccaccggcgaagcgggcaacgaccgcgacaccaaggacaagattcgcgccgcgcagaagtccgaaggctgagcctttcgtgacgttcgaaatctacattcatgttccgttttgcttacgtcgctgcggctattgcgacttcaacacctacacggccgtggacatgggcgcgggcgcgtcacgcggcaactacgcgaacatggttatccgcgaaatggcgattgtccgcgattggcagacaacgcacggtatcaacgagccgaaggtggcaaccgtcttcttcggcggcggtacgccgaccacactcaaggcaagcgatttgatcgccatgctggatgcggtacgcgccacatggggcatcgccgatgacgcggaaatcaccaccgaagcgaatcccgacacggtgaatgccgactatgtgaaagaactcgcagacggcggtttcaatcgtatttccttcggcatgcaatccgcggtaccgcatgtgcttgcaacgctcgaccgtacgcatacgccggaaaacgtcgccgccggaatcgcagcggccaatgcagcaggcatgcgttccagcgtcgatctgatctacggcgcgccgggggagagccttgacgattggcgcacatccgtccgcaccgccatcgatttgggcgtcaaccatatttccgcatatgcgctcaccatcgcgccgaatacgaaaatgggacgacagatcgcggcgggcacgttgtcgagaccggacgatgacgacgaagcgaacaaatacgaaatcgccgacacgatgttcaccgaagccggcctcgaatggtatgagattagcaattgggctcgtcctggatacgagtcgcaacacaaccttggctattggaggaacgtcgattgggccggtctcggtcccggtgcacattcgcattatggcgattgcgaagacggcaaaggattgcgctcctgggatatcgcgcatccgcgattgtggggcaccgccatcaatgagggcaatgtgccatgggccggcagtgaacgcatcactgccgccgaggacatcgaagagaccatcatgttgggcctgcgcattcgtgaaggactcgacaccagacaattcagccacttgattcctgaacaaaaatggattgagcttgagcacgacgggctgatcacaatgcttgatggccgcgccatacccactttgcgaggccgactgctcaacgacaccatcatcacggagctgttggaaacactggactgaccgggttaatgagcataagtgaagtgcgtgcgcatgagcatgacatgcgaagtatgcgttcatgggctaaatcctctgcgaggcattgacaaaaatagccattcgttatatggacacgtgcaacgttgctgacatactggcgcggtattctaaaccacgcattaaagaaccgcaagacttttcttgcccaaaaacattgaaggtggtttcggtgactttccacgccccgttagatctgacgatccatgattcccaaggtatgtacgatcctggagccgagcatgatgcttgcggcgtgggtatggtcaccaccctcaacaagcgtccggaacgcaagatcgtcgatgacgccatcgaggtgctggtcaatctgaaccatcgtggcgccgtgggcgccgaggagaacacgggcgacggcgcaggcattctcatgagtatgcccgacgaattcatgcgtgccacggccggtgtggagcttcctgaagaaggtcattacgccgcgggcatcgccttcttggatcgcgacatcgccacttccggccagcaggagcaggccatttccaagatcgtgcgcgaagagggcctcgaagtgctcgcatggcgcgtcgtacccaccaatccggacggactcggcctgcaggccctggccagcatgccggcgttcaagacgctgatcgtggccgatccggaaggcaagctcggtggcatcgaactcgaccgcaagaccttccgcatccgtaagcgcgtggaacacgaggtaggcatctacttcgcgtccctgtccgcccgcaccatcacctacaagggcatgctcaccaccatgcagctcaagcccttcttccttgacctgtccgacgaacgcatgaaggcgaaaatcgccatcgtccattcccgcttctccaccaacacgttcccaagctggccgctggcacagccgttccgccagctggcgcacaacggcgagatcaacaccatccaaggcaaccgcaactggctgtccgcacgtgaaggccgactgagttccgaactgctcggcgaattcaagccgctgctgccgatcgccacccccggctattccgattccggcactttcgacgaatgcctcgaactgctgcacctcgccggccgttccatgccgcacgccatctccatgatgctgccgccggcatgggagaacaacgaccagctcgatccggacgtcaaggctttctacgaatacaacaacacgctgatcgaaccatgggatggcccggcgcacatcatcttcaccgacggcacccaggttggtgctctgcttgaccgtaacggcttccgcccgggacgttggcaggtcaccgacaatggttatgtcgtactcgcgtccgaaaccggtgtgctgccggaagtcgccgaggagcatatcgtcaccaagggccgtctggaaccgggcaagatgttcctcgtcgacaccgacgagggtcgcatcatccccgacgaggaaatcaagaagactcttgccagccagcacccctaccgcaagtgggtggaaggcaactccgtggaattgagtcagctgcccaagcgcgagcacgtcaaccactccggtcagtccgtgcagcgtcgtcagcgcgccttcggctacaccgaggaagatctgaagctgctgctcgccccaatggccaacaccggcaaggagccgctcggctccatgggcaacgatacgccgctcgccgcgctgtccaagcacagccgcatgctgttcgattacttcacccagaagttcgcgcaagtcaccaacccgccgctcgactgggaacgtgagaagatcgtgaccagcctcgaatccgccatcggtcccgagccgaacctgctggccgattccgaactgcacgccaagaagatcctcatcccgctgccggtgctcaactccgacgagatggcacagctcaagcgcctcgaccgcgccaagattctcggtggctattacaagccattcatcgtcaagggcctttaccaggtggccggcggcggacaggcactgaaggaccgtcttgacgagatcttccaggagatcgacgaggcgattgagaacggcgccaacttcctggtgctgtccgaccgcgattccaactatgcgtggggtccgattccatcgttgctgctcacttccgcagtgcagcaccatctgctgcgccgccacacgcgtacgcagatctccatggtggtcgaagccggcgatgtgcgcgaaatccaccatgtggcactgctgatcgcctatggcgctgccgcggtgaacccgtatctggcattcgaatccgtcgaagacctctcccgcaagggctacctcaaggtcgacgcggaaaccgccgtgaagaacctgacccgcgcactgtccaccggcgtgctcaagatcatggccaagatgggtgtctccaccatcatgagctaccgtggcgcgcagctgttcgaagcggtcggtctcaacaaggacgtcatcgacgagtacttcaccggcaccacgtcccgtgtgggcggcgtcggcctcgacgagctcgccgaggaagtcgccagccgccatcgcgtggcctatccgacccaatggaccgcccgcccgcaccgcaacctgcgtaccggcggcgactacaagtggcgtcgtaccggcgaggaccatctgaacgatccggaagccatcttcctgctgcagcagtccacccagcgcggcgactacaacctgttcaagaagtactcgaaccacatcaacgacacctccaaccgtctgatgacgctgcgtggcctgatgaagttcaagtccacccgcaagccgatcgacatttccgaagtcgagccggccagcgaaatcgtcaagcgtttctccaccggcgccatgagctacggctccatctcccaggaggcgcatgagacgctcgccatcgccatgaacacgatcggcgcacgctccaactccggtgaaggcggcgaatccgaggatcgtatcaacgatccgctgcgctacagcaagatcaagcagatcgcttcggcacgcttcggtgtgaccagcgactatctggtgcatgccaccgacctgcagatcaagctcgcccaaggcgcgaagccgggcgagggcggccacctgccgggagccaaggttccgccgtggatcgccaaggtacgtcacgccaccccgggcgtggagctcatctccccaccgccgcaccacgacatctactccatcgaggatctgaagcagctgatcaacgatgcgaagatggccaatccgaaggcccgcatccacgtcaagctcgtctccgaattcggcgtcggcaccatcgctgccggcgtggccaagtgccatgccgatgtggtgctgatttccggctatgacggcggcaccggcgcggctccgctcaacgccatcaagcatgccggcaccccgtgggagatcggcctgtccgaaacccagcaaacgctggttctgaacggcctgcgttcccgcatcaccgtgcagtgcgacggcgagctcaagaccggtcgcgacgtggtgatcgccgcgctgcttggcgccgaggaattcggcttcgccaccgccgcgctgatcgtcgaaggctgcgtcatgatgcgcgcctgccagaagaacacctgcccgcagggcatcgccacccaggatccggagctccgcgcacgcttcaagggcaagccggaacatgtcgtcaacttcttcatgttcatcgccgaggaagtccgcgaactgctcgcgcagctcggcttccgcacgctggaagaggccgtcggccatgtcgaatgcctcgaccaggacgaagccatcaagcgttggaaatccgacggcatcgacctgagcaacgtgctcatgcagccgggcccggttccgggaaccatcctgcacaagacgatcgatcagaaccacgagctcgacaaggcgctcgacaacaagctcatcgagcttgcccagcccgcccttgacaagaaggagcccgtgcgtatcgaaatgccgatccgcaacgtgtaccgtacgctcggcaccatgctcggctatgagatcaccaagcgctacggcgaggaaggtctgccggacgacaccatcgacatgacgttccatggtgccggcggccagtccatcggcgcgttcattccgcgtggcgaaaccatccgcgtctacggcgaagtcaacgactacgcgggcaagggcctgtccggcggccgcatggtggtccgtccagaggacggcatcaccttcgatccgcacgagaacgtgatcgcaggcaatgtcaccggcttcggcgcgacttccggccaaatgttcgtggccggccgcgcaggcgaacgtttcgccgtacgtaacggcggcgccaccttcgtggtggaaggcgtgggcgaccacggctgcgaatacatgaccggcggtacggtcgtgattctcggctccaccggccgtaacctcggcgcgggcttctccggcggcaacgtgtacgtgctcgacctcgacatgaagcaggtcaacccggcggccgccaccaacggcgcgctgctgttcgagccgcttgacgccgatgccgacaagctggtgcatggtctcgtcaagcagcatgccgaagagaccggctccgccttcgcgaaggccctgcttgacgactgggaaaacagcgccaagcgattcacccacatcgttccgaagcacttcctcgccatgcagaaggcgatgaaggaagccgaggagaagaacatcgatttcaatacgcccggcgtctgggaacaggtgtacgagcaggttatggaaggagcgcgctgacatgggagatcctcgtggattcctgaaggtccgtacccgtcgcgaactggccgaacgccccgttgaagagcgaatcaaggactggttcgacgttcacaccgaatccggcctgcagtcctggaccaccgagcaggcggcccgctgcatggattgcggaaccccgttctgcatgagcggatgcccgctcggcaacatcattccggagttcaacgatctggtccgtcaggagaagtgggaggacgcgtacaaccgtctgtccgaaaccaacaacttccccgaagtgaccggtcgcatctgcccggcattgtgcgaagccgcctgcgtgcttggcatccatcagccggccacgatgattcagaacgacgaacgcaccatcatcgatcaggcatggagccttgactacgtcaagcctctgccgccgcagcgtctgaccgaccagaccgttgccgtggtcggttccggcccatccggtctcgcctgcgcccagcagctcacccgtgccggccacaccgtggtcgtatacgagcgtgatgacgccatcggtggtctgatgcgttacggcattccgaacttcaaactcgacaagcgcctcatcgaccgccgagtcgagcagatggaagccgaaggcaccgtgttccgcaccggcgtggaaatcggcaaggacatctcctgggatgacctgcgttcccgctacgacgcagtggtggttgccatcggctccaccgtgccgcgtgacatgaagattccaggccgcgggctcaagggtatccatttcgccatggagttcctgccggacgccacacgtcgcgtgtacggtgtcaagccggtcaacgacatcaccgccgaaggcaagcatgtggtgatcatcggcggcggcgacaccggttccgactgcctcggcacatccctgcgccaaggcgctaaggacgtcaccgtgctgcagatcatgccgcaggaaccgaaggagcgtccggccaaccagccatggccgaccttcgcccgcctgtacaaggaaacctcctccatggaggaaggtttcgaaacgcagcgcgccgaatacgtgtacaacaccgactcggtcaacttcgagggctccgacgaggacaaggccaaggtgaaggtggagaactccaccgccaccgaaggcttcgtcgccgacgagaacggacatgtcaccggtctgaaggtcgtcaacgtcgctccaggagagaacgggccgttcacccgccagccaggcaccgaacgagtgattcccgccgatctggtgctcatctccgtgggcttcctgcaccctgacaccaccacgctggtggatcagctgccggtcgaccttgacggtcgaggcaatgtggcgcgtaacgacaagttcgccacctcccaggacggcgtcttcgcctgcggtgacgccggacgtggccagagcctcgtcgtgtgggccatctccgaaggtcgctcctgcgctgccgcggtcgacgagtaccttaccggctccaccgaactgccggcaccgatcgtcgcttccaagcgtccgatgatgctgccgcgatagacaacactgttgtaagggtatgaacgaggtggcccggctcgcgaatagtgagccgggctacctgtttttcacccaaaatgcggtaaagtaatcccagcaccatgcaacaaaggagtgactaatgccaaatcgcgcagaacgacgtgcccaagccaagcgcaatcgcaggggagtgccacagcaatacgaccaaacccaaggccgcgcacgttccggcatgttggacgagtatcagctgcaggaaaagtcacgtcgtctgcaggacggcactgatgggccatggaagccgagtgccagtacgatcacggaaacggaaaacgtgctgaacaccaatcctgattacaagaatccgaagatgttcaaggcaccccattccgtccgccaatggttccgtgtggccagctgggtgctgattgcgctgtcggccatcgccttcctcgtggtcatgtggctgccgtcgcatccgatgtggctcatctccacagtcgccatcgtcttcgcagtcggtgtgctgagcctgttcttcacggccggcaacccgaagcacaatccgaatctcgaccaaaacggaacagccgtctgatcacaaaaacgatggaaagcggtgagacaaccagaagcatttgtctcaccgctttttctatcggattttaggtatgcgctacttgacttcgactaaccgtaaagggtatgcgagaatgctgtttcatcgtttttcagaaaaagaatggaactttctgaaaaacgatgaaaacaataagtgtttttcgtgtctgatgttttacagtagaacaggaaacgctggaagactcgaggaggagattacagacatgaaggttgacattctatcgcgtgaatacccgcccaaggtgtatggcggcgcgggggtgcatgccgaagagctttccaaggtgctggcggaacgtgtcgatgtgacggtccgcgcattcgacgggccgcgcgcggccgccgacattcccgcgattcccggaaccgacccgaaagggtcgctcacggtcgtcggctacgacgtgccgaaagagcttgaggatgcgaacggtgcgctgaagacgtttggcgtcgatttgcaaatcgccaacgacgttgatgccgacatcatccatgcgcatacatggtacgcatgccttgccggctatctcgccaaaatgctgcatgacaccccattggtcatcaccgcgcactcgcttgaaccgttccgtccatggaaacgtgagcagttgggcggcggctacaatctgagctcttgggctgagaaagacgcctacgagcatgccgaccgcgtgatcgccgtatccgcgggcatgcgtgaggatatcctcaccgcctatccgaaccttgacccggacaaggtggtcgtagtgcataacggcatcaccatgagccagtttgaaaccccggcggatgacgatccgggctggaaggtgttcgaacgttacaacatcgaccgcagcaaaccgaccttgctgttcgtcggacgcatcacccgtcaaaagggtctgccgtacctgcttcaggcactgcacttcgtggacccgaacatccaggtcgttctgtgcgccggcgctcccgacacgccggaaatcatggaagaggtcaagaccgccttcgccaagctcgacgaggaacgcggcaacatcatctggattgaggagatgctgccgaagccggaactcaacgcactcgaacatggctgtgacgcattcatctgcccatccatctacgagccgctcggcatcgtgaatctggaagccatggcatgcggtctgccggtggtcgcctctgcgaccggtggcattccggaagtcgtcgtcgacggcgagaccggatatctggtgccggtcgaccaactgcatgacggcactggcacccccaccaaccctgacaaattcgtgcacgatatggccgacgccatcaaccgcatcatggctgaccctgaaaaggcgaagcggatgggacaggccggttacgagcgtgcccgcgaccacttcagctgggagtccatcgcagacaagaccgtcaaagtctacgaggacgtgcttgccgaacggaagtagaaccgaacctgtctgatcgcggataaccgatccggctgatcgatagccagaatattcctgaaatgcctcctgccgacgcactatgctggcaggaggcatcatcgcatccaagtggtttgtgaaaatggaggggaccatgaacgaacagagcatcgcgttgaaactggacgatgtggaattccgtcgccgcaggcgcgtaattctcaccaaagtcaatctggaagtcaaaaaaggcgagaaatgggtgctgttcggtcccaacggcatcggcaaatccacgttggtgcagatgatgagcacccgtggattcccatccgaaggcacagtcgacattcttggaaaccgtctgggcaaagtgaacgtgttctcctaccgcaaccgcatcggtttgagctcggccgaactcggacgtgcgttcccaccgcaggaagatcctcttgacgccatcgtgacggcgctgaccgcaaccaccggccgttggcgcgacacctatactgacgaggattacgccaaagcccgctcattgatgcgtgaattcggcatcgaatacctggaaggcaagatgatgttcaagctttccgaaggcgaacgcactcgcgtgcttatctgccgtgcgttgatggcggatcccgatttgctgattcttgacgagccgaccacgggtcttgatttgggtgggcgtgagattgctttgcgtgcgttgagtcgtgttggtgcggagcagtctgaccgcgccgtgattctggtgacgcaccgtcttgaggagattccgcaaggcttcgaccatgtggcgatcatgggacgtatcaccggcaacgaggcggacgcgtatgcggataatgtggccggcaacgatccggcgccgggcactatcgtgtatacgggtgatttggagcatggttttacttctgaacggttgagccaggtgtttggtttggatttgaaggtcacgcatgcgaatggtcgttggaacgcgtacgcggtgtgatgttgacgtcgccgtcacattgccgtcgcttcgtgccgtctgccggtatgacggcggatacggtagcataggttcgttgctgtccgtggaataatgcggtctgcaatcgtaagccatagtcgtgaaatcgtatactgaacgaacgtacgaaggagcgtgaaccatgcgtcgagggccgcttgccgccggtgaaaaagtgcagtttacggaccgcaggtcgaataaaatcaccgatcagctggtgccgggtggtgtgacgcagacttcgcatggcatcatcctgcatgatgatgtgattggccagacggaaggatccgttgtcgtgacggtgagtgcgaaacgtgaggctcaggtcaaccagacgcatccggaacgcgacgcgaacaagccgtggaaggggacgcgtgccatcggtggttgggagttcgccgtcatgcgtccgcgcttggctgactatgtgctgtccatgccgcgtggcgcgcagatcatgtatccgaaggacatcgcgcaggtcattcagctcggtgatattcgttccggtatgaacgtgctggaatccggagccggttcgggcgcgatgagcatcaatctgctggatgccgtgggggagggcggaagcctcaccaccatcgagatgcgttcggaattcgcgcgcgtcgccgaagccaacgcgacggtttactttggcgaacgtcccgcatggtgggatttgaggaccggcgatttcgattcggtcgcggctggtttgccggaacactccttcgaccgcatcatgcttgacatgcttgacccgtggaaccgtcttgaacaggcgtatcgcgtgatcgcgcctggcggcgtgctcgtcgcgtacgtcaccaccaccacgcagttgagccgtcttgccgaagcgttgcgcgaggccggttgctggaccgagccggacattcaggagactttggaacgtaattggaaggcgcaaggactggccatccgtcccgatcaccagatgattggacacaccggtttcctcatggtttctcgcgcgatggctccgggctttcaggcgttgcgtaaacgcgaccgtgccacgaaggacacgacgaccgacatcgattcgttgacgctcgaggagcgtgccgaacagcttgaggatctggaattgcgtgacatttccgatcgcaagctgcgcaaggtgctgcgtgacctcgacgcgcaggtcgaagccataaaggagtagatttagagcgtttcatgccatgtcccagcggaaaatctgagacaatggatattagatatttgaaatgcggcgctggaaccggatcggagcgtgcgattatgggaacgagcctgaagaaggtcgccaaaaagaccaaggaatacaagtatgtgctgctggcgatgcgccacgccaaaaccgagccgttcggcggcaacggcagcgacgtgggacgtgagctcaccgacaaaggacgtaagcaggccaaagccgtggccaaaggattggcggcgttcaaaatggtgcccactcgcatcgcatgctccagcgccacccgcgcccgtcagacctgcgatcgcatgctcaaggtgttcggcgacgatccgaaagtcgactaccggcaaagcctgtacgaaggcggcgtgcaatccgtgttcgacgagctcgcgcaaaccaaggaaaagcatcgcacgctgctcgtgcttggccacgaaccgaccatttcgatcgcctgccaatggctggccagcaccgaatccgatccgacgttgcttgacctgctgaatctcggcatgtccccggcctcgatcgccgtattcggctcgaacgagccattcaaccagtggcagctgcacagcggcgaactcatcgcgctgcttaccgccaaagacttcgagtagggcttgcgtgttccgggctgattcggaacgatgagcattccgcagagtgctgtgatttgacttcaagcggcttcaaggttgtatggtgctttctgaaccgatgttcagaatgatggataggagagcccatatgaacaatcccagtgcgttccctcttggggaaccaaatgacggtttcgcccagtatttcgacggacagagctggcttgcgccggtacttgacgcgcctgaagtgtcaatccacaatgtgacgttcgaacctggatgccggaaccactggcatatccaccatcacgcggcccagattctcattgcggttggagagcgtggctactaccagcttgagggcgaagagccgaaggagcttgaaccgggacaggccgtccgtattccgccggacgttaagcattggcacggtgccgcccctcacgaagctttcagccatttggcgttcatgattgcggatggcacgggcgacgtgacgaatgaatggctggaacccgtagaccccgacgcatacgagacattgcgttaaatccgcttgccgggctgttctgcattattgatccataaacataaatgtgtgaatatagacggcatacggactgcgttataaggacagtttataacgacactcaaattttcttgatgtcttatagctggcggttttgtgatagcttgagcgggttgcattgttcatatcagatggaggattcatgtccgctcttacttccgtctccggtttcccacgcatcggccagaaccgtgagctgaagaaaatcatcgaagcgtattggaagggcaacaccaccctcgacgaggtgcgtgccacagccaaggaactgcgtgccaagcattggaagctgcagcaggccgccggcatcgacctgattccgagcaacgacttcagctattacgaccagatgctcgacactgccatcctgctcaacgtcattccgcagcgctaccagcgtctcgccttcgagaacccggaagagaccctcttcgcaatgggccgcggctatcagggcgagaagggcgacgtgaccgccctgccgatgaagaagtggttcaccaccaactaccactacctcgtgccggaaatcgactccgccaccgacatcaagctcaacagcaccaagccattcgacgaattcaacgaggcgaaggcgctcggcatcaccaccaagccggtgctcatcggcccgtacaccttcttcaagctcgcccgcaatccgcaggccgaggagctcgactacgacaagggcctcgtcaacgcggtcgccgcggtgtacgccgaagtcgtcgccaagttcgccgaactgggcgcgcagtggatccagatcgacgaaccgtacctcgtgctcgacaaggagccgggcgacgtcgaactgttcaagagcctgtacgccaagatcctgcccgcccgcgaaggcaaggtcaaggtgctgctcaacacctacttcggacacatcgccgacgtgtacgaaaccgtcaacctgctcggcttcgacggcatcggcctggacctgaacgaaggcaaggacgaaaacctcgccgccgtcgaaaagtacggcgtggcagaaaacaccaccatcttcgccggcgtgatcaacggccgcaacatctggcgcaacaactacgccgtgagcctcggcctggtcgacgcgctgaagcaggtcaccgccaacgtggccgtctccaccgccagctccctgctgcacgtgccgttcagcaccgaaggcgaggacggtctcgccgacgacgtgcgcaagcacttcgccttcgccgtccagaagctcgacgaactgcacgaagtcgccgtgctcgccgacgcttccgacgacgagaagaaggcatccgccgaactcgcagccaaccaggcgctgttcgacggcacccgcgtcgccgccgatcctgcggtcgccaagcgaatcgcaagccttaccgacgccgacttcgtacgtcagccggcacgcgccgaacgccagaaggagcagcgtgaggcgctgaacctgccgctgctgcccaccaccaccatcggctccttcccgcaaaccaaggaagtgcgcgccgaacgcgccaagctgcgcaaggacgagatcaccaaggccgaatacgacgaattcatgaagaaccagatcgacgcctgcatcaagcatcaggaggaaatcggcctcgacgtgctcgtccacggcgaattcgaacgcaacgacatggtcgaatacttcggccagaacctcaacggcttcctgttcaccaagaacgcgtgggtgcagtcctacggcacacgttgcgtcaagcctccgatcgtgtggggcgacgtatcccgcgccaacccgatcaccgtggaatggagcgcctacgcgcagtcccgcaccgatcatgtgatgaagggcatgctcaccggtccggtcaccatcctcaattggtcctggccgcgcgaggacatcacccacgagcagcagacccagcagctcgcgctcgccatccgcgacgaagtgctcgatttggagaaggccggcatcaaggtcatccagatcgacgaggccgcactgcgcgagaagctgccgctgaggaagaccgactggcacaagaagtacctcgactgggccattccggcgttccgtctggtgcattccgccgtcaagccgaccacgcagatccacacgcacatgtgctattcggagttcaacgacatcatcaaggacatcgacgcgatggacgccgacgtgatctccttcgaagcctcccgtggcgaccttgtggtgctcgacgccatccacgacgccaacttcgaaaccgaagccggcccgggcgtgtacgacatccactctccgcgcattccgtccgaacaggagatcgaggaccgcatctacgagatcctgaagaagatggacgtcgaaaaggtgtggatcaacccggactgcggcctgaagacccgtggcaacgccgaaacctggccgagcctggagaacctcgtcgcagcggccaaggccgtgcgcgccaaactcgccaagtaaggccggcataggcataaacaggcaagatttccaaggaatcacatgcattcgccaatcttctcgctggaggtgttccctcccaagcgcaccagccctgtaggtaccatctacgatacgttggatggcctgcaggggctggaccccgacttcatctccgtcacctacggcaccggcaaatcgtccgaccgcacgttgaccgcacgcatcgcgcatacggtgaacgaatacggcattccggccgtggcgcacctgaccgcgcaataccttgacaaagacgacgtggacgaggcgctcgacctgttcgaccaagccaaagtctccggcgtgctcgctttgcgaggcgaccgtgtggaaggagccgaaccggcgggagtgttcgaccatgcgagcgatctggcggcctacatccgcgagaagcgtcctaatctcaagatctacggcgcctgctatccggaaaagcacccgcaggcggccacgcttgaggaggatatcgacaatctcaagaagaaggtcgacgcgggcgtaagccacctcatctcccagctgttctacgacaacgaggatttccttcgattcgtggacaaggctcgtgccgccggcatcgacgttccaatcgaagccggcatcatgccggtgatgaacgcgaagtcggtgctgcgcatgtcgaagatgtgcgaatcgcgtgttcctgaaaaacttgccgtcctgcttgacaagtgggggagcgacaccgcgctgcttaaagaggcgggtatcgcctacgcgtccgaacagatctgcgacttggcggcacgcggcgtcgacggcgtgcacctgtacacgatgaaccatccatgcgtcagccggcgcatctggtccaacgtcaaaccattcttcgtctgattccggacgatgcaacaaacacgaaagggatggtttccggcaactgtcggaaaccatccctttcgccatacttacggatatgaacgattactatgggaaccatggcttcttctacgcatcagtttggggtgctcgatctgattcgggcaggactgcaggatctggacacggcacgcacgctgcttgacgagttgcgcgccgacggcatcgacgacgaccggctacgcctgctgatgaaaacattggaacagacctgcgagcccgacatcgcgctacgcaacctcgtcgacatcatcaaagcgttgcaaagccaaggccgcgacttccaccaggtcatcaccgacgacgccggactcgtacgactcgtcaccgtgctcggcgtgtctgacgaaatgggcaagctcatgcgattccgtcccgaactcgtcatggctgcggccagcgactcatgcgaaagccacctgtacaaccatgcccagcggcgcgcacatgtgctcgaagcggtcggtgccgaccctgtcgacagccgcacgccgaaagcctcgaaaccccttgcggaggcggcgactgccttgcgacagacctacagaaaacagctcgccgccatcatggcgcaggacgccaccgcggacgacccaatcgaaatacaaccgagaatcagccaggaactgtccgatcttgccgacgcggccctggaaggcgcgctcgccatcgcccgcaacgaagtggacggcagcgaacacgtgcgcttcgccatcatcggcatgggcaagctcggcgcacgcgaactcaactacgtatccgacgtggacctcatctacgtggtggaaccggcggacgcggacaccaacggcatgaccctcaaccgtgtcggcaccaaaatggccaccaccctgcagcgcgtatgccaatccgtcatcatgggcgtcgccgaacctacattgtggcagatcgatggcggactgcgccccgaaggcaaggacggcccgctcgtacgcaaactcgaatcgcacgaagcctactacgaacagtgggcggaaaactgggaattccaagccctgctcaaggcccgtcccgtggccggtgaccccgaccttggccaagcgtacatggacatgacccgaccgttcgtatggaccgcctccaaacgcgacaacttcgtctacgactgccagcagatgcgcaaacgagtcgaagacctcatccccgcgcccctgaaggaccgtgaaatcaaactcggccgcggaggcctacgagacgtggaattcaccgtgcagatgctccaactcgtccacggccgcgccgacgagaccctgcgcaccagctccaccctcgaatcgttgcaacgcctcgccgaaggcggatacgtctcacgcagacaagccaagaaactctcctgggactaccgcttcgaacgcgtcatggaacaccgccagcaaatgtgggcgctcaaacgcacccacctgttcccggacctcggcaaagccagtctcggcggtatcgaacgcaaacgcgacaccaacgacgacgaactcaaccacaacctcgaactgcgcagactcgcccgggccttccacatgcaccccgaggaactcgtcgacaaatacgacgaaacccgacgtgaagtgcgccacctgcacatggacatctactaccggcccatgctgcccatcaacgccggcctcgacgacgaacaagtggaactgtccgccaacgccatgcaggaacgcttcgcctccatcggattcgccgaccccgacgccgccatgcgccacgtcaccgcactgaccgccggcatctcccgtgccgcgaaaatcaaccgcatcctcctgcccgccgccctccaatggctcggcgaagggcagaaccccgacatgggactgctcaactggcgcaaactcgaagaacactttggcacggacagcgaatacctcggcttcctgcgcgactcgccgtccgccgcgcaacgcctgtgccacatcctgtccaattcgcggttcctgggcgacgcgctcaacaaatccgtcgaatccgtcacctggctcggcagcgacaacgacctgcagccacgctcacgcgaaagcctcgacgtgcagacacacgcctcactcgaacgcaacgcaggcagcatcaacgacttcgccaactccatccgcgccatgcgacgccacgaaatcgaacgcatcggactagggtggatgagcggcgtcatcgacgacaaggcgtcgctcgcaggtatgaccgacgtatacgacgcggccatcgacgcatcgctcacctgggccatccgccaccaaacgcaggaaatgggactcgacgaagcgccggcggcaatcgccgtcatcggcatgggacgctacggcggcagggaagtgaacttcagctccgacgccgacgtcatcatcatctaccggccgtccgataacgccgacgacaaccaagccaacctcttcgcacgcaaagtgcaggaagacctccgcgccatcctgcaaggaccgaccacgctcgaacccaaaatcgaactcgacatggacctgcggcccgaaggcaaaaacggacccctcgtgcgctcctacgcgtcctgcgaggaatactaccgttcctgggcgagcacatgggagcaccaggcgctcctgcgtgcgcgttacgcggcaggcgacgcggcgctcgccgaggatttcctgatgaacgtcgccgacccgctgcgctatccgaagatcgatttgacggaggcgcaggtcgccgaaatacgcaagctcaaggcgcgtatggaagccgagcgattgccgcgcggcgtgcgtagggaccgtcacctgaagctgggcaaaggtggtctgtccgacgtggaatggacgattcagctgctgcagttgcagcatgccggcgacaacgcgaacctgcgagtcaacggcacgatgcaggcgttgaacgagttggagcggcgcaagctggtttccgccggcgacgccgtcgtattgcgacgcgcatggtggatgtgcacggccgcgcgcaacggcagctacctgtggagcgggcgcgtcaaccaggcggatatcctgccggatgacacgtattcgctgggaggactcgccgtctatctcggatacgacgcgaatcgcggacagcatttcgaaaacgatctgcttgccgtaatgcgcaaggcgcgcgacgtgacggaacgtctgttctacggcctttcatgaaacgattcgagcgggcgctcggtgaacacgcggtgaacgctccgggtcagtgtttcgggctatagttggctaggtcactttcagtggccaccttcaaccacaagttgcatgaaaggtgagccgttgtcctcagtactcgaaccggcggtcgaaacgccgatggtcggaaaaagcgtcatcactctcgatgatctttccattcgtcagattcaggaaatgctgcacaaagcgcagtacatcgattcccatcgtaaagaagtggcacacacctgcgaaggcagggtgcttgccactttgttttatgagccgagcacgcgcacgcgtctgagtttcgaaaccgccatgctgcgcctcggcggcaaggtgatcggtttcgccggcgcccagctcgcctccgtcaccaagggcgagacgatcgccgacacgttgaagacggtgtccaactacgtcgacgtggtggccatccgccatccgaaggaaggcgccgcgctggtcgcatcccgcgccgcctccgtgccggtcatcaacgcgggcgacggcggacacatgcatccgacgcagacgctcgccgacctggccacgcttcaatcgcgcttcggccgtgtcaccaacctgaccgtcggcctgtgcggcgatctgaccttcggccgcaccgtgcactccctgatcgaaacactgtgccgcttcggcaacgtcaacttcgtgctgatcagccccgacgagctcaagaccccgcagtacgtgcttgaccgcatcaacgccaccgaatcctgctcctacaccgaagtcaaggatctggtctccgtcatcggcgatcttgacgtgctgtacatgacccgcgtgcagaaagaacgtttcttcaacgaggacgattatctgcgtctgcgtgacacctacatcctcgacgaagccaagatggcgtacgccaagaaggacatggccgtgctgcacccgctgccgcgcgtcaacgaaatcgccgtggaagtcgacgacgatccgcgtgcagcctacttcgaacaggtcaagaacggtatgctcatgcgcatggcattggaaagctcggtggtcggtgacgaactgccgggatacgaaccgctcgcagccaaggaggttgaagcctgatggaagtcaccagcattcagaacggcatcatcatcgatcacgtgcccgccggaaccgcgctcaaggtacttgagtatctgaagatcgacccgtccaaaaccaagctcgcgttgatcatgaacaccgacagccacatgtacggcacgaaggacatcatcaaaatcgaggatgagaccgaatccatcgacctcgacgtgctcggcctcgtggcgcgcaccgcgaccgtcggcatcgtccgcggcggcaaaatcgtcgaaaagaagaagccgaccctgccggaacatgtcgtcaacatcatcaaatgcgtgaacccgcgctgcgtcactaccaccgagcctgcggtgcagatgttccatctggtgcattccgaccgtcaggaataccgttgcgactactgcgacgaggaagcgaagttctgaaatcatgaccctcacccttcacgacatcaaggtctggaacaccggcgaagtcattgacctcgtcgtcccctccgacacggacgcgtccgtggacgcctcggcgatgaccatcgcccctggattcgaagacccgcacgtgcatttccgcgatcccggacagacctacaaggagtccatgatctccggctgcgcggcggcggcatccggcggatacacgaacgtgctcatcatgccaaacaccgtgccggccatggatggcgtgaaggtggaggccggccagccgggcgcctccgaagtgctcgacgccgaatacgacacggtcatcgattacctgcagcattacgaggccgctcatggcgtgaaactgccggtgcgctacgacctatgcgtatgcgcctcaaaggggcgtgccggccatgaggccaccgaagtggccgactggatcggctacctgcccgaacatggcgacgagcataaggacgcctaccagctggcgcatccggtgaccgccatcagcgatgacggttccgcggtgacccccagcattctcgaacaggtgttcgaaaacgtcaaggagtcgggactgtacctcatcgagcattgcgaacaccacgacaccggcgcggtcaatgacggtccggtgtcccgcaagcttggcgttccaggcattccggaggacacggaactcaaaatcgtcgaacgcgacattgacatgtcccgcaaaaccggcgtgcacgtgcacttccagcacgtcagcaccgcgatctccttcgacgccatccgcaaagccaaggccgaaggacttccgatcacctgcgagaccgcgccgcattacatcgcattgaacgacgaggcgctgcttaagtacggcactttggccaaaatgaacccgccgctgcgctccgaagcggaccgccaggctaccatcgcagccgtcgccgacggcacggtcgatttgttggccaccgaccatgcgccccacaccatggaagagaaggaactcggcttcctcgacgcgcccaacggcatcatcgggctggaatgcgcatacggcgtctgccacaaggtacttgtcgacggcggattcatttccgacgaacgtctcatcgaactcatgtccaccggtccggccgaactcatgggccacgacaaaacggacatcacggcggtgctcgacgactacgccgacgccgtgccgggagacgacgacaccaagcgcgtgcttgatctgggccgcgtgcccgaaagcgaccaggtggatctcgtggtgctgaacaccggagaggaatggaccgtcgacccggagaagttccactcctcggcacgtaacaccccattcggcggatggcaggtcaccggccggccgctcgccaccatcatcggctcgaagctggccttcagccgcatcgacaaggaggactgatggaccgtctgatcgaagccatcgaagacaagcagaatccaagcgtcgtgggactcgaccccaccgaagcgctggtgccgaagcaggtcgtggccagcttcgccgaggaaatcgccgaacaggtggaggatccgacggaagcgccggcagcccaactgtccgtcgccttcttcgaattcaaccgcgccatcatcgacgcagtagccgacatcgtcccggccgtcaaaccgcagatcgccatgtatgaggcgctcggaccagccggcatcgacgcctacagcatgacctgcgaatacgccaaacagcagggactgtacgtcctcggcgacgtcaagcgcggcgacatcggctccaccgcagccgcctacgcccaccatctgagcggtgtgaacgcgggggagcgcgctttcgacccgtggcatgaggacgcggtcaccgtgaacccctacctcggcaccgacggcatcaccccgttcgtcgaagccgccactggtgccgacaaggacatcttcgtactggtacgcacctccaatccatccagcagcgaactgcaggaactcgaactcgcctcaggcgagcgcgtgtacgagcatatcgccggcctcgtggaaggctggggagccgaaaccatcggcgcgaacgggtattcccgtgtcggcgcggtggtcggagccacccatcccgaggaaggcaaggcgttgcgggcgcgcatgccgcacacgttcttcctggtccccggttacggcgcgcagggcggtaccgcccaaggcgtggccggcatgttcgacaaagacggcatgggcgcgctcgtcaattcgtcgcgtggcatcatcggagcctggaagaagtccggcaaatacagcgaatccatgagcgcagacgatgcgctcgacttggtcgccgaatcggcgcgcgaggccgcgaaggacatgcgcgacaatctgcgcgcggtactgccgtaagctaccagaacaatcgaacgaaacacaggaaagggagtcatgaccgccgcagcaacgttcatgccgaccgtcggccaggcgagggaagcgggatttttccccagcaggcacacggtcgaaatcgtcgacaaccgcatgctggccgatggcgtgtaccgattgacattccgcgacgaattcatcgcgggacatgccaagccggcgcagttcgtcgacgtgtattccaacaatccgagcagactgatgccccgcccgttcggcgtggccgaagtggatggcgatgaggtgagccttatcttcgccgtcgtcggcaaaggcaccgccgaattctccgaattgcgtgcgggcgacaccattcgggtgatgggtcctctcggcaactccttcaacaccaaggagaacgcgaactacgtgctggtggccggcggtctcggcgtgccgccgctggtgcgcgccgcgcaggccatcgccgaatcggaggggtcgacgagcaccgcggtgttcggataccgcaacgtgcgtttcggagacggatacgtcggccggtacgcggacaagacatacagcatcgacgaatccgaaggcaatgtcgtaacgctccttgaccgtattgaaaatgaactggtgaacggcgagctgaagccggtcgtcctctcatgcgggccgttgccgatgatgaaggccgtcgccgcatgggcggcgaaacgcggcatcgaggcacagctgagcttggaacagcgcatgggctgcggatacggcacatgcgtgctgtgcaccgtcgacaccgccgaaggacgattgaaggtctgctcggacggacctgtgttcacccgcgaacaattgggatggggggagtgagcatgaccgcagaacaacatgcgaacctgtacgaacagcacgaatggaagcatcccacccaggtggctggtatcccgtggaagaatccggtggcgaccgcttccggcacgttccaatatgctgccgtgcgctggttctatgacgtgagccagctgggcgccgtcaccaccaaaggcgtgtctccggtgccatgggaaggcaatcctggcatccgtactgcggaaggcccctccagcaacatcaacgccgtcggcctgcagaatcccggcgtggaccattaccttgaggacgatctgccgaaactcaaggccatcaacgccaccgtcatcgccaacgtcgccggacactgcgacgacgactacgcggaagtcgtgtccaagctcgacgattccccggccgacatgctggaaatcaacgtgagctgtccgaacgtgtccgcaggcggcatgagcgtcggcaccgacccggtggctttgagccgcctcatcaccagactgcgcaagctcaccgacaagaagatgatcgtcaaactcaccccgaacgtcaccgacatcaccgtgccggcacgagccgcggtggaaagcggagccgacgcattgagcctgatcaacacgctgctcggcatgcgcatcaacatccgcaccggcgagccggtcatcacgcacgtcaccggcggcgtgtccggcccggccgtcctgccggtcggactggctgcggtatggcgcgtgcgcgccgcattgccagaaataccgatcatcggcatcggaggcatcgactccggcgagaccgcgctcgaatacctgtatgccggcgccaacgccgtcgaagtcggcgcggccgcattgttcgagccgaccgcgccgctgcgcgtggcccgcgaactcgacgatctgctcgacgaacgtcccgaactcgccgacaagctcgccaaaggcgagacctggcgctgaaatttcgtaatcgatcaatgtaaggagaacaagcaaatgaccgcatcgctcgaccatcgtttcaccgagttcctgctggaatcgcaggcgttgaaattcggcgagttcacattgaagtccggccgcaagtcgccgtacttcatcaacgccggcgcattcaacgacggacgcaagatcgcccgtctcggcgcgttctacgccgagaagattgtcgaggagatcgaggcgggcaacctgcccaaggacatcgacaccgtgttcggccctgcctacaagggcatcccgctgggcgtgtccaccgccatcgcgctgacgtccgcccatggcatggaggtcggctacaccttcgaccgcaaggagaagaaggaccatggcgacggcggcatgatggtcggcacgcagcttgcggacggcatgaaggtcctgctcgtcgacgacgtgatgaccgccggcaccgctgtgcgcgaggtcatcccgaagctcaaggccgaggcgaacgtcgaggtcatcggcctggtactgagcgtggaccgcatggagaagaccaaggattccgacacgtccgcggtgaaggccgtcgaagccgaattcggcttcccggtgttcgccatcgccaacgtgaaggagatcttcgaagccggccagcacatccagaacgccgacggcaccccgtacgtcacaccggagatcaaggccgccgccgacgcgtacctggaacagtacggcgcctgactgcggcgttcgcgctgaaccgcgctcatcggctgtcatagtcgtctcggatatgacagaaaggcactgtgctgctttcgggcagtacagtgccttttcgttgtggttcctctgttccggggtcagtcgatgagcgtgtagccgtggctggcgaccaccgacttgagcttctccaagtacgtttcggcggccttggacagcttcgcgcgctcattggtgatccatccgacaagcatcgtctcatcggtgtcgagcggcacggtgacgatcttctcgttgttgagatcgccgttgtcgatgccggtgcacaccgtgtagccgttcaggccgatgatgaagttcagaatcgtggcgcggtcggtcacgttgatctgcttgggggagtactccggccagacggcctcctccgcgaagaagaagctgccttcctcgccctgctcgtattggatgaacgggaacggcttcagatcgtccatggtgaccttcttcttgccggccagcggattgtcgcgcgagatgaacacgtgcaacggcgcgcggaacagcggatggaactcgagatgcttctcgcgcagcagcttgccgatcacgtccttgttgaagtcggacaggtagatgatgccgatctccgaaagcatgttcgccacctggttgatgatgtccttcgtgcgggtctcgcggatggtgaactcgtattcgtcggacttggtggagtcgatcatctccacgaacgcctccacggcgaacatgtaatgctgcgtggacacggagcacagctgtttgcggggtttcgcgttcttgtaccgttcctccagcagtgacgcctgatcgaggacctgacgcgcgtaggtgaggaattccgcgccgtccacggtcaacgcgatgccttgggaggaacgggtgaagatctcgatgccgagctcgttctcaagctccttcaccgaggagctcaacgcgggctgggatacgtacagctcgtgcgaggcctcgttcatggagccgcattccactattttgacgatgtatttcagctgaaggagggtcataacgcccatttataccagcgtcgctttacgaaacgacgatttatagcgcttcgttttgcatagtggacacgcggtcggtggatgtgcggcctacagcggacgatgatatgggcgcatggccgaggcccgttccgcgggacgcaggcgtacgtccgccgcgctcacacgcgcacgcccaaggattccaggtccctgcgcgcctggtcggcgtcgacgaaacggaaggcgtgcatgccggccgaccgcgccccggcgacgttcttcgcggtgtcgtcgaggaacacgctgctctcggggcttaggccgaaacggctcatcgccagttcgtagatgtcggcgttcggcttgtgcatcttctccacgccggagacgacggtgccctgcagcagttcggcaagctgcgggaacttctcgaatgcgaaatggaacgtctcatgggaccaattcgtcaatccccacacgccatagccggccgccttcagatcgcgcagcagccgctccatgccgggcagcatgcgtggcagcgcgtcgtcgtaatgcgcgatgtaataacggaagatcccggcgacgcgttctccctgctcggccaccacatcgggccatatcgaatcgaagtcctccccggcgtccatacggtcctcgtatccgaagaagccgcaggggtcgtcgtcggcgcagatgcggtcgacggtcgcgtcgtcgaatctgccttcaaggcatgcccgtgtccgccaatccagcaacactccgcagaaatcgaaaacgacgtcggtgatggtcggaactgcaacggtcatcgggaaacccttcttgtagcgtgcgtctgtcttccgccagtgtaccgtacccatgttcgtgaaggacgttttcgtcttcgcgtgcggcgtttcctgaaagtcattggggcggaaaggctcgcttgggtttttgaaaaaggctaatctagacgttttcggagattgtgatgattgtcatgccgaccatttcgaacatacaatcaatccgaaattaaatcaacatgttgtctgaatagacgggtgtcctagtggaaagcattaggaaggggccgacgatggcatatatcgaaatggtgcacagcttcaagcgctaccatatgggcgacatcacaatcaccgccaacaacgatgtgagtttcggcatcgaacgcggcgagcttgcgatcattctgggatcatccggagccggcaaatcgacggtgctcaacatcctgggcggcatggacacgaattccgaaggcaaggtcatcatcgacggcgtcgacatctcggacttcaacgcgaagcaactgaccgattaccggcgcaacaacatcggattcgtgtttcagttctacaatctggtggccaacctcaccgccaaggagaacgtggaactcgcctccgaactcgtcaagaacgcggccgatccagtgcagacgctggtcgatgtgggacttggcggccgcggcccagctggccacggcgcaagcgcaactggcctcggccaacgcgtcggtcgcctccggacagacgcaactgcaggcggcacggacgcaactggctcaaggacagaaccagctctccgattcatggaaccagctggcgaacggcaaaacgcagctggacgcggcgcgagaacaactcgaaacaagcaaaaccgtgctcgacaaagtcggcgcgacgctcggcaaatgggaacagaccggcatcaccggcaaactctacgaacaaatacgcggcaaatacgacatggcgatcaaccagtacaacgaagcctgcgccgaatacaacagacagctgaacgcctacaatgcgggactgcaacaataccagaacgccgtagcgcggctcgaccaaggttcgcaggcgtatcggagcaatgcggacaatctcgcacaggcatccaaacagatagccgaaaaacaaaacgagctcggcaaagcggtgtcgcaggccggcaagcaagtcgcagacggcgtcacgcagcttatccaaggccagagggacatcgacaaggccgaaacggaataccagagcaaactcgccgaattcaacgcgcagaagcccgaagccgaacgcaagatatccgaagccgaacggcaggtaaccctcgccgaggagaagatcgacaatctcaccgtcccggcctattccgtcagcggccgccgcgaaggcctgacctcgcaaggctactgcgtgtacatggtcatcgaaggcatcgtggcgaaactggcggacatcttcccgatcttcctctacttcgtcgcggcgctcgtcaccttcagcaccatgggacgcatggtggacgaggaacgcaccaattccggaacgttgaaggcgctcggctacggcaacgcggatgtgatgctcaaattcatcgtatacggattcgccgcatccaccctgggcacatgcatcggcgtgctcgccggccacacgctgctgccgcttatcgtcgcccacgcatacagcgcgggattcaccatgccggacatcatgctcaaattccacccctggatcaccatggccgcattcgcacttgcatggataagcgccgtcgtgccggcatggctggccgcgtccaaggaactgcgcgaaaaaccggcgagcctactgctgcccaagccgccggccaaaggctcgaaaattcttttggaacatttcccaccactatggaaccgtctgaatttcacacacaaagtgaccgcccgtaacatcttccgatacaaaacacgcatgttcatgacgatcttcggcgtatgcggagcggtatccctgctgacggccggcctcgccgtccaatcctcgatcggacagataggaaaccgacagttcgaggaactcatccactacgacctgatcgtcgccgaggaatccgacaccaacagcgcgcaacgcgaggaaatcgccacgacgctgaagggcaaaaccgtccaatcctcgacagcggtgcgctacgaggaactgtcgaaaaccgcaggcaaggagaacgataagcagtcgatcaccctgctgtccaccgacgacgcatacaacttcaacgaatacctgacattacgcgaccgcaaaacacaccaaccacagatactggtcaacaatggcgcggtaatctccgaacggctcgccgaaatgctcaacgtctcggtcggcgacaccttcacggtaaacgacgaaaacggcgcgcaacgcaccatcaaagtcgccggcatcagcgaaatgtacatcggccatttcatattcatgaacgcgcaatgctacgaacacgtgttcggcgaccagtacagcacaaacgcatacatggtcggactgaaagaccacagcaacgccaacacggaacgccaaggcgccaaattcatgaaactggccgccgtgcgcggcgtcgtgcagaacacgacgcagaagaacatggtgtccacaatcgtgggatcgctcaaccagatcatggaagtgctgattctcgtggccgtgctgatggccgtggtgatcctctacgacctgaccaacctcaacgtgtcggaacgcatacgcgagctatccacgatcaaagtgctcggcttccacaccagcgagaccacgatgtacatctaccgcgaaacgatcctgctgtcactgctgggcatactcgccggatacggcttcggagaatggctgcaccgatacatcatcaccgaagtgccacccgacgaagtcatgttcgaccccgccatcagctggatcgcattggcggccccggccatcgtcgtggccgtggtactagccgtgctcggctggatcgtataccgccagctcgaaacggtggacatgctcgaagcattgaaatcagtggaatgaccctccacgaaacggtcagcggagcagctcgccaaaagcccggggaacagccgcgacgacatcaccggcaacaatcggatgcccgatcgcgctcgccggagtcttgcccgcatgcccatacagatgcggacgatgccatccgcgctgctccgacccgctggccatcgcgccggcaagcccatgcatatacgcggcggccgcggcgacctccggaaccaaagccggatcgtcggacagcatgtcgtcctgctgcgccagcaacgcgcccaacacgccggccaacacatcgcccgaaccggcggtggccatccaggcaggcgcgcgcccggacaggatgatccgcgtgttcccatctccatcagctccaaccacaatggtgaccgcgcccttaagcagcaccgtggcccccgtaagctcatgcgcgcgcaacgccgcccgcaatggccgggcctccacccactgcctggaaacaacatcagccatatcggcatccaaccgattcagcaatgcggccaattcgccggcatgcggagtgataacgacctgcggcacaacatggcacggcagcaaatccaacgcgccggcatcaaccacaatgggaggcatgccctccgcccgctcgttccgcgagccatcgccatcctccaacgcgtaatgatccagcagcgcggcaatggtcgcacgttgcatgtcatcaccggaagcaacgtcaccctcggcgggcacgccggatccaaccacccacgactgcacccggcccttgcccaacacagcctccggcaacacggacaatatcatatcctgcgtacgctgtggccccagataacgcaccatgcccacattcgcgcacgccgcggccctcgccgacaacacggcagcacccggataccgcgccgaaccagtcaccaaaccaaccactccacgcgaatacttgccatccgcaagagacggaagacgaaccgaatccgccacaaaatcgccatccgtcatctcggcaaacggaacagcatcatcgacatcgaaaccgaaatcgaccaacgtgatccgtccgcaagcatacgaagccggcggcaccatcgcacacggcttcatcgcaccgaacgtcaccgtcacatccgcaggaatatacggccccggcaacgaaccatcatcaacacccacacccgacggcgcatcgacggccaccaccaacggcaaatcagcggaagggtcattgttcggcaacgcaggcttgtccggcaacactccatccatacccaaagacgaagccaacgtgccagcgacaccacgcaacgcgccgaccacgccaatccccgtcatagcatcaagcaccacatgcgcaccccgcgcacactcgaccgcagcctgcagccgctcaccagcctcacccgcggaaaaaccagacgtgcacccagaaatatcagccgccggatccaacaccaacacacgcccacccgcacgaacaaacgccctaaacgcatcctcatgcaacgaacggccaacagcaaccgcggtaacctgcgcaccctcacgcgccaactcagcccccgcatacaagccatcgccaccattgtccccagcgccagccaacaccgtgacccgcgcatcctcaacatccaaatcctcatcatcaagcaacgacaacgtcacacgagccaccgcagaagcagccatacgcatcaacggcacaccatcatccaacaaaggacgctccaactgccggacaacatcggcggaataggaactatacaacaacgtctgcaaacggtcggcatcatcggagacatccatggaaaatcctttccctcggcgtggaaccacaaacaccactttagtcgtatattaaaaacaacaaacaaaaacggcatggacgccaaacaagaaaacggagcggaacatggcatacatcgaaatgaaaaacagcaccaagctctaccacatgggatccaccaccatcaccgccaacgacaacgtctccttcaccatcgaacaaggcgaactcgccatcatcctcggcgcatccggcgcaggcaaatcaacagtgctcaacatcctaggaggcatggacgccaacacctcaggacaagtaatcatcgacggcaaagacatctccaactacacacccaaacaactcaccgcataccgccgcaccgacatcggcttcgtattccagttctacaacctcgtcgccaacctcaccgcacgcgaaaacgtagaactcgcctcacaaatcgttcccgacgcacaagacgcccgacaggcgctcgccgacgtagggcttgcggaccgcgtcgacaattttcccgcgcagttgtcgggcggcgagcagcagcgtgtggcgatcgctcgagcggtggcgaagaatccgaagattctgctgtgtgacgaaccgaccggcgcgcttgactacaacaccggcaagcaagtgctccgcattctgcaggacatgagccgcaagaagggcgcgacagtggtgatcgtgacgcataattctgcgattgcgccgattgcggaccgtgtaattcgcatgcatgatggacgtgtgtcatcgattgaggtcaacgagcatccgatggatatcgaagagcttgaatggtgacgttgcgacacgctgtgatacgtatgatttgcgtaaatggctgattcgtgtaatatatgtgacttgtgcacggaagctaagtcttccggtgggaacattcctgcgtagctcagttggcagagcatccgactgttaatcggacggtcactgtagcgcacttccttcacacggaaggggtcataggttcgattcctatatcacccaccgttatcacagctcggttttgccgggttttttgtttccattccttttcacgctacttcgtcagataagaatgcaagcatcgacgcgccggcaaaaacagcgatcgacgaaaaacgattcaccacattacacaagaattgccgatgaaaatacaaagaatcaaacgagagaagcatgacttttgccaaacgcatttctaaaatgagtatcgtaaacaaaaaagaaaacaaacaagacgcaaggtgcgtcacagcacgccagcaagaaaaggaaacatcatgaacaagaacaagatcttctccgcaatcatgcgtggcttcgaagtcagcggcatcaacgctctgtcttcggctgccggctcctcttccgtcaacggcgctctgcaggagatcatcgacacccgccgctgatttggacaccacacactgaatccttcttgaaaaagcctggaacgcgattaaaagcgttccaggctttttgttccccggcaagcggctacaattgcctattgtgaacgagagacaattgaacctcaaccaaccggttaaggatatgggccccaacgaattgaaagcgtacgccgagctggggcagaaacaacacgatgaggcgaaccgcgaactggaacgacgctggcgcagctacgatgacatgctgccgaaggacgaattcgtatccatcatcgacaagaacgaacggtaaataccgttcacagtgtatgattcgtgaccatgccggccacaataccggccaattgcaaggggagagggtagaatgacagctatgactgatccgattccaagcgcaggcgaaacgaccatcattggtcttcctgctatcactgtaccggttacttccaccggagaccgtcctctgacgaaggaggacctcaatacgatcatgcgtctggccgacggcacggcgctcctgatttccaccaggggagcggtgtccggctcgcgttatctcctcgacgaggacgagatcaccgtgggacgcgacccgagttccgacatcctgctggacgattccaccgtctcccgcacgcacgcggtattccgcaggattaacggaaagtattcggtgattgacgccggcagcctgaacggcacatacgtgaaccgtcaacgagtggatagccaggaactgaagaacggcgacgaaatcattctgggcaagttccgtctcgtatatttcaccaacaaggccgtcattgcctaatgaaacgcccgatgcgggataaactgtgagtaacggttttccttcaatcgcctatgggctccgaatggaagctcataggcgattgttttatggcgtgtaggagaagacaatggacggcgaggcagaaccaacaatgcggttgcatctgcacgtgtcgcacgcggtgcagggggagttgttcccctccgcggacgcgcagcccgtcacacggggctatcgtggtacggtcgcgtcaaaagtggcgggtatcacgtaccgtcagcttgactattgggcgcgtaaacagatagtggaaccatccatcaccccgtcgcacggatccggctcacgcagattgtattcgttcaaagatgtggtgattcttgccgtttccaaaagattgctggatgccggaattaatctgcagaacgtgaccaccgccatcggcttcctcgcgcagcgcacgcccgaacagttggccggcatcaccatcatgtgcgatgggcagaatgtgcatgagtgcacggacagcgaacagatggtggctctgctacaaagcggcagagctgtgttcggggtgtccgtcggatcgctatggcatcagatcaaagaagctctagaacatgaggaatatgtcgatttgacgaagacgccggcatcgacagacaccaataggccaatcgacgacattgccgcgatacgtatgagaaagaagctggaatcgcggcgcaaatcccgcgcagcagcctgatcgcatacaattggtacgattcagcccggaacattcgaacgatataacccgcaggggagtagcgcatgcttgatattctgccggcactgttgtggatcatagccgccgtcatcgcagtgaacatttgttcgattactgcgattcgaggcaatctgttttccaaaaaacaccgcgatgtgcatccggtgcgttggtcgatcatcgcgctgcatttcacctcattggtcattggcgcgttgccatatccggtatatgcgatgttcaggtcggatttctcggcgaagttccgtcgtttctacgaacatgtcggatggccgtcggctgcggtgatggccatgctgatcgcagcggaacttgttttcatgtatcttcaggcccgaaacggcatgcacagcgagatggagcggaagctcaatcaggccgtcaaatagaaatctgacataacgtacattatcggcttttcaggaatgacgtttttccaggcttgaggaagcgtcaaacacgcggttctgacataacggcttccgtcactcaataaaaacgtggttgctgccacgatattgcgacagcaaccacgtaactggcctacagcgtttccgtttacggactcaggcgaaatactcctcgacggcctgcgcgagttcatctaccgaatccagaatacggtatgcgccatgggctttgagctctccgggctccgcatagccccagccacagccgaggcagtccaaaccgcacgccttggcgccgtcggcatcggtccaacggtcgccgaccatcagtgccttgtctcctgcgttctcgtcgaaatcgatgtgctggaaagcccaacggatcacttggtccttgtcaagacgggaattgtcctcgctggcaccgtagatgccgtcgaccatggtgtccaagtggaaatgctcgcaaatcggaatgcattggtattgcggcttgcagctggcaatcgccagatagtatccgtcggcacgcagtttggcgagctgctccggaataccttggtaaatcgtgttgttcaggcggccggggactttctgtccgggattgttcgggtcgtcgaacacggcctcgtcggcgtaatacttgcggtaaatcctcacgccttcgtcaagcttgtcatccggaatgccgttgcgttgcatcgattcgctgatggccggtccaatgaaacgatgcaattcggcatcgtccggcaccggatatcccatctcttcgaacgccttgacaacgcagccaatgattcctggatcggatttcgtcagtgtgccatcgaggtcaagcagaacgactttcttcggatgttcggacatggatctgattctccccttggttgtgtgctataagaattgatgacagaaacaattatgcccggtctcaatgaccgggcattcgttcaagtgtcgttcaactgcaggtcactcgtagtccgggaaccatccgtcacgatgcatttgcagacgcttctccagcaaagccttcagttcgtcttcggtacgacgttccatgagcatgtcccagtgcgtgcgtgtcggcttggcgatttcatcagcctcgtcgtcattgtctccttcacggtgcgcgacggcgccgcagcggcactcccactcatctgggaattctgcgccctcagcgaacggcagaatcgtacgatggcctttcggacacacgtatgcgacgtcggttcgcgccgcaaaatccacattgtcatcggattcaagcgacttcgcaccgatgctcatgcctcgcaggctacgttccgccatattgcttttgcctccttgattatctgcttactctaagctacaaaacacttcggacgtgtcacttattcccggcgtccgcgaaaaccgatctcccgattgcgcacatgctcagtcgacacctgaataggcgacgatgccacggttgacgttctcgtacgcctgtttcgcgatcggagcgagcgtttcggcgcgtttacccaggtatggtccggccacggcgatctgctgcaacacgtcggcgagacgtttgcatccgcgtacgaaatcgccgccggtcaaatcggtgccgtacagcacacgcgacaggctttcgccctgagcccattcgtagacgacatcggtgatgccgaaatcaagttggcgcggctcgtcgagggcatagtcctcacacagcatggcaatcgacgcgtgcacgcctttgagctgcgccgcacagatggcgacgttcccctgcattcctccgggataatggcgcggctctcccccgctgcctctgcgcggctcgtaaatcaacgacatgacggcgctggccagctccgtcgcatcgagtccgtcgaacgcgccatcatcgatcgcctgggcaagcaccaaatcaagctcgctgtacaagtgccgcaacagctgtccacgttcggtaagccggtaatcgatatgttcttttgcgccttcatcaagccgatcgaggtatccgagctcgttcagcacattgcagatgcggtcgaattgacgtgccacggagccggtgcgtgaatcgtagcggtgctgcacacgttccaattcacgcatttcacgcgcccaccgatgcccccatttgagatgcttctgaatatcggggcatttgcggcagggatggtccctgtctttttcgcgaagctccgcgatacgcctgtcaaggtctttgaacgcttcgcttcgcgccttctgcgtgcggaacacctcgtgcttgagtttgcgtcgttcgttcttttccaagtcgctcaagcgcatgcgcagccgcatgaactccttgaagtcgccgaactcacaatcgaacgcccgttcgtatccgtccaacgctttgcgcaacgtatccatctgcgcttcaagctgccaggcggattcgttggcctcccattgcgcgaaggaatggtcaagcgtgatgcgagcggtctcgtaatcgctggaattaagcaggttgacggccatgttgaacgtcggtttgaaactggagtgcagcgggtacacgcgcttgctggacagcgcggcggcagtggcgggaatgaagccatgatggtccacaaccaccgcatggccgatggtgtcgatgccacgtcggccagcgcgtccggtaagctgggtgaactcccctggcgtcaatccgacatgcccggtcccatcgaatttctcaagtttttccaccaccacgcaccgtgccggcatgttgatgcccaaggcaagtgtttccgtggcgaagacgaccttcaccagcccctcttcgaacagtcgttcgacaatttggcggaagagcgccaccatgccagcatgatgcggcgcgaatccttcctccaaggcgaagcggaactgcgagaaatgcaaagccttcaaatcctcttgactgagttggccttcgaccatctcatcgacgatacggcggatgcgacgcacctcgtcatcggtggtgagttcgagtccggcgttgatgcattgttcgacggcctgatcgcatccgttgcgggagaagatgaaatagatgcccggcaggatgccgaggaaattcaattcatcaatcacggcccaacgacgtggcgtatggcgttcgggtctgcgggaatggtcgttccatttgccgcccttgccgccctttcgtctgtcggggcgctgctctcccctacgtttcgcggccttgcggtcgagctgatcgagcctgctcaccagctgggcgttgagcttgtctgtctgattgccgtctttatcacgtcgatacaggtcgatgagttccggttcggtgtggtcgtccgcctgaacaagcacatgctgttccaacggcacgggccgtttttcggacaccaccagcgtggtgtcgccacggaccgattcaatccatttggagaagtcctcgacattcgacacggttgcggacaggccgatgattctcacgctttggggcaggtggatgatcacttcctcccacaccggcccgcggaaacggtcggcgagatagtgcacctcgtcaagaatcacgtaacgcaaggcgtcaagcgtcatggaatgctcgtagagcatgttgcgcaggacctcggtggtcatgaccacgatgtcggcttcggagttgatggacgtgtcgccggtaagcaggccgaccctgtccggcccgtacgtttcgaccagatcatggtatttctgattgctcaacgctttgattggcgtggtgtagaacgctttgacgttacgctcttgggccagatagatcgcgaaatcagccacgaccgtcttgccggctccggtgggcgcggcgacgagcacattgtcgccggcttccaacgcatcattggctttgacttggaaatcgtccaattcgaatggcatggaccgtgcgaaacgagacgagaccgattggcgtttggcctgcgtctgtttgaacgccgcatagcgttgcgcgggagatagggctgtggtcatctcggcatcgtatgtgccggtgtcgttattgccatgtcgacgatgatgagtcatggttccttttcgaatcagtcgttggaatgtttccactgcgcccactgccgggcatgacggacgcgcttttcctcacggcggctgatgacttcggcatgagcgtcgatataacgattggccgcgtcctcaagtggacgtgtgaagaatggggacgtgttctcctttggttgcggcaacggctcggacatggcctcgaaacgtttggacatgcgtccgcctactttgatggcatctttgaacgcatgatatccgcggatgcatgcgtatgcgccgccgccgaccagcatcgtcagcatgaacaggacgagtaccagccaaatccaccaaggcatagcgcctcccccgtcagtcttcgttctctcggtcgccgacgctcagctcatgctgtgctcgggcgatgatcatcgtgcgcaacgtctccggcgcgacggcagtaatatgacgggcgtgcgcgatgcagaacgcgacataccaggaatcggaagacacaatcagatgcaccttctcgccttcgccgcatttctcgacggtggctcccgacaggctgtcgatgaacgacaggtcgtcctgattggttatgaacacggcaggtgtgccattgtcgaaactccacttgcgcagttcggatgcgggcacgtccggaatgtccactttttcagtgggttcgactagctccgcatgctcgatgcgggagatgcgaagcacctgccagatacgaggcttgccagtagccttgttgatggtcgtatccgtcttgacgaacttcatcttgtccgcgggcgccgcgttggacacgtcggtccataccgccacgtagtaaacgccttcgtcgacaaaaatcttgtctggcgccactagcttgcgctgtatacggcccgcaccgtccgtatattccatgtcgagcagcatgcctttggagatggcgctcttgacgatggagaagttccttggttccatctcgtatccggtcaggctcagccacggcatgtcgccaggcttgacgtgctggcgcagtcggctgtacagcgattccgcctgctcacgcagcttgtccggaagcaaagaggagtgggcgagatagctcaccgatgcggtcagcatgctcaggtactgctgggaaatgccggcaaggcgttcaagccccagcgaattcgtggcggagacgatgccttccgcgtcaagcaaggaccaatcgatatcgaagaactggcttccggccatctcgccatcatcggacaccgtggtcaacgtgttgatgtccttatgaatgatgttgacgaacttcttcaattcgtcatcggacttcggcctgccgatgaatcgttccgcaagttcttcaagagagtattcctcacccatgtgggcggacaggaacagcatcaggcgaagacgccgatcgacctcactaccggtctggaacgcggagttcttcttcggacggcccttgccttcctcggtatcatcctcatcagtgctgttgcggttgatttccggagacaccacggtggagctgtcggtgccggtggattcatcggccggcacgaactgcgtggccgcatgcagccggcggttgaacgcgtcgacagcctcctgagggctcactatggacgcacccggatgagacagcacgaacatggccagatcatcggagtcggcgtaggcgacattgagatgctcgccatcaacatccacagtggcggcgaaacgtcgctgatcgaccactttgaccagctcgtcgggaatggattgcgtgccaagacccggcgcgatggaatccaagccaagtcctggaatcggcgtctgcggcacgcgcggcgcggtacgggaagcgtgctggggttcgtgcgcaggagccgaggaaatcgacatggagcgcgcaaggtaattcgcagcggcaagaatcggcagatcctcgtcgccgaacagcagacgcacgcgcggctcatcgccaagctgcagacggtaggaagcgaaatcctgcccttctgacttggaggaatattccggctgccttgattcgatggcgatgcccatggcggcgagcttggcgcggtcacgctgaaattgcttggcgaaggcggccttcgccgcttgatcggcgagctctccgtacgaatcggcatacgccttcacacgttgcgcgatctgacgtgaggtaagccattgcggaaaggctgaggagagcacagccaacacatcaagctcatgcttgccccatttgtcggaaaaacgtcgcctaccgttacttccctcagccattagtcctcacgtctcgttaacgtttctttttaagtgcttggcctcgtaagccgcacacaacattctatgatagaggttttttaagcgatttgtgcctatttcacgaaaaaacatcgttttcgtgttgcatggccgtccaaaatcagacccaatcgtccggttccacgccctgcgggccgacatattcgccattcggcacatagcttggttcgccttgatcctccagtcgcgcgtcgctaaacagcatcacatccctgccgaaggtccaatcgccatcgatattaacggatttcgccgcggcgagcgaaggcacaccgtatgggaaacgggcatcgaaatcgtggatgttcttgtaatagcgcgcgtccaaatggacgtcggggaagatgtagttgccgtcttccatctcgtactggtccgtcagatggaatcggtcggaccgcatgatgaacaaatcgtcagtggtcttcaccggcaggaaacgcatacggtcgacgcatacgcaggtcgcgccatcgaaaagcgacaccgcggctcccatggcggtctccagctgaatgaccggctcgctggtcggatcggtcgggtcgaccgtcttcttattgcggattaccggaaggggaagcacgccgtcataggatgcgagtttcgctttcagcgcatcgatacgcacccaaatgctgttcgtgttgaagtacggatgcttgtcgatgttctgcgcgtcgtccttgtcgtctggatggacctggctcatctcacgcagcatcagacggcccgtggccttgtctcgcacgatgtggccgcccttacgatcggctggggtgcgtttggcgacctcgatcatgaacggtgcgcccgtattctcgaaatgctgcgcaagcgtacgggagggacgcgcgcccaggttgtcggaattggagatgaaaaggtatttgaacccctgcgcctcaagcgcgtcaagcagaccggattcccaaatggtggagaacaggtcgccgtggcccggcgggcaccattcgagttccggattggccgggaagctgacgggcattcccgtttccacgctgatcttcggctcctgatgctggatgatttccatcgggatgtcttcctgatggaatttcttattggtctgcagcaccttcatggtgtctttggaggtacggaaggagttcatcagagtcaatggcagatcgacgccaagtctggtccgcgcggtcaacacctgtccgatgatgatgtcgatgaaacgcatctgccgtgccttgtggcgacgtaccggcagcagcgacttggcacaatcgagtcccatcgaagtgccaagaccgccgttaagcttcaggaacgccgttttggcgaacgcgtcaacggccttgtcgtgattgatggtctcatacacgtcatggaagctgggaacgctgacgagcggttcgacctcgtcctcacgaatccaactgctggcctcctcattgcgccagacctcgtacagacgacggaactgggcgatggccatgtcggtcattccgtgcttccgcatcttcgcggcagagtattcgaatacgtcctcagtcaatgtctctccctttcgaacgggcgttgttattcgatgcgcttatgccataatacgacattccgccaaaatcgggggcatttagacacagaaccaacatgaacttccggtggagcaattgccggaaaaccctcaaatatccgaagccaaactctccggaatggatgcgactcgctttccgacacgatgtgtttgaaaaaccgtagagattatgctatgtttcatattcggtgcttttcgcaccgttcggaccatagcgcagtttggtagcgcacttgactgggggtcaaggggtcgcgggttcaaatcccgctggtccgaccaagaaagcccgtcgttccgccgttttccacggcatcgaaacggcgggtttttcgttatgtttgggcaggtttgggcagtgaactgcggcatacagctcctcagaatggcatctatcggagccggaagccggacgtcaggacggtcttgagcgcatgcaaatatgtagcctgcgatatttttcatgtttcttgccgtttaatgcgattaacgcatgggttcagagaggtgattcggtttgcagcagaacaacacgcagccacagttcgacgacgtcgacgaattcgcccatgtgttcgattcaacgcttcccgaagatgaatggaagattcgattgccccgcgagcttggcttggaagcccgcgaacgcgctcggcatgatggcatcacgcttaccgaattgacccgcagggcactcttgtccgacgattccgatggctgttcagacgcggtcggcatcgggcgcatgccaaagaacagcgacgggcgcaaacagcttggcgacgaatggaagatcaaactcccctacgccgtaggccataaggcgcgggccaaggccaagcaggacggcatttcattaagctcgctcgcgcgcagagccataacggggtatctcagaacacgcaaccaggatgaacatcctctgttctgacgctgtcggcctaagctgtgcgtaaaggaaaacaaaagccggcaacgacccagattcaataaggcagatgggcgtgcgccatggtctgaaccaggcgcacgcccatcttctaacagttccggtggttacttgcgtttcttcttctcacggacattcaccgaaatctgaatcggcgatccttcgaagccgaattcctcgcgcagacaccgttcgatgtagcggcgatagccatgctccaagaagccggtggcgaagatcacgaagcgcggcggtctggtggacgcctgcgtcgcgaacaggattcgcggctgcttgccgccacgcagcggatgcgggtgggcagcttggatcttgccaaggaacgcgttgagtttgccggtggggatgcgcttgtcccatgatgccaaggcgccacgcatggcattggccaaacgattggtgtgccatccggtctttgccgacagattgacgcgctgagcccaagtgacgcgattgaactcggtcttccacaggcgttccatacgctgacggtcgaactcgtccatcaggtcccacttgttgaacacaagcacgatgcaacggcccgcgtccacggcctggctcatgaccttcaggtcttggtcggaaatcggctgggaggcatcgaacagcaccaaggcaagctcggaacgttcgatcgcggcctgcgtacgcaacgaggagaagtattccgcgccggacagcttgtgcagacgacgtttgatacctgcggtatcgatgaacagccaatcctcgccatcgacggtgacgacctcatcgaccggatctcgcgtggtgcccgcaagatcgttgacgacggtgcgttcctcgtgggccagctgattgagcagggaggatttgccgacgttcggacgtccgaccagagccacgcggcgcagatgcgacggcgtaaggaagccggatgtcctttccgctttcttcaacgagtcgagtgcggcgtcaagcagttcgccgatgccacgaccgtgcatggcggaaatgccatacggctcccccagacccatcttccagaattcggcggtcaggtattcgctttcgcgatcatcgaccttgttcaccgcaagcgtcaccggcttgccggcggcacggagcattttgacgatgcgttcgtccgtgtcggtgagaccgaccagaccgtccaccacgagaatcacggcatcggcaagctgcacggcgatttgcgcttgggatgcgatggcggattcgatgccttccacgtcggcttcccagccgcccgtgtcgaccagtttgaaatcggtgccgcaccattcggcgtcgtagctcacacggtcgcgagtcacgccgggggtgtcctccaccacggctgcgcgacggccgagaatacggttcaccagagtggatttgccgacgttcggacgtccgaccacggcaagtacgccgaccggtttcggaccattcttgctttcgccaccagagaacgccgttccatcgatcagctcctcatcgccttcatccagctcatagccttcgaggttggaaacgtactggcggtattcctgttcctcgatggcgtcgtcaacgatacggacgagcacgtcaagggtctcgccgaagttgagatcggagttgtcgacggtcaacacgccttccgcggcggatgtgaagttggtgactttcgaatcggccttgtcgcgtgccgcgacattttccgcacccacacccgagacggcctgtccgctacgtcgggcctgacggacctcttcacgcgcggtaagcaggatgcgcacttcggcgtcgggagcgacgacggtggtgatatcacggccctcagcaacaataccggcgccttcggagaaggaatcgaccgaagcctctcgtgcgatgtaggcacgttgcgcggcgatcaacacgtgacgcacggggatgatgttggacaccttggacacgtgcgaagagacctcggaagaacggatggcctcgctgatgtcctcgccatcggcgtacaccttcggatcgtccggatcgacgctgatgtcgaaatggccgtcggtgaagaattcgccgacggtttcggtgacgagctgctcatcgatggtttcggcatccaaatcgatgcctttgtgcatgcaccaccaggcgcaggcacggtacatcgcgcctgtgtcgaggtatgcgaaaccataatatttggccagtgccttggacgtggatgatttgccgacgcccgcaggcccatcaatagctacacggatcacagtcccaccgccttggatagagaacggacctcagcctgcgacaacacgcgatacgtgccgcttttcaggtcgccgagtttgatcggaccgatctgcgtgcgtaccagacgcttgacgggaaaaccgatcgagccgaaaatacggcgcacgatgcggttcttgcccgaatgcagcacgaccttgaccaacgtgctttcgcggctggagtcgagaatagcgcagcggtcgagtttgatccacccatcgtcgagcttcacgcccgtggtgacgagcctgcggcacacctgaccgctgatgcgtccttccagcgtggcgatgtaggtcttttcgacctcatatttggggtgcatgacgtgctggctcagttcgccgtcgttcgtcatgaggattaggccttccgaatcataatccagacggcccatgtggaaaatacgctcgtacttgtctccgacgatgtcgcgcaaagtgtagcgtcccttgggatcctccatggcgctcagcacgcgtttcggcttgttcaacgcaagcgtgacatggttagggttcacacgcacgcgagaaccgtcgacacggacctcctgacgtttcggatcgactcgggtgccaagttcggtaatcagctcgccatcgatctcaacgcgaccatcggtgatgatttcctcgcatttacggcgcgagccgaagcccgcctgagcgagaagtttctgcaggcgaatgccttcattgtcatgattgtgcgccttggcggcgcgagaatatgcgtttggcatcgttctcccaacgtggccggataatacttacagggactgctggtagtatggcagtcgtttggcggctttcataaaaaccgcaacttgtccactatatgacagaggaaagactatgactgctgttgaagcaacgtccgtaacagaggaagaacagagcaagccactggcccttcgcgtaggcgcggagctggtgggaagcttcatcatctgcttcgccatctactcgatttgcacgcttggttccgcgatctacggcgtgaatatggcgttcatcgccctgctgacaggtttggtgtacgccgcagccaccctgatattcggcacgatttccggcgcccagttcaatccggcggtctccgttgcggcgatgctgtccggcaaaacccatgtgcttgacggagtgctctatattatcgctcaggtgctgggtggtatcggcgcaggcgccgccatccgcttcctgctgccgacatccgagcaggtaacactgaaaatctggctgacgccggtcattaacggttttgacaagaattccgtctcctatgccacgctcggcaactatggcgtgtccttcagcatcactctggccatcgccgttgaactcgtcgcgggcatcatcatcgtcgccaccgcgctcaacaccaccagtaaatccggaaagaccaataccagccatgccatcgccatgggtctcgcctacggtgtcggcgccgcaatctcctatccagtaacaggcgcagctctgaatccggctcgtgccactggcatcgccatcttcgcccagaatcagggcctttcccaagagcctctgcagcagctgtgggtgttctggatctgcccgattctcgcagccgccatcgtctcgcttgtggccatagtcgcgtccatgatcggcaccaagaaaaacgtttcggaagccgagcaggattccaaaacgctggaggccatagccgacgacgcgtcagacgatgccgacgggcacgagggcgagcaggatgaacagtccgacgcccagaccgatgccgatgaaagcgtcgaagccaactgaacggactttccaaggactacgctcgcgcattacgagtctgattagtcctgttatgatggccgtcaccgcgattaccgtggtggcggcttttacatggcctaagaccgcaagcactgtggctataaccaccattgccgcaacgatccattcaaaccacggcttgccttcatggtcttcggaaacgtagggatgactcatatcgcaggcctttcgttatatgtcaacgcgcgtccgcgcacggaacccaatcataataataaaacgtggcgtccgaaaccagcgaatggtttcggacgccacgtcatttatcgcgccgcgacgctcccagcttgccggtcgacgcttccactgaactcagtggaagaagtgtcgggtaccggtcacatacatggtgacgccggccttgcgggccgcctcgaacacttcctcatcacgaatggacccaccaggctggacgatggccttgacaccggcgttgatcagaatctcggcaccgtcggcgaacgggaagaacgcgtcggacgcggccaccgctcccttggtgcggttggctccgtcagccagcgtgttggcacgctcgacggacagattggcggaatccacacgattgacctggcccatgccgatgcctacggttgcctgatcgtgggcgataagtatggcgttggatttgacgcaccggatggcacgccatgcgaacaccagatccctgacggtttcagcgtcggccggctcgccggaaaccagcttccacgcgttcggatcgtcgcctggagcgtcaatcagatcggtggactgcacgagcagaccgccgtcaatctgacggaactgggtcttggtcttcggaggctcagacaccttcaggatacgcaggttcttcttcttggtctggagcagttcaagcgcatcggcgtcgtaatcgggcgcgacgatgacttcggtgaagattggacgaacactttcggccatttccatggtgaccttgctgttcgcagcaatcacaccgccataggcgctcatcggatcgcatgcgtgcgccttcttgtgcgcctctgccacggtagcgccgatggccagaccgcatggattgttgtgcttgaccactgcgacggcgatctgaggcgcgaaatcccacacggcacgccatgcggcgtcggcatcgacgtaattgttgtagctcatcggcttgccgccaagctgttcggcgtgtgcgaagccgttctggttgagcggatccagatacagcgaagcctgctggtgagggttctcgccgtaacgcagcacgtgcgcacggtcccacgtacgggtgaacgtggccgggaacttggcctcattcacttcggtctcgccttcggaaaccggctgttcgatggacgccggcttcggccaatgcttcgcggtccactcgttgatggtggcgtcgtaggcggccgtatgggcgaacgcctttcctgcgagccagcgacgctcatcaagggagaagccctcgccgttctcgatgcgggaggcgacgagtgcataatcgttcggatcggtgatgatggcgacggtggcgctgttcttggctgcgccacgcaccatggacggaccgccgatatcgatcttttcgatggtggcggcttcgtcagctccggaacggaccgtgtcggcgaacggatacagattgacgaccaccagatcgaacggcttgatgccaaacttctcgagctggaaggcatggtcggggttggtcatgtcggcgaggataccggcatggatatgcgggtcaagggtcttgacgcggccatcaaggcattccgggaaaccagtgacttcggagacctcggtcactttgacacccagctcagccagacgcttcgcggtggaaccggtggaaaccacctcggtgcccgccttgatgaacgcttcggcaagcacctcgatgccttccttatggaagactgataccagagcccgtcgtatcggtcgattcgttgttgtcaccctgatcctccttgttattgttgttcgaggcgaccgtgcgaagcgcacgtgtttcctcacggctgttttccgtggattcgggagcggtctccctctttccacgttcgcgtatacgcttcatcatccagcgtatggcgaaaaatatgctcacggccaccaaagtcagcagccatgcggagaacaaacccatggcggtgggttgtcccaccttacgggttgacgcgatcacgtctacgccgacgtgcgcaagatgtttcgatcccaaacctccgtttcccaaggcgaacagcaagctggaagccacggacacgacggcgctggtaatcgaaaaagcagcaatcggataggcaaaactcagcacaacgcgtttgacgtcgatgttccgtcctgattcacctactctgatatggaatcccttattaaacaacatgacgaccatgccggtagcaaaagcggatgccaatggtatgcacatcagcgcgattctcacccaatccgtctcaaccgcctgtggcatcataccgaaaagcggcaaggcggggagcccgtcaccctgtccggtccataatgtgaattcggctaaatcgccgattgagaagccagcgccgaaagtccatgagacagcccaaatcatcagattcggaagccatgcgagcatactgatcgtggtaagaatacgagacccgttctgcatgcccgaaagttcatatagcttcgctatcgatgattgattgcttattgcccaaaaaacaacgacgatcagaccgaccagcagatacgccgcctccagcagcagccctaggacggaaccgatgaccatggtctttcgcaccggcgatgacacatgagatcgaatccattcggtacaggcttgggtccatgacgcattcggaatcgccgcgaccgcatatccgaggatgaaaacaagcgccgttttgatggcgatcatcgtcatcgaatcaacgatttcgatatttatgcttctggcgaagaagatgtttacggcttcccaaaagaccagaccggccgcgaatccacgcagactcgtgccgaatcttctggcgagctgcgcgataagggcgataagcagtaccgtcaaaagcaacggcacaatcgtcaacgtgatggcatcagtcttgaacccgataccttggctgagcagcaccaacgcctcggtaagaggcaccgagaaggcggagagattgtccccgccttcttccatggatatgaccagaagcattagggccatatagcagcccaaggcaacggcgtaaataatcatggacgctgccgcgacggcaagccctttcagccaatacttcaggttcgtcatcatagcgattgggaagcgagcacctctcgcatgatttcagcggtctgtccgggagtacgaccgacacggatgccaacggcctcaagggcttctttcttatcctgcgcggtgcccttgccgccggaaacgatggcgccggcatggcccatctgcttgccttccggcgcggtgaatcccgcgatgtaggccacgacgggcttggtcatatgttcggaagcccacttggcagcgtcctgttcggcgctgccaccgatttcgccgatcatgacaacggctttggtggcttcatcgttctcaaaggcttccaaagcctcctgcaaggtcgtgccgacgatcggatcgccgcccgcgccaaggcatgcggtgaaaccgatgtcagacagctcccccatcagctgataggtcaacgttccggacttggacaccaaacccaacgggccgcgggacacgatgccatctggaataatgccgaggttgcagcccttggcgtccttagaagatggcagcgtcaacagaccaggacaattcggcccaacgatgcgcacgcccttacgcaaggccaactcgacgaaatacgcgctgtccgccaccggaatgctttcggtgatgacgacaatcagttcgatgccggcttcaatggcctcaacgacggcgtccttggcgaagcgcggcggcacgaacacgacgcttgctttggctccagtggcttcgatggcttcagagcagttggcgaacacgtgaatggtggcatcctcgccatttttggcttcagggaaggtgacgtccagcccagccttgcgggcgttcacgccaccgacgatgttggtgccggccttgagcatgcgggccgtgtgggtcataccctgatgcccggtcatgccctggacgatgaccggagcgccatcttcaatgaaaagcgtcatttcagcgaacctccttggccgcgaaacgtgcggcctgctgtgcggcttcctccatggtctgagcgacgtgcaggttggcgcggccggcttgggccaaaatgttcagaccttccgccgccgcattgccatcgaatcgcacgacgataggcttgctgctgccaagttcgtcaagcgcctcgagaatgcccttcgcgacctgttcacacgaggtgatgccaccgtacacattgatgagcacggattcgacctgcgggtcggacagcacgatttcaagactattcgacatcacttcggcggaagcgcctccgccgatgtcgaggaagtttgcgggcttgacattcgtgccctgatcctcgcctgcgcctgacaccgcgtcaagagagctcatgacgagtcccgcaccattgccgatcacaccgacggaacccttgagatgcacataatgcagtccatgttcgcgggctttttgctcatatggatcgacatgaatcggatcggtgaaacgtttccaaccatcatggcggaacgatgcattgtcatcaagggagatcttggcgtccagcgcgcacaacgacttggaagattcgtcatccggatcgccgatttttgcaagcgggttgatttccacaagcgtggcgtcgttctccttgaagcaacgccacattttcagcagaatctgcgcggcctgatcaacatcggcatgatagaagccgatgctttcagccatcttggtggccgcttccaaatcgaaatcgtcaagagcatcgatatgcagacgcttcacggattccggatgctctttggcgatttcctcaacctcagtaccgccattcgcagtggcgagcacgtcgaaatcacgagaggaccggtccactgagatggagacgtaatactcgtgaaggatgttcttcgcctcggccaccagcacgccgctgaccttgtgcttgtgaatggtcatcggcagaatgtcttccgacgcgagaatggactcgtcacgggtcttggcgagcttgactccgccggcctggccacggtgtccaatcttcacctgcgccttaatcacattgggatatccaatctggtcggccgcttcggcgacttcatgggagttctgggcgaatattgccttaggagtcgggataccctgttcttcgagcaattccctggcttgatactcatagagatccatggatcattccctttggttgtttgttctgaatggttgacgaaaacggagttatcaggcaggcatgcacaccagcgagcttgtcggataatcgcctagcgatttcatgccgtcaataccggtaagttccatgacgaagctgaatccagcaacgacgcctccgcacttctcgatgaggctacgcgccgcattggcggttccaccggtggcgatcagatcgtcgacgatcaatacgcgcactccctcatggacaacgttggtttcgatttccattgacgcctgaccatattcgaggtcatagctttgcgacatggtttctggaggcaatttgccggctttacggaccgcgataaacccctttccgagacgggcggccaacgctggaccgaacaggaatccacgggcttcaaggccggcgaccatgtcgaaatcatcgacgtctactggcaatgccgcttcaagggcccccatcaaaataccgaacgcgcgcgcatcagccaacaccggcatgaaatcgcggaataggatgccctccttcggaaagcccggaatagtacgtattttcgatacaagatatgctgcgtcttcggctccaactttgttcaagcccgaaacggtgatatccgatgctgccatgacagtggtttccttctaccttggtttacggcactttgaattataggtttcccgtgcgaaaaagaacggcgaaaacctcaaaaatgagattttcgccgtctaaaaatcaaagaaatcaatcgttcttctgctcgtcaatgggctgctgaataacatcggcatcctgtgcgggctcttcagtcgcgtcgacgacaggcttctggtcgggctcgtcttccttggatagcggattgccgttctcatcgacctcatcatcatgcacgtatgccggacggacatattcacggctgatggcgttgaagccgaaacgcagctgcgatccttcggaatcaacgacgatctcctcgtattccgtatcgacggaaacgaccttgccgatgatgccaccgatggtgatcacttcagtgccgggctgcagactagaacggaaattctgacgttcagcttgctgctgcttggctttcttggactgccagaacatcatgccgaacattacaacgataagaacaacgagaaaaaggatatccaaaataaactcctcggagtcagggtctcaaccggaacacattactcaagatgtgaagtctatgacatcttattgacatcatatgcggattcgtcgggagtaataccaagatgctcccatgccttgcgcgtggccacgcggcctttcggcgtgcggatgaggaagccctcacgtaccagatacggttcgcataccgtttccaccgtttccgactcctcgcccaccatggccgccagattgttcaagccgacggggcctccgttgaaattggtgacgatggccttaagcactgctatatccagacggtcaagaccttcggtatcgatctgataaagcgccaacgcctccttgacatcatcgggacgcaccgattcgagatcgtgcacgatggcccaatccctaacacgacgaagcaggcggttggcaattctcggcgtgccgcgggaacgcatggccagttggcgagcggccccgtcctccaactggattcccaacactgcggaggaacgctcaatcagcttttcaagctcctcatgcgggtagaaatccagatgcgccgtgaaaccgaaccgcgcacgcagcggcgagggaagcatgccctctcgcgtggtggcaccgataaccgtaaaccgaggcaatgtcagcggaatggatgaagctccagggcctttgccgaccatcacatcaacacggaaatcctccatggcgatgtacagcagttcctcggcggcacggggcagacggtggatctcatcgataaagagcacctcgccggcgtccagcgaactcagaatcgaagccaaatcaccagcatgttggatggcgggaccggaagtgacgcggattggaacttccaattcattggccacaatcatggccaaagtggttttgccaagtcccggaggccccgcaagcaggatatggtccggaggaacgtcacgttttcgagcagcatcgaggaaaagctgcaactgcgctttgagccttggctgtccgatgaatccctcgaggatatgaggacgaagctcctcgtcgctgaccggttcgttgccgacgggtgcggcggaaaccatacggagggattcctcgttcgccccggtgttcggctgttcgaatgtatcagtgttcgtcataatggtccgtttcatctacctctatccaacgatgtcagcgcgagcttcagcacgcgtggaacatcctcggcgttcaacggcgtctcgatttgattatcggcgcaaaccgtctgcaccgcatggacagcgtcctgctggtgccatcccaaagacatcagaccttcgacgacctgttcggccccagtgtcttcaggagtcgaagcggttgcggaagaaccctcgatctggctcagatcaatggaacctttcagttcgaggatgattttctgcgcgcctttcttgcctaatcccggagccttggccaacgcagtggcatcaccatccgccacagccctcgcaagtcgatcgggaggcaaagtggacagcaacgatagcgcgactttcggtccgatgccactgaccttctgcaattgcaggaacatgcgtttcgaggccagcgtgccgaagccgaataaagtgatggcgtcctgggacacattcaacgaagtgtagaccttgatttcctggccggcgtgcatggaagccaagtcggcggatggcatcctgacctcgtagccgactcccccgacctcgataatggccgatgcggcgtctaccgactccacatggccacgtagcatgccaatcattatggacgtctccttcgcacaggtctagaacatctgttcgatacagcttacatgcctctgcggacgccttgtctgcgcgctgctttttgcgaagcctgcgcccactgtcgttgcgccgccgtgagatgctgttcgcgttcgccgccttgcagcgcaccagccggacgcaacgcgtgacagatcgcaatagccagcgcgtcagccgcatcagccggctttggcagcgtgttcaatcccaatatccgcgccaccatacgttccatctggattttctctgctttgccgttgccggtgattgcaagctttgattccgtcggcgtatgcaacgctacaggaatgccgcgttgcgccgcagcgagcatcgccaaccctgccgcctgtgcggttcccagcaccgtgttacggttttcttgcgcgaacactcgttcgatggacaccgcatcgggagcaaatcgttcgattttttccaccaagccgttgtagatggccagcagacgcagatcctgggaggtttttggatcggaacgcaccacatccacgtggataaaagaaagccggcggtatgcgccggcttcaatcacgccgaccccgcagcgagtcagcccggggtcgacgccaagaataatcacgctggattactcctcgtcaagctgggccatgacctcgtcggaggcggtccagttggagtagatgttctggacatcgtccagatcatcgaggttgtcgatgagcttggagaccttctgggcatcctcaaggctcagctcgacctcgttcttcggcatcatgaccagatcagcggaatcgtaatcgaaaccggcgtcctggagagccttgcgcacgtcgatcatgtcggacggatcggtgatgacggtgaatacctcaccatcgtcggtcacgtcttcggcaccggcttcggcggccttctcgaacaggttgtcgaagtcaacgccttcggccggaacaacgatctgtcccttgcgttcgaagttgaagctcacggaaccagtggtggccagggagccattgcccttggtcagggtggaacgcacgtcggcggccgcacggttgcggttgtcggtgaggcattcgatgatcaggccaacacctgccggggcgtaaccctcgtacacgatgtcttcatagttggcgccgccggcttcctcaccggaaccacgcttgacggcgcgcttgatgttgtcggccggcatggaggccttcttggccttgtagatggcgtcatacagggacgggttgccgtcgggatcgccgccacccatacgtgctgcgatctcgatgttcttgatcagcttggcgaacagcttgccgcgcttcgcgtcgatggcggccttcttgtgcttggtggtcgcccacttggaatgacctgacataatgctcctaggcaggttgcggatgtttcaaacgaaatgattctaaagcggttcgccgacaaaatgccgaatacgaacctgtggcatttcgcttttcgaacttttggatggggtctgcccccggctgtgactaccgccgatatgttttctcccctatgaccatttggcgcttggcttcgaagatgcgttggaatacggtgactaatcccaatccggccaacagtatcatggcgatggcgagccacaatccctgacgcgtcaatccggtgatggccatgcccaccagaatgatggtcaagcgatcggcacgagtggcgatgccgtttttcacctcatagccgactgattcggcacgagcacgggcatatgaagtgacgaacgatgtcatcacggccaccgcggcggcggcgataccgatcatgctcgtatagtcaggcgtgttgtcgatggccgtatgccaccagtcacgatgcataagaaagaagatgatcacgcctacgagcatcgcccaatcagcgatgcgatcgagcgtggagtcgagaaaagccccgaattcggtcccacccgtggtaagcgcggcgatcgagccatccaacgaatcggcaagcacaagcagagtcagaacaaccgctcccccaaatagccatccggtcacaccggtggcgatggccacgacgatggtgccgacagcaccaatcaccgtcaccgcattggcggtcagtcctatggcgatcaacgctttggctattggctcgatgagttttttgaacggcgcacgaagatgctcaagcatgtgttacttccttctcgatgagaaaatgagaaacggcgcacaaacctcttgtcgagattcgtgcgccgtttcacggttcatggtcgcgtgcgacttgttgccaccggtctcgctcagtcggcgagggcggccttgaagtcgtctgcggtgttgacctggacgcgcttcttgattacggtcagaatgttcgccttcgcctcatcgaccggcacgccgttcaactggctgccgtcgcggaagcggaagctgaccgcgttgttgttcatatcctcttcgccgacgatgaggatgaacggcgccttggacttggatgcgttgcggatcttcttgccgaagcgatcgtcggacaggtcgatctcgcaacggacggtctcctcttccaagctggcgatgaacttctgcaggtgcggggcgaactcgtccgcgaccggcacgccaagcacctggaccggggcgagccacgccgggaaggcgcccgcgtaatgctcaagcagcaccgcgaagaagcgttcgatggagccgaagagcgcgcggtggatcatcaccggacgctggtgcgtgccatcggcggcgatgtattcgagcttgaaacgttccggaaggttgaagtcgagctggatggtggacacctgccaggtacgtccgatggcgtcacgggcctgcacggagatcttcggaccgtagaaggctgcgccgcacggatcgtcgaccaagtccaaaccggattccttggcgacctcggccagcgtgttggtggcttcctcccaaatctcgtcggaaccgacgtacttgtgcggatccttggtggacagctccagatagaagtcatccagaccgaagtccttcaacaggccgagcacgaaggtaagcaggctcttaagctcgtccttcatctgctcgcgggtgcagtagatgtgggaatcatcctgagtcaagccgcgcacgcgggtcaggccatgcacttcaccggacttctcataacggtacacggtgccgaattcgaacaggcgcagcggcagctcacggtaggaacgctggcgggacttgaagatcaggttgtgcatcgggcagttcatcggcttcaggtagtaatcgaagccttgcttgatgacgttgccgttctcgtccttctcctcgtccagacgcatcggcggatacatgctgtccttgtaccactgcaggtggccggaggtctcatacaggccgcccttggtgatgtgcggggtctgcacgaagctgtagtggtgcttgcggtgcatctcacgggagtagtcctccatggcattgatgacggccgcgcccttcggatggaagacggcaaggcccggaccgatctcatccgggaaggagaacaggtccatttccgcgccgagcttgcggtggtcgcgcttggcggcctcctccagacgggtctggtatgccttcaggtcctccttggtggcgaaggcggcgccgtaaatgcgctgcagcatcggattggcctcgctgccgcgccagtatgcggcggcggaacgctcgatcttgaacgccttgatgtaacgggtgttcggcaggtgcggaccacggcacaggtccttccaaaccacattgccttcacggtcgacgttatcgtagaagctcagttccttgccgctgatttcggtggcggcttccgggtcaagatgcgcttccttatccttgataagttcaagcttgtagggctggtcggcttcctcggcaagagcctcttcctcggtcaccacgcggcggcggaaggactgggaggacttgataatgcgctgcatgcgcttttcgatttccttgaggtcctccggagtgaaaggagtctcgacatcgaaatcgtagtagaagccgtctttgatgaccggtccaacaccaagcttggcgtcagggcgaatctcctgcacggcctgggccatgacatgggttgcggaatggcgcatgatggccacaccgtcctcgctatcgagcgcgatgggttccacaacgtcgccgtcgtgcagctcggtatagagatcgcggggttcgccgttcaaacgcaccgcgatgatgttcttgtcgtcggagaagagctggacgccggtctggtctgccgccacctccttcttttcgccgttgagtgtgatggagatggtctgttcagccatgagttgtcctttgctatcggggtccgcgttaccaatgtgcaggcctggactatatatcaacgatgaacaagatagggtcaagcgcagacaacggcacgccatttcggtgaacggaagaacaacgctgattgaatgtcgcgaaaggaaaggtcctttactgtttactgtccgatgacgtgcgcatatgtatactgcggagcctgacgtgtggacttgatcatcactttgtcagaggggctgaccgataccgtagcgccatacttcactttgagccgcgacccgacgccaccggccagattgaccgcgttctgcagattgtcgctgtcgccgatcgcgcgaatggtgaatggggatttcagtttggtgccatcgcagacgagactgccggccgtgccactgatgtaagtgctggttaccacgcggacattgttgatctcaatgacctcggcaccactgttgcgcaattcctcaagcaacgtgaacaatatcgcggagtcaatcttctgtttggaaccctgcgatatgcggatgaccacgccttctcccgtagccgcgagacggccggataggatgccgttggtctgcgcgttctgcttggcgatttccgcggctttctcatttttgtccgcggtgtctttcaaagcgttcagctggctggagagttcgttcttacgctgttcgagcttttggacctgagcattggtctcgctgatgagcttggttaattcatcttcgctcatcgtctcataggtggatgtcgtgttgtttatctggatcacatagccgaagccaagcaaggcgcacaatatcgtgaccagaatgctggaatacagtcgggttcgtgtgaccttcgcatcaagtgagattcgcttcttggccttgaccatggggaacgcaccggtttgggtgctgtcattgttctggtccttgaccctctgctcatggattctggacagcatgtccttgctgttcgcgtcttgtccgctcataccgcatcaacctttaaagatgaagcgtcgaatggaggacacattggtaaagattcgtatgccgagcactacgatcactgcggtctgcagctgggagccgactcccaactggttgccgaggaacaccagcagcgtcgcggtgatgacattcgagaagaaggagatcacgaacactttatcggaaaagctgcgttggaaatacgcgcgtgcggcgcctagcaacgcatccaacgcggccaataccataatcggcagatacggttggagctcgatggggatgtccggacgaacgaatacaccgattaccacgccgatgataagtcccaagacagctgccattacttgtccttcctcacatgcgtcgtgtcgccagccactgcagcatcaagtgtaatcgatttgcttttgcttatctgcggatagatgccggcctttttgaaatcgtcatacagttgtttctgcgttgtcttgcttaccgatttcgccaaggtcgcctgattgcctatcgcctcgattcgatatgggctttgcaccgaattgactccgatgagaatcgtcgatccggcggttcgaatcgaggtttgcacgccaaggcggttgccgttgatcgcgatcgcctccgctccggattgccatagcaaggagacaagcagctgcaaatcggaatcggtgacgactcgaacctggctgccattttctcttggcagtgaggagtcggcattgtcgccgctgacggaaagcgggttggctacggtcaggacaatgccttccccttgcaccggaagcgttccattgaccatttcatcatcctgcatcgtctggtttagggaccagcttgccaaggattccgattcagattcgatttgcgaccgcaagtcgttgacgcccttggtgaggtcgccgacccgcttcgtttgttcggtcagctggcttgccaactgcttgcgtacttctttgcgtgggtcagtgctcagctggcgcacgaaaacgcttcccgcggcacccacagcgatgcagatgaggaacaccagaatcctggtggcccaaatcgaaaccgccgaacgttttttagtggccaggcgggagtccgaatacaggacgtccatcggacgattggtcaaatcgtcaataagccgaagcgaatcgtcatcgacatgtctatggcgttgcggcatggcgggcatggaggccggttgcacatgatgggatgacaggccggcgaaggatgacgaaaaaatggcacgatgctttgtgggtacgttctccggggaaacggggaacgacgcgaaacgtggagcatcggacttcatatatgcgtcaatccttgctgtttgtatcgttcttcaacagttggatgccttggcgcatgtagatgtaccctgcaagccaatacagtccaacgccccagattccggtggcaagaccgcatagatgcagtgtatccgcagcggagttggaccagatgtcggcgaagatcaacgcgacgatggcgataagcagcatcgcggtaccggccttgcctacgaaatgaacaggcaatgggccataatcgtgctgcgccaaaaccagtatcagaacagccatgatcaaatctcgcaggccgacgacgatcagcatccaccatggaatgatgttcgccacacccaaagcaagaatgctgcagaagatcagcagacgatcggcaatcggatcgagaatttgcccgattttgctcacctgattgaatgatctggcgatcagtccgtccaaaccatcggatatcgccgatagcgcaagcacgaccaaggcggtcaccatcctgtgatgagagaccagcatcgcgataaaaggaatcgaaatgattctcagcaggctgatgaagttcggaaccgtgaaatagatgtctcgcggttccggactgtattgcttcttaataatcagtttgctcatattacaagcaacactacattctcgaagcctgcaacgcggtgactattatgccacgggcaccaacttcatacaactggtccataagctgattcaccttcgccttcggaaccaccacacgcacggccgcccactgcttatcatgcagaggcgaaatcgtcgggctttcgaaacccggagtgatatccactgcggcggacaccttctcgaccggaatgtcgtagtccataagcacattacgctgggcagtgagcacgccttgcagacgcctgctcagaatcgtcagccgctcgtcatccgcctcaagacgaggggaacgaatcaatacggcttcagagtgcatcaacggttcagcgaaaatgcgcagtcccgcattacgcagagtggtccctgtggaaaccacatcggcgatcagatcggcgacgccaagctgaacggacgattcgacggcgccgtcaaggtgcacggtttccgcgttgatgccatgctcgaccagatagtcgtgtacgagcttgtcgaatgtggtggcgactcgcttgccttcaatatcctcaagcttggtaatcggcgaatcgttcggggctgcgaaacggaacgtggaggctccgaagccaagctgcatatgctcctccgcatcggtgccggagttcacgagcaaatcatgcccggtgattccaacgtcgatggtgccgcgaccgacatagaccgcaatgtcgaggggacgcaggtagaacaactcaacatcattgtcgggatcctccacgaccaactggcgagggttgctcctcaaacggtagccggcttccgccagcatgttccaggcgggttcggacagcatgcccttattaggcacagcgattcttagcatgtttctcctctaaaaaaggccacaccttcaactggcatggccccgggtttctcacaggttcttgtagatgtcctcgagtgtgatgccacgatcgatcatcatgacctgcagatggtagatgagctggctcatttcttcggccgtgcgatcagcaccctcatattcggcggcgatccaggtctctccagcctcttcgacgatcttcttgccgatgaagtgcgtgcctttggcaagctcgtcgacggtcagggaaccggcctgcttggtggcggctttctcgctcaattccgcgaacagcgattcaaaagtcttcatattcgtatgcttccttgtatggtgggcgttcacgccttgaaggctgcttcggccttctcgcggatggagtcgatagcctcggccggattctcggcaccgtacacggcggaaccggcgaccagcacatcggcaccggcttcggcaacgatatgggcggtcttggggctcacgccaccatcgacctggatcttcgtcttcaggccacggcgggtgatttcgtcacgcagacgacgaaccttggccatctggttgtcaaggaacttctgaccgccgaagcccggttcgaccgtcatgataagcaccatgtcgaattcgtcaaggatgtcgaagatcggctcgaccggttcggccggacggaccgcgaagcaagccttgcagcccatgtcgcgcagctgacgcgcaagacgaaccggagcatgcgtcgctcccatatggaagctgacggaagccgcaccaagcttggcgtattccggagcccaacggtccggatcctcgatcatcagatgcacgtcgaccggaaggtcagtgacttggcagatgcgagccacaatcggctcacccaacgtcagattcggaacgaaatgatggtccatcacgtccacgtgaacgagatcggcgttggaaatggccttaaggtcacgttccagattgcagaagtcagcagacaggatgctaggtgcgatttgaatagtcatggttctcattctatggaaggtaatcgacttgatgttacttgttgtcggactggtcatcggcatatgagacggatgagccatcgtttgccgtgatttcatccttggttttcgtaaggttggccttcgcggtcgggagaccggtttctccatcctcgacgaggcttagctcaatctcggtgacggtgcgcaacttctcggcaagcagctcggtggactttcccatctgctgaataacgatgaaagccaccacgccaagcacgaacaccgccatggacacccatacgttgatgcgcacgccaaggaactcgtgcgcgaaatcaatgcgcagagcctcgatccaagtgcgtcccaccgtgtaccacatgatgtatatggcgaacaaggacccggccttgagttttttcatgattttggaaccaaggaaaacgatgagcgcagcaccgatgagattccaaatcatctcatacaggaaggtggggtggaacagcgtgcctgtcgggcaggtcgctccgtcatagcattgttcgctgtgaccgatggcgcttccctccatattcaacttcaaaccccaaggcaaggtcgtcggcgcgccgtagagctcttggttaaaccagttgcccagacgtcccacggcctgcgccacgagcaatcctggcgcgacggcgtcaccgagcagagccattggataatgcttgtgacgacaccatgcccaaacggcaagcgctccaagcaggacgccgccccagatgcccagtccgccattccagatgcggaacatctccacccaatcgccggtcggtccgaagaaacgttccggagtggtgatgatgtggtatatacgcgcaccgatgatgccgctcggcaccgcgacaagcgtgatgtcgagaatctgatcgaaattaccgccatatcgtttccaatgaacggttgtcatccataccgccagcacgatgccgagcagaatgcacagcgcgtagaaatggatggtcaccggcccgatggaaaactgcgaaatggtgggtgacggaatgtaagcaagtgtcatggtttcctgatggtagtccacgtatacgatatggtacgtggactaccagtatgttgtctttggactggttcagttgcgggcgttgtggatgccttcggcaagctcctcagtcttcgccgccaaggccttgagaccggtggcttcgtcgactgcatgcttgccggattcgtcaagcatggtatgcaccagagccgagcctacgatgacaccgtccgcatacgatccgacacgagccccctgttccgcggtggacacgccgatgcctacgcacacgtttttcgcaccggccttgcgggtacgggcgaccagttccttcggggacgcatcgatggtggagcgttctccggtgacgcccatgcgggcggcagcatagacgaaaccccgcgcattgtccgcaacgactttcagacggtcttcggtggaatccggagataccaggaagatgcggtcgagtccgtgacggtcggaggcttcgatccactcgccggcctcgtccggaatgagatccggggtgatgagaccggctccaccggcgttttcgaaatcacgtgcgaatcgttcgacgccgtaatggaagatgaggttccaatagctcatgaccaatggcactcccccggcgttcgccactgtttccaccgctttgaatacgttggcgattttttcaccattgtcgatggcgatttgcgatgccgcctggatgacgggaccgtccatgacggggtcggaatacggcagcccgatttcgaccgcgttcacgccgtgttcgaccatggtgcggaaagctttgagtgaataatccggatcagggaatccgtatggcagatatccgatgaatgccggcttgtcggcggctttgaattcatcgaacatggtttccgtcgggcttggcttgtggctgatgccgagtggctggccggacggcgtggatgatgttgcgttcgtcatgatggttgctccttttctcactcgccgtccgcgttgttgccttgcgcgccgttggattccaaggctttggcctgctcgtcggtcaggtatccgaaccatttgccggcggtgtccatgtccttgtctccacggccagagatgttgatgatcatgaccggatgctcataccctttggccttgaggtctgcagctgccttgtacgcgccggccactgcgtgggagctttcgatggcagggatgatgccttcggtttcgcacagatccttgaacgcgctcatggcttcctgatcagtggcccaggaatagttgacgcggccgatatccttgagccatgcatgttcggggccgacggaggcgtaatccaagcctgcggagatggagtacgtgtcaagggtctggccttcggggttttccaacagatagctcttggctccttggaacatgcccagttcaccggtacctggcgcgaatcgaatggcatggcgaccggattcgggcccgttaccgccggcctcgtaaccgtacaggtttactcgttcgtcatcgaggaaggcgttcatgatgccgatggcgttggagccgccgccgacgcatgcgcagatagcatcgggatggtcgatgccataccaatcctgcagctgctgtttcgcttcctctccgatgatcttttggaagtcgcgcaccatggatgggaacggatgaggccctgcgaccgtgccgagcagataatgggtgtctttgacgttggtgacccagtcgcgcagcgcctcgttgatggcgtccttgaggatgcgatcacccaaggtgacttcgacgacctccgcgccaagcatgcgcatgcgggcaacgttcagcgcctgacggcgggcatcgatctgtcccatgtagatgcggcacttgagtcccagcatggcacagaccgtggcagtggccacaccatgctggcctgcaccggtttcggcgatcacacgggttttgcccatgcgcttgaccagtagggcctgtccaagcgcgttgttgatcttgtgggcgccggtgtggttcaggtcttcacgcttgaggaacacacgggcatcaagaccggttttctcctcgagcctctgcgcgaaacgaggcgcttcagtcaatggggacggacgtccaacatactgctggttcaaccgcgccaattccttatggaattccggatcggccttggcttccgtatacacgcgttcaagctcgtcgagcgccgtgatcagcgcttccggaacatagcgtccgccaaactgtccgaaatatggtccttcatggcttgccaacggggtctgttcggatgccttcactcttgctcctgcctttactaatcgttccactgcctgctcatggttggccgcggtggccacgccttctcccaccagcaccgcatccgcgccggcacgggcgtaatcctcaagctcaaccgaaccgaacacaccggattccgccacgcgaatcacatcgtccggcaaatccgcggccagttcgttgtacttgttcacatccaccttgaggtctttaagattgcgggcgttgatgccaatgaccttggccccggcattgatggcccgttgaatctcctcacgggtgtgtgtttccaccagcaccgtcatattgaggctatgcgcgagatcgagcagcgacttgagcttgacgtcgtccaatgcggcgacgatgagcagcaccagatcggcaccatgcgcacgtgcttcccaaatctgatattcggtaacgatgaaatccttgcgtagcacgggaatcctcactgcggcgcgcaccttgtcgaaatcttcaagagagccaaggaaccgacggccttcagtcaacacggaaatcgcgcttgcacctccctgctcgtattcgcgggccaaagcggccggatccggaatatcgctcaaatggcctttggatggggaggcacgcttgatctcggcgatgaccggaatgccatccgcctttttcagccactgacgcgcatcgattggcgctgaagcctcgaacgccatccgcttgacctcagcgagcggcacgttgttttctcttgatcgctgatcctcgacggctcccgccaccaattcatcgagcacagacattactgcttcctttcacaacacaattgaacggtcagaatgtgactcacaactggcgaagctgcgcggcgatctgtaccgcttcaacgctggcttcggccttgttgcgagtctcctgccactcactggccggcacggaatcgaggacgattccagctccggcctgcacgctcgcttcatggtcgcgaatgaatgcagttcgaatggcgatggccatatcgaggttgcctgaaaaatcaaaataaccgacggtgccgccgtaaataccacggtcggccggctcaagttcatcgataatctcgatggcgcgcggcttcggcgctccggacagcgtccccgcggggaaggcggaagtgaacacgtcgaacgccgtcatatgcggatcgacctgcccggtaacggttgagcagatgtgcatgatatggctgaaccgtttgatgtccatcaaggaaacgacttcgacgctttccggacggcacacgcggctcagatcgttgcgggccagatcgaccagcatgatatgctcgctgcgttccttcgggtctgccaatagttccttggcgagacgttcatcttcctcaggagtggcgcctcgtggtctggaaccggcaattgggaaagacatggcatggccgttgtccaccttgatcagtgtttccgggctggaaccgatgacgttgaaatcacgtccttgagcatcggtgagtgccatgaaatacatgtacgggctcggattgagggtacgcagcacacgatacacatcaaacggatcggcgggagaatcaatatccagtcgctgcgaaatgaccacttggaacacatcgccatcgatgatatggcgtttggcttcttcaacggaacgttcgtaatcgcttttctccgtgcggaatcgcagttggggctggccgaccgactcgtcgagcacattgacccgggcttcgttttcgacgggtgcggcagccttgcgctgcatatcatccagacgtgccagcgcttcatcgtaggcggcatcggcacgagtcggacggtcatcgacattcacggcattggcaatcagccataccgagccagacacgtggtcgactactgcgatgtccgtggcgagagccagaacggtttccggctgtccggtctcattcggggcttcggcacggagcgtcggttcccaatgtcggatggaatcccatccgacagtaccaacgaggccactggtcagattcggcaatccctcgacgtgcggagccttcaatgtcttcagcgcggcatgtgccacttcgacaacatcaccgtcggtgggcactccgacaggcacctgtcccagccaatcggctttgccgttgttcgaacgcagctgcgccatggaattcacgccgatgaagctgtatcgactccacgctccgccaaattcagccgattcgaggatgaacgtaccggaacggcctcctgcgagacgctcgtagaagccgactggggtcaatgaatcagccagcaaacggcgtacgatggggatgacacggtagccttggtcggccaattcatggaactgctcacggcttggccatgtagcaccccacttgagggtctgtacgctgcattcgctcaccgctgaccctcctgttctttggttcgatggcccacgaccacaggcagctgtccgccttcttcaaagcaggaacgtttgccggtatggcaagccgctcccacttggtcaacttctaccagaatggcatctccatcgcaatccagcgcgaaggacttcacatactgggcatgtcccgacgtatcgcccttacgccaatactcctgcctggacctcgaccagaatgtgacgcgtccggtggtgagggtacgtctgatggcttcgtcgttcatatagccgaccatcagtacctctttggtatcgaactgctggatgacggccgcgaccaagcctttgtcatcgtgcttgagacgccgtgcgatgcgcgggtcgagagtggtggtgttgtcgtatgcttcgttggtcatgatggtattgcgattcgttgttcagtactacagggttggtttgcgtagtttccgtggttctattcagcgtacggtgtatccggctgccttgatggcgtctttgacttcaccgatggtgactttgccgtaatggaaaatcgaggcagcgagcacggcatcggcgcccgcctcgattgccggcggaaaatccgaggctttgccggcgccgccagaagcgataatcgggattttgacttccttgcggacagctttgatcatctccagatcgaagccttgttgggtgccatcggcatccattgaattaaggagaatctcccccgcaccaagttcttgggcgcgcttgacccaccaaatggcgtcaatgccagtggatttgcgcccgcccatggtggtgacttcgaaacctgactgcgtatgtcgttctccctgttcgcgacgtgcatcgacggacagcacaagcacctgattgccgaatcgttcggcgacacgactgatgagggtagggtcattgatggccgcggtgttgacgccgaccttatccgcaccgcaacgaagcagggaatcgacgtcttcaggggtacgtacgccgccgccgacagtcagtggaataaaaatctgttcggcggtgaggctcaccacatcgaccatggtctgcctatgggagcttgacgccgtcacatcaaggaacgtcagttcgtccgcgccctggcggtagtattccgcggcgagttcgaccgggtctcctgcatcgcgaagattctcgaaatgcacgcctttgaccactcgtcccgcatcgacatcaagacatggaatgactcggaccgccagtgacatgctgctctactccttcacgcataacggttgcaatgattgcaagagtaaccgcaatacgttacgtcggttcatgcggattccgagtagcggacagaaccgggcctttcggaggaatcagtcacgttctttggctgcaagctgtccgcatgcgccatcaatgtcctgtcctctggtatcacgcagcgtggctgtgatgccagcgttatggagaatctcaaggaatctacgctcgtcttctggtttggacgcggtccacttcgatccctcgatcggattgagcggaatcggattgacatgcgcccaatcatctccatagtggttcagacgcttcgccagcaatttggcatgttccgcctggtcgttgatgccgcgcatcaaggcgtattcgatgctgactcgccgtttggaagccagataataatcatgcgcagcgtcgagcacctgtttggtgttgaaacgcttgttcatgggcacaagttcatcgcgcaattcatcgctcggcgcgtgcagggatactgcgagacgtactgggatgccttcttcggccagtttcctgatgccaggcaccacgccaacggtggaaaccgtgatgttacgtgcggagatgccgaagccttcgggaggcatggaactaatttggcggactgcgctcaagacggatttatagttgcccattggttcgcccatgcccatgaacacgatgttgctcagtcgtccggagcctccggccacttcaccgtcacgcatggccttcgcggccacacgaacctgctcaacgatttcgcctgcggacatgttcctggtcagtcccagttgtccagtggcgcagaatgggcaacccatgccgcagccgacctggctggaaatgcaaagcgtggttctggtgggataacgcatcaatacggattcgatcagcgacccatcaaacaggcgccacaacgttttgatggtggtgcctccatcggcgacttggcgtgtcacctcatggatgagttccgggaagaaagcttcagccgcgtcggagcgtcttgccgccggaaaatcggaaaattcttccgcattgacatcaaaatggccatagtaatgattagccagctgtttgaccctgaatttcggcaatccaagttccttggccttaccgatacgttcctcttcggacatatcggcgaaatgcagtggcggcttgccacggcgggcatggtctttcgacagcacatcccggaaggcgcccgaagtgcctccaggagtgatgcctgtttccggctgatcattcatggaattcacggttattggccctttctcacattccggtggcccacaggagcacgcacacgaaaggagcgcacaggaggatggagtcgacacgatccatcactccgccatgacctttaagcagatggcccatatccttaataccaatgtcacgcttcagcatggaagcgcataggtcgccgaaggttccggctataccgatcatgaaaccagcgacaataggcacccaccatcgaaccgtccaaacggatggctcgtaagtgcaaaacatcaccacaaaagaaccggccatggcgaacaagatggatcctgccaggccctcccatgatttcttcggtgagatacggggactgagtttatgtttgccaagccatgcacctgcaaacagaccaccggtgtcactcagcgcgggcatgaagacaagcatgatggcatgtgccaccggatgaccgttgaacgtcaacggcatgatcaggcaggaggcaagcagcggaatgtacagaacggtgaacatggagactgccacatggctcagtcggctgtggcgcacttcaccctgttcatgattgaacgacgattcgagacgagcacctgcatcggtgtgcgacagtttgtccgccacggccagggaaagccgactgccgaacgtcaccttggcacttgcggcgatcgctacaagcagcaaggaggccagtacacagaccgtcatagccacaatatgatgcttgctgtagtaggtggccagcaaagtcaccgcggaacatgcccacagcgccaccacgggaatatgcaatcccgcggtggcgaaatcgacgcgcagctcccacaatgcgagcaccatgaacagcacgacaagatagacgaacaaatcaacgctgatcaacaggcatgccaagatgatggcgatcaggacgaccgccgtggcgatggcctgcggcatgttgcgtccggttttcttgttgatggcgttaatggcctcttcggcttctttttcgcgttgctcctgtttttccatcgtggtctctcctgtggtaccgtgcgtcgattgatgattatggagattcgaaggaatcagacctccatgatctccttctgcttggtttccagcagagcgtcaagctcgtcggtggtctgcttggtgaccttgtcgagttccttgagcagacgatcgccttcgtcctcgcccatgtcgccgtctttgatggccttgtcaagggattccttggccttgcgacgaatgttgcgcaccgcgaccttgccgtcttcagccttgcccttggcaatcttgacgtattccttgcgacgctcttcggtcagctccggcatggtcaggcgaatgacgttgccgtcgcgacgggggctggctccgagatcggaatcacgaagcgccttctccacggcgttggcctgggacgcatcgaaaggagtgaccgccaaggtgcgcggctccggaacaccgatggtggcaacggccttcagcggggtcggtgcgccgtaatagtcaacggtgatgccgttaagcagcgccggattcgcacgaccggtgcgaataccggagaagttctccttggtggattccacggacttggccatctgcgccttggcctgatcgacgatagttgccattgtttgctcctttaatattgttggtttaatcgatattcggctttgaatgtcgtcactcggcgagggtggattccgcggtggaaaccatggtgccgatctcctcgcccagcaaagcctgggtcacattgccggcgccctcgagtccgaagacgcggatgcgctgcttgttgtcccgcgccatggaaagcgccgcagcatccatgaccgcaagattgtcgaccaatgcacggttatagctcagcgtggcgaagcgcttggcgttctcgtctttgcgcggatcggcagtgtatacgccgtccacgccgttcttgcccatcagcacctcatcgcagtggatttccagagaacgctggatggacacggtgtcagtggagaaatacggcatgcctgctccggcgccgaaaatcaccacgcgtcccttttccagatgacgaatggccttaagcggaatgtacggctcggcgacctgtcccatggtgatggcggtttgcacgcgcgtggcctgtccctcctgctcgaggaaatcctgcagagcgaggcagttcatcaccgttcccagcatgcccatatagtcgccgcgggaacgatcgatgccggcctgctgcagttcggcgccacggaagaagttgccgccaccaacaacgatggcgacctgcacaccttgcttgaccgcgggaacgatttcctccgcaatacgacgaacgacggtggtgtcgatgccgactttgcctccgccgaatgcctctccggacagcttgagcagtaccctgcggggattgtcgccagtgttttcgccagtcatgaaatgcctttcttacccgaaaacccatgaaatttaccgttttcaagactatcggcaaacacagacaccaaaaacacgatggggtttagtgcaaaaaaaatgtccgcaatcctgttggattgcggacattggagatatgccaagcccacgttcgaaagcgtgagctcaattcacatcagattcactcggcgtcgcccttgccgacctccacacgagcgaaggaaagcgcggttcccccgacttccttgaacaggtcgccgacggtcttggacggatccttgacgtacgcctgctcaagcagcacggtctccttgtagaatgcgccgagacggccttccacgatcttcggagcgatcttctcgatcacggcctccggcttgcccttgctcttgagctcctccgtggtcttctcggtggccacgcgacgctcggattccagcacatcagccggaacatcctcgcgggtcagccactgggcgcccatcgcggaaatctgcagagcggcctcatgagccacagcagcgccggcttcatcggtggcaatcatggccacgatgctcggcggcatctcagcggacttcttgtgggcgtagacctcgacatgcgggccctcgaccttggcgaactggcctaccttgacgtgctcaccgaacagagcagcggcttcctcgacggcttccttcacggtggtgtcaccggaggctgctgccagaacctcatccacggaggatgcttcggccttgacggcgtcatcgagcacgctaccggcgaattccacgaacttcggggtcttggccacgaagtcggtctcggagttcagctcgaccgcatagccggtctggccgttggcggattcgacaacggtggaggcgatggtgccttcctgagccttgcggccttcacgcttgccagcggcctggatgcccttggcgcggatgatttccttggcgcgagccacatcgccttcggcttcggtcagggccttcttgacgtccatcatgccggcgccggtttcctcgcgcacctgcttgatcagagctgcagtgattgctgccattgatttgtctcctctgaaaatttggtgatgccccgatgatgggaggcatagcacctcccatcatagagcatggtctcactcggccttggtttcgccttcagcctcagccggggcttcagctgccggagcgccctcggtgaggagctccttttcccaagcagccatcggctgctcggcttcgccttcggccttggcggccttgccggaacgctccagcagaccttcggccactgcgtcagccatgaggctggtcagcagttcgatgccgcggatggcgtcatcgttggcggcgatcggatactcaacggattccggatcggcgttggtgtcgacgatggcgacaaccggaatgcccagcttgtgggcttcctcgacggccagagcttccttgttcacatcgaccacgaacatggcggacggggtgcggttcatgttgcggataccgcccagctgcttagccagcttgtccttctcacgctcgaggagcagcagctccttcttggtcagaccggagccgtgcacgtcggtgaagtccatttcctcaagttccttgaggcgggagacgcgcttggacacggtctggaagttggtcagcatgccgccgagccaacgctcggagacatacggcatgttcacgcgggtggcctgagcggaaacagcttcctgagcctgcttcttggtgccgacgaacagcacggtgccgttgtgggcaacagtggccttgatgaagtcgtaggccttgtcgatcatgtcgagcgacttgaacaggttgatgatgtggatgccgttgcgctgggtgaggatgaactgcttcatcttcgggttccaacgacgggtctggtggccgaagtgcaggcctgccttcagcatgtcgctcatagtgatctgagccatggtattgctacctctttctttgtcggttcttgcctggtcatgcgttcctgcgtgcagccaatgccttgcaggcatcagccgaccgacacaggtcgtcgcgagcatgacgcgaattggttgcgcaccggttgacaataattgggcggtttgaagcactcgcggcagcgcttctcaccaaattggcgcacaaatattaaaaataccatggggccacgtctttctgacgtggccccatggttgaatcgtcgttcgctgtttcgatcacttgcgatgggtgcgcatgtaacgcatcgcctcgcggcgttcttccttttccagacgatcaagatagacgtgaccgtccaaatgatcagtctcgtgctgcagcatgcggcccatgatgccatgaccttccaacactaccggcttgccgtccagatcaatgccccgcacgcgagcataatcggcgcgacgagtcttgtaccacaatcctggaacggaaaggcagccttcatcgccatattgctctccgctggtctcctccaacaccgggttaagcacatagccgattttgccgtcgatattgtaggaaaacgcacgcagactcacaccgatttggttggcggacaacccggcgcgtcccgggtcatcaacggtatccaacaaatcctgcaccagatggcgcaccgcgggcgtgatctccttgatgggatcgcatggggtgcgcagcactggatcaggtacgactcgaatctcacggattgccaaaattaacgctcctcgttgttcttggttgcggaaggctcgacggacggtgccgtctcgtcatccggttcatcggactgcttcttgattctctcctgcatggtatcaaatgcctgccgaaccttcgggctgacggattcagaagcctgccgcatgctttccgacgcctgcttgacggtttcggtggtgcggtcgagaatctggacggtcttcggcaacggcctgttggagggttttggcgcgtaaatcacgttttcgatgacgtctgcgtagcgctgcagcaccttgggacgaacaactttcaggcttgccgtcaaggtgccgtcctgttggttgaattcctcatcgagaatctcgaattttcgtacggattccgcacgggaaacgttcgcgttggccttttcgacatactgctgcacgaaagcgcgcacggcatcgttttccgctacctgcttcatggacataccggcatcaagactctgctgggaaagccaagaacgagtcatatcaggatccagttcaatcaaagcgctgatgaacggcttgccatcgccaatgaccacagcatgggacacgataggacaggtgtcgatgatgtcctccatcggggcggggctgacgttcttgcctccggctgtgatgatgatgtccttcttgcggccggtgatatacacgaatccatcatcgtcgatggcccccagatcgccggtcctcagccaaccatcaggcattttgacttcagcggtcttctcaggattcttgtagtagccaagaaaaacattggggcccatgacctgcagctcgccatcatcatcggtgcgcacacccatacccggcccgggcttaccaacggaaccgacgcgattcgcattttgccagttgacgatcatcggagccgcggtttccgtcataccgtacccctgaatgaacgtgatgccatccatgccattgaagaagtgggcaaggtcgacgttcagcggggcgccgccgcatgccagatatttcaggttcggaccaagcgcggaacgaatggacttgccgacgacggacatgaagaaggaatgctcggctcgggccaccatcgaatgatgtcccccgtcctgctcgtccttggaccattgcacgaaatgatcgaacgccttggcgaagaccctgccgcgaatacccgcaccggccttctgcgaggcagcgttgtacactttttcgaacacacgtggcacgccaagcaaatacgtcggtttgaaactgcgcagatcggcgagcagatgcttggctccaggcagatagccgaccacgccttgtccgccaatcgccacgtattggatatagcgggcgaagcagtgcgccaacggcaggaacagcatcaacctgttgggctggtacagcatctcgtcaagaatgatgtagccattgagcacgatatgcgtgaagttacgatgggacagcatcgcacccttcggacgtcccgtggagcccgatgtgtaaacgatggtgagcatgtcgtccgccttgatccgggcaatgacctgatcaagggtatcgtcatcgacgccctctccgaaatcggcgaccgcgtcaagaccgtccgctttgaaattgaacacgtaacgcagcccttcatgcatgtcacgaatctgttcgagcgtctgcgtgtggacggaatctccagcgaaggcaataaccggctccacctcttccacgatggaagcggcctgcttggccgaatcggtttcataaatcggaacgcttaccgcgccgatggccgcgcatgcgaaatcgaccacaccccactcgtaacaggtgggagagtaaatgaccaccatgcttccggctttgactccaagaccgataaggcccttcgccacggcgcgcacacgagcgagcatctggcctgccgtcacatcatgccattgccgagtctcatcatcctgccattgtgcgataagatcatccggattcttctgcgcacgacgcgacagcaacgcatataccgtgtcatcatccgtggtgctgtaggccggctctggtacaaattctctcaacatggttctctatagtagttcccgtatgcttaaggcacgctgaaagcccttggcatcgactgcgaacatcgacgccaagggctttttgcagattcctaccgtatcatcgcatcaatgcgatcacccgaaatcagccaagacgcacttccacgtggagcctttgagcctgaatgcggtgttgcatctcaaccgcgtttcgccgatgttgagcaaagccgcacattcgaatttcgtggtcgaagtcaaccagccgttaatggcggacacgttgatgggaagcagaccaatcttggcatatagatttgcgtcttccttcatataatggcctattatggaagctgcgattttaagcctacgcatacagtcctccgttagaatacgctctacatgcgccggcttttgccgaccacggaagatgtcgatggcatcgcacgacatgcgcgcgcccaataacgccaaggaataggcttgcttcgcgtcccacggtgtggaatcggaccggataacatggaagggcacccgcatgccggataattgtgtttccaaaaacccatcatatgaaggaagcttctcgacggattttcctatgcactgcagccattggccattgttttccgcttctttaagaccgacatacgaatcagggtctgacggtgggatttcgtcaggctcattgccttctatctccttgtcgtcttccggctcccgctcagagccggactgccattccggaggtgaaacgccatcgtcagataagtcgtccattgccatggatccctcatttctttacctatttaatgtcatccaactctcttcactgagaaggaccaaaaacattaatacataaagacaatccccccgtcaagtcgacggagggattgtggataactttttttatccacaggacgaagctatctgatcagtggctcgaagcgaccgtaaccggacaacgttggaagctcttcaaatcgacataaccggtcgtggccatggctctgcgaagcgccccaacaaaattggtggttccgtcggcgttatggctcgggccgaacatgacctcctgcaaggaacctacggtgcccacgttagtgcggaatccgcgcggcaacgtctggtggcgggcctcggcgccccaatgcatgcctttgccaggagcctcggaggcgcgtgccagaggcgagcccagcatcaccgcatcggcgcccagcgcgaatgccttgacgaagctgccggaatcacccataccgccgtcggcaatcacctgcacatagcgtccgcccgattcgtccatgtaatcgcggcgggcctcggcgacatcggcgatggctgtggccatcggcgcgtgcactccaatcgtgttgcggttggcggataccgcaccgccaccgaagccgacaagcacgccagcggctcccgtgcgcatcaaatgcaacgcagccgtgtagttggccgcgccgccaacaatgacggggacatccaggtcatagatgaatttcttaaggttcaggggctcatggtccttggagacatgctccgccgacaccacggtgccacgaatgacaaacagatcgacaccggcctcaagcacggtggaataataatcctgcgtacgctgcggagacagcgcgccggctacggtgacgccggcatcacgaatctcatgcagacgttcgacgatgagttccggcttgatcggctcagcgtaaatctgctggatgcgttcggtggccttgtccgcaggcagctgcgcgatttcgtccagcagcggctggggatcgtcatagcgggtccacaatccttctaggtcaagcacgccaagcgcgcccatcttgcccatggcgatggccgtggccgggctggtcacggaatccatcggggcgccgatgaccggcacgtcgaattcataggcgtcgacctgccaagaggtggacacatcctgaggatcacgggtacgacgggagggaacgatggagacatcgtccagcgaataggccagacggcccttcttgcccaaaccgatttcaatttcctgagacatggtttcaaggctaatgctcagctatgacagtgccttcgcgcgtgtccccacggttttggacatttccatacggaattaacacacatgtaataagacggaacccatcaccttcaattccgacagggaggacaaaccatggccaaaatcaaggtcgaaggcaaagtcgtcgaactcgacggcgacgagatgacccgtgtcatctggaaagacatcaagaaccgtctgatcctgccgtacctcgacgtggatttggattattacgatctgggcatcgaaaaccgcgacgccaccgacgatcaggtgaccgtcgacgcggcgaaggccatccagcgcgaacatgtcggcgtcaaatgcgccaccatcaccccggacgaggcgcgcgtcaaggagttcggcctcaagaagatgtggaagtcccccaatggtaccatccgcaacattctcggcggcaccatcttccgcgagccgatcgtcatgagcaatgtgcctcgcctggtcccgggatggaccaagccgatcgtcgtggcacgtcacgccttcggagaccagtacaaagccactgatttcaaggttccgggagccggcaccctcaccgtaaccttcactccggaagacggctccgagccgattgagcacgtcgtttacaattatggccctgacggcggagttgcccaggtgcaatacaacgtgaacgattccatccgaggtttcgcacgcgcctgcttcaactatggtctgatgcgcggctatccggtgtacctgtccaccaagaacacgattctcaaggcgtacgacggccagttcaaggatacgttcgccgaggtgttcgaaaacgaatacaaggacaagtacgaggcggctggcctgacctacgagcaccgactcattgatgacatggtggcaagctccctcaagtggcatggcggctatatctgggcttgcaagaactacgatggcgacgtgcagtcggattccgtcgcacagggattcggctcccttggcctaatgacctccgtgctgatgactcccgacgggcagaccgtcgaagccgaagccgcgcacggcaccgtgacccgccattatcgccgttggcagaagggtgaaaagacctcgaccaatccgatcgcctccatcttcgcatggaccggcggtctgaagcatcgcgccgaccttgacaacactccggaagtcaagcatttcgccgaaactttggagaaagtcatcatctccaccgtcgaaggcggacagatgaccaaggatctggccatgctcatcggaccggaccagccttggctcgataccgagggtttcatgaacgccctcgacgagaatctggcaaaggctctggcagagtaatctatctgagctgtcgaaagcccgtatgcgcaatcacacacgcgtacgggctttttgacgtccggatattacaatcgatggtcagtataaggaacgtctattcttccgcaaaggacatggcatgattctgcatcgcacaatcccggcgaaacgtctgctcgctctgctggcatcggtctgcatggcaacagccatgggggcctgctcgcccaacggtgattcgcaatcgcagcaacagccgtcatcacaatccagcgcaacagccgatgccggcaatgtggcgattttcgctccgacagacagcatcaccatctctcaacagacgccattgagcaaatgggaaaaactcgttcccgaaatcgtgtcctcgttgaaacggaccggtgtcaaaagcggcgacatcaccgtgaaaaccgcttcgaacctcgacaaacaaagtcaaagcgtccaagactatgtggtgaatcacatcaacggaaccgagcattcgtccacgaaagccaaaaccaccttggtggtggcgcctgtcgccgagatgccggaatccgacaggcaatacggcgactatgcacggcatgatatcacgtggaactccgacgcgtcggatgaggacgaacaggattatgcgcaatcagcgcaacggctggtttcggcgttgcagcttgcgcagaatgaaggaatgaaggtcgttctgatctccaatacgcttcaagggtatgcgccggacatgtacgtgccgatgaccacggccgagcagattggagaactgcaagccaaagagctcgtcaacaagctcgagctcgacaaggcatcgtccgatgcccccaagcaaatcgaggtactactcccctacgacgcggccgacggacatgatgccaaaacggacacgtccttcgcccagaacatgttcaaaggcatctggaaagtgctcgaaccgtatttcaaggacggcaaagcggcatctccttccgagacgctcaccgcttcgaccaccaaggatgactggcggtccgtggcattcgattcgtcaaaagccgaacaaatcaaatcggtgcttgccgaacgtctcgacgcggacaaggacgattcgcaccctgtccaccttgatggcgtcatctcctgcaacgactatgtggcgaagaacatcgccgacgagttggacaaactcggctacacaggttcctcagccgatatcaacccttccatctcaatttccggcatcgtggacagcatcacgggcaaaaaagacctgaaacggcaggcagtgcctgaccctgcgaagacgtcgtcatcggatgacgacagcgattccgataacaaggaaaacgcaaaatggccgataatcaccggctatggggcctatatcagttccatgccgaacatcgtcaacggcaagcaatggatgaccgccatggagaaccgcaaggcgttggccgatgacatcgcgcagacatgcgtgcgactgaacacttcgggcaaactttccaaactcggtttcatccgttccgcaacggtcgaggggaagaaaattacgaccatccatgaggagacattggcgatcagcgccgacaatctcaagaaaacgctgattgaacccggctacatttcgctggcggatgcgggcctatgattcttccgggattcttccggatatggtgggggccgatggcatcactcggatgtcaccggcccccaccatatttcgaacatcattcggcgtgagccgccggcttcctcggcacgtagaggaccttgtcgatcaacgtccggtaatgttcaaccactgcctgcctgcgggccttcatgctcggcgtgaccaaaccgttctcctcagtgaactcgtcgggaacgatttcgaacttgcggattgattcggcacgtgaggcgagctcattggctttgttgacggcacgctccacttccgcacgcacaatggggttcttcgaggcttcatccaaatcagcgacctgttccgctcccttggattccagccataggttcgtctccgccaaatcaagggagatgattgcggcgatgaatggcttgcgatcgccgatcatgacgcattggctcaccaccggcgaagtcatgatggatgcttccatctcgcatggggagacgttcttgccgcctgcggtgatgatgagatccttcttacgcccgacgatggaaacgaagccgtcatcatcaatggagccgagatcaccggtatgcagccatccatcgacaatttgctgcttggtaacgtcaggattgttgtggtatccggcgcatacggcagggctctttatgcacagctccccttcttcgtcgacccccatggtcacgccttgcagaggcaagccgatggtgccgatcttgtagccttcggtcggattgacgctcgagggggcgcacgtttcggtcatgccgtagccttccaatagcggcagaccgacaccgttgaagaaatgcgcgatagaggaatcaagcggcgctccgccggagaccgcatactcgacgtggccgccgaacacttccatgattgacgaatacaccagcttgttgtacagggcatgttttgcgttcagcgcgagtggaatgctcccaccggactgctgagcatgcgaccaatcgtatgccgtctgggtggcgtcagcgaaaacacgtcccttgaaaccggctccggccttctgcgaggccgcattgtagatcttttcgaaaatccgcggcacggcgaggatgaacgtcggtttgaacgccttgaaatcggcgagaatggtcttcagattgctggacagaccgagtgaaacgtttccggcaaagcagaagaactgcatgtatcgggcgaatacatgggcgagcggcaggaacagcagcagtcgacgattcggtttcatggcgatgtccggcatggagttgacgccggaataggtgatgaacacgaaattggcatgcgtcagttcaacgcccttcggggtgccagtggatcccgacgtatatacgatggtggctagatcggagcctttgaccgtttgttcacgttcaaggaattcggcgtcggagaccgcgcggccgtattcgatgatcgtgtcaattgcaccaagtccgatgacgtacacgtcgccaagatccgggcactgatcacggacggattcgattttgtcgcgctggaaatcatcctcagcgaacgccatcttgacattggcatcattgaaaatcatcttcacctgcgccggcgaattcgtttcatagaccggaacggtaagggcgccgatggacatgatggccacatcaagcgcggtccactgccagcaggtatgcgcgataatggataccgaatctccaggcattacgccacgagcgataagtcctttggcgagggcgacgaccttgtttttgaactccgcagcggtgaacgccgcccattcgccctgagcgttcttgtattcgacaagattgtcgtcaggagtgcgttccacacgctcctcaagtactgagaagatgtttttgtccgagtcaattccctgttccaaagggcgcgtgtattccttgatcataagcttctcgctcctcgaaatctaatgtacagacagcattatagccggaataccgcactttttctttaaggccacgaccccaggacaacgacaacacccgtggatatggccgttacaacggtttcagttcaacccgcatcgacctcactctgcccgacggatccgcataatcacgtcctccgctcttgaggccccaatgcaggcatccatcggcgcaatgttccgagccaccttcaacacgagcgaaacgctcccccttggcgatgacggccccgaccggtcgcgtagtgaccgcgggttcaaacgtcgacgtcaggcttcccgtttccgcaccgtggcgaagcgttaccacggatttgcccgccactttgccactgaaggcgaccacaccatccgcgggcgcgatgatggcgtcttgcggccgtgcacgcaaatccaaaccgcgatgcccaggcaaccattgtttagccggcgcatcatattcgccgattacttgcgcgtgctccaaaggccactgcattgatgtgcggcatgccgcttgtgcgacttcatgcgccacgtcatcagccgattgcgcgtatgccgacgccgtaggttgcgcgcagcatatcgtgaacgcgatattcgccaatacgcatacggccatcgccgcggcgcaccggtgccggttgcgcttgtcaatgtcatcggacatcttattgtgtcgaacacgacgacggtattcccatttgttcatgaggcctcctgtggtccgcgtctctatcggggaatcgatatcatggcacgttcgaagaccgcccgtcgacttggaacgaccttgtggtcggagaacaacacttatccacagatgccgggcgtgtcgcgccatgacatgccaaaacgccaccgaacgtggcatacgatgggacgcatgagtgacaacactacgcaacgcaaggcattgcagcagttggagagcgagccgtccgaggaacgcatcgcctactaccgcaagccattcatggtgctatgggccgccattcaggaggcttcaagcgagctgcaggacgattacacgctttcacccgaattgtcccagttatgggttggcgagcaaatacggcaggtttcggattcgctagtggatcggctcgcggaaatcgccgtggcgcatggcgagtcaaaatcgaatgtggcacgtgcggccaacgcaagtcccgacaacgtcatacgtcgcttccctcgactcaaggctgatgcggcacacgaccgcacactcattgacgacgtgctcgattcgttggaatagcagcgaaaagttcttatggaaacaaaaaagcccttggaaaaccaagggctaaaaagctcctgcgactgggcttgaaccagtgaccgttcgattaacagtcgaatgctctgccaactgagctacgcaggaatatgttccggagtacccgaaactgcgctcctgcgactgggcttgaaccagtgaccgtccgattaacagtcggatgctctgcctgttcacgaccgtaagcttggccgaacggccttgagtgtgtcgtgaacaggacgcccgccctcccacggagacgcgcctctgtatttatctatttatctgcgattattaatcgcctttatagtgcctaaaaaccgctttttaaatcgcaacttaaatcgcaattaaaaagtttcacgcgtcgatgccgaccgcctcgctgacatgttcgaacccgtcgcgcctgagcagttcggccagtccacgcttcaacacggtgatctgctgcggaccacggtacatgagcgcgctgatgaacatcaccagcgacgaaccgcaacgaatcttctcatacgcctgctgcggggtgaagacgccaccgatgccggcgattgcgaaccggtccccatactcgcggtagacctgcttgatgcgttcgttgctggtcgcgtagcacggcgagccggacagtccgccctcccaatcgcgcggaatggacatgccggtgcggtccttctgcagattggcgatcgacagtccctgcacgttgtgctcggcgagcacgtccagcagatccttgaattccggccacgtcttattgagcggcattttgacgagcgtcggctgcggacggtcgattttgtccagttcggtgaacagcttgtcgagcgcttccgggctttggttgaacggttcgccggccatggtgttcgggcaggagatgttcacttcgaccatggcggtgcgtccggccgcgcggcgcatcgaaatgcagtaatcctcgatgccttcgtccagatcgccggtcttgctgtcgttcgtgcgggcgatcgaaaccgacacctgcatgctcttcgccttcgtccatgcgttctcggcgcgcggaatcaccaccgcggaaccctcgttggcaaggcccacgtgcaccatcatcgaatcgtattcaggcaggcggtggaaccatgggcgcgggttgccggggcaggggcgcgacgtggtggagccgaccgtttcgaaaccgaagccgacgttgtcgagcagcaccggcatctcgcaatccttgtcgaggccggcggacaggccgaacggattggcgaagtcgacgcccatcacgttggtttccagtatcgggtcggtgtagtcgagcatttcgcggcatagccacatcagcggtggaatgttgcgggtgaccttgcagaaatcgatcatttggctgtgggccacgtcgggcgtctggttgaagatgaaatgcggtttgatgatgtgcttgtagccgaacgtgaaaaggtcggtggtggctttgttcactgcgtcgtgccaaaagttttcggaaacgtatgtcatggttccttattctcgcacgttttcattggtttcgcatggcattttgggcaaaagccggtgtgtgtcggtgtggcatataggacgttcgtttttgttcgttttaggctgaatttgagtcgattgtggtgcggctttgcgcgaaacacgcgcgaaacgctcaactcagttgtatttttgagtgaacatgtgcgataatgttcatatgatttcgtcacaacgccagcatttgattttgagccgtctgcgtacccgtggtgcggtgcgcatcactgcactgtccaaggaattgggcgtctccgcgatgaccatccgccgtgacatcgccgatctggcggacaagggtctgctgaagcgcgtgcacggtggcgccgtcagcaccagcacactgctgagcgaaccgctgttctctgtaaagtcgcagatggacatcggtctgaaggacgccatcgcacaggaagccgtcaaatacgtggcccccggcgacgtgatcgccatcggcggcggcaccacggcgtacgtgttcgcgcagcatctgctcgaatcgcagcaatcgtccggcatcaccatcctcaccaactccattccggtggcggagctggtgcaggcgctcgaatcgaaagacgtggaagtcatcgtgacgggcggcgtgaccacccgttccaactcgctcgtcgggccgatcgcagacaaagtggtcgcctcgctgcgcgtcaacaccgtattcctgggcacgcattccgtgtccattccgcgcggtttcctcatgccgaactcgctggaagccgcaaccgatatggcgatgatggacattgccgatcgcacgataattttgaccgaccacaccaagtggagctgcacgtcactgtcgctgttcgcacgttttgaccaggtggatacggtcatcaccgatgacggattggaccccgattcggtgtcgaaaacaagggatttggtcaaagagctcgttctggcacgccaggccgagccggttcaggaaggtgaataatcacatgagtgatttcgtcaactacactccgggagaatatgcgaaggagcatatccgtatcacgccgaccacgcttgccgatggccgcgacttcttctatcttgacgacgatccggaatacgtctccggcgtcaagactcgcgaactgaaggatccgcgccaacttccgtaccgtttctccaaccagctcaacgcggccggcgaggaagtgccgtacgcggctccggaaatgcgccgcgatccgctgactggcgattggattccgatggcgaccgcacgcatgaaccgcccgatcaccgcaggaccgggcgccaccgccaagggcaacccgctggccgcacgcaagccgggcgatccgtaccaggacggcgaagtgccggacaccgactacaacgtggtcgtgttcgaaaaccgcttcccgtcgatggtgcgcgtgccgggccgttccgaagccgtggaatacgtcaacggcaacccgctgtgggagaagaagctcgccgcaggccgctgcgaagtgatctgcttcgacccggatgaagacggcctgccggcggacctgccggtctcccgcctgcgcaccgtcgtggaagcatgggcgttccgcaccgccgaaatctccaagatggagggcatcgagcagatcttcccgttcgagaaccacggtcaggaaatcggcgtctccctggcgcaccctcacggccaggtctactgctatccgttcatcgcaccgaagatggaagccgaactcaagcagaccgaagcctaccatgagaagaccggtggcaacctgctcaaggatctcatgaactccgaaatcgaggccggggagcgcatcgtcatgcgcaaccacagttgggtcgcctatgtgccggccgcggcacgctggccgctcgaggtgcatgtggccccggtgcgtgacgtgctcaccctcgacgagctcaacgatcaggagcgttgggatctggccgtcatgtactccaccctgctcaagcgcggcaacgcgttcttcgacaagggtgacggcaagggcatggacctgccgtacatcgcagcatggcatcaggccccgatccacgacaagcgccgcgaaaactaccgcctcaacctgcagttcttctcgttccgccgcgccgccaacaaaatcaagtatctggccggctccgaatcaggcatggccgcatgggtgtccgacaccacgccggaactcatcgccaagcgcttccacgagctcggaccgatcgacatcgaaggctgaaagccaataaaacccaaaggacaaaacaccaatgactgctgttgaattcattgagccgctctcgcacgacgagggtgtgaagaacgcgaccgacctgttccgagccacctacggtgaggaaccggctggcgtatgggctgcaccgggccgtgtgaacttgatcggcgaacataccgactacaacgcgggcctgtgcctgccgatcgcactgccgcaccgcacgttcatcgcgctcaagccgcgtgaagacaccaaggtgcgcgtggtttccgacgttgattccgaaaacgttaccgaagccgacctcgatggtctgcaggccggtggtgtggaaggctgggccgcctacccggtaggcgttgcctgggcattgcgcgaagccggcttcgatgcggtgcagggcttcgacgcggcattctcctcctgcgttccgctcggatccggtctgagctcctccgcagccatgacctgctccaccgccttggcgctggatgacgtgtatggtttgggttatggcgcatccgatgccggtcgtgtgacgctgatcaacgccgccatcaagtcggaaaacgacatggcgggtgcgtccaccggtggtctcgatcagaacgcatccatgcgctgcactttcggccatgcgttgcgtcttgattgccgtccagagctgagcccgctggagaacgtctcccagcaggaattcgatctcgacaagtacggtctggaactgctggtgcttgacactcaggctccgcaccagctcaacgacggccagtatgcccagcgtcgcgccacttgcgagaaggccgccgaaatcctcggcgtggccaacctgcgtgtggtcgccgacgaaatcgctaaatccgaggatccgttccaggcactcaaggaaacgctcgacaagctggaagacgacacgatgaagaagcgcgtgcgccacgtcatcaccgaaatcgcccgtgtcaattccttcgtgcgtgccttcgccaacggcaagatcgacgaggcaggccgactgttcaacgcgtctcatgattcgctcgcagcggattatgaagtgactgtgcccgagttggatattgccgtggatgtggctcgtgtcaacggcgcgtacggcgcacgtatgaccggcggcggcttcggcggctccatcatcgcgctggtggacaagggccagggccacgagatcgcacagaagattgctgaccgcttcgaaaaggaaggtttcaacgcgcctcgcgccttgccggcgttcgctgcggcttccgcgagccgcgaggcttgatcgcagaagccgatgcaaaaatgcgcgttggcgcacgcccatgaaaaaggacgtgcgccaacgcgcgtttttgcacgatttacttgtggaccagatggcgcaccagcgtattccacggcgatgaccagcaggtacgatgccgaatgcttcatcccggctcccggtgcggctacgtgtttgggctggtgctgtctgtgatcgtattcgtgctcccctccttctttctgaaggaggggagcacctttcgtaagtagcgacgtgtcgacttggtggccgtcatgttcggctacgcttttgtgcgtacaacggacgggttgcacgtgtatttgatgaaaaacgatacgttatacgattaacggcgtgtcgcgatgtgggtgattccggtgttctgcaagaacggcagtatggagccgaagtttacgtttgcgacgctggggggctggtcgatgagagcgctaactattgagataaacgattaacgtttgacattaaacgattaatgatttatagtgttaaccaccgcaaagaaacaaccacaaagcaagtggctgacggggtcgtaccggtgcgtcttacatcggtgcgaggaggaaacatcaaggaagaaggagcctaatcatggcacgaagaagtgttcgcctgttggcatcaatagctgcagtcgcgactatggtcacgacgtttgccgcctgcggcaacaagcaggccaccacggacgagaacggcaagccgatcgtcaatattcttgtccgccgtaacgtgaccgatcatccgatgcaggacacccagtacaccaaggatctggaagccgcctgcgattgcaccatcaagtggcaggaagtctccgacaacgcttggggccagcagaagagcgccaagatggccgccggtgaattcccggacattggcttgagcttgttcagcatggtggatgcggccaagtacagcacctatttcgaggatctcaagccgcatctggacaagatgccgaacgtcaagaagttcctcaaggcccagccgggcgccgcgaagtacgttaccgatggcaccaagatcgccatgctgccctccgaccgcggcaagggttacgaggtttccggcactcacatgttcatcaacaagacctggctggacaagctgggactccagatgccgaccacttgggacgagctcgagaacgtgctcgatgcattcaagacccaggatccgaacggcaatggcaaggctgatgaggtgccgatgaatatccgcagcctcggcttcggcctgtggagccctctggcgctgatgaactccgaaggcgtggtcacctccttcatgggcggcggcgcttccgaacagggctattatgtggacaacggcaaggttaagagctattacacctccgacgcgctcaaggacgtcgtctcctacctgcacggactcatggccaagggccttatcccgaaggatgtgctcacccgcgacgcctcgcaatacacttcgcagaccgtcagtgacggcaagaccgcgctgaccggcgtctccttcggttggtccaactacgccgaatacggcaacgcgcttggcgaccagtacgtcaccctgccgccgctgaagaaggacgcctccacgcccgactcccaggtcaagtgggattattcccaggacgcctgccgctgggcctactccggttccggcctgaccgtcaacccgaacgcagccaaccaggacgccatctacaaggtgatcgacgccatgtacggcgagaagctttccgtggctggattcttcggctctattccggatatcgtctccgatgacggcgaccaccagtacaccatcgacaaggctaaagcctacgccgaatatcctgatacccgcgccgtcgccctgcaggaccgcttcggtggctggattcgcgacgacgtgaagatggtcaacgacaccaacgccgaccaggtcactgcgtccgatttggccattcgtgaggcgcgcaaccgtgtcgacggcgtcaaggatgtcgtaccgatttacgtgcgcccgaataccgaggactccaacaccctgcaaaacaacaacaccgccatctccaactacgcgaacaaccagatcgcgaagtgggtccagaagggcggcatcgacaaggaatgggatgcctacgtgaagaaggtgtccgaaccgaccctcggcctcgacgccaacatcaagatttggcagaagtggtacgacaagtacaccaagtagccaagtaataccgcggggtccatcgcacgggttcgtttctctcccgtgactgccgccggaccccgcatttttgttccctagcaatcatcctaaattggagaccaacatgagtgcacaaacatcgcaaggcgttgctgcacggaccgtggcgatggaagcggctcccgaccgcaagaaaccaggtctgctcgatcgcatcgccgaccacttccgccgctactggcagctgtggatcctcaccgctcccgccctgttcttcgtcggcctgttcgcctacgtgccgatgtggggcatccagcttgccttccgtgaattcgacccgaccaagggtctgaccggcggcaagttcgtaggattcaaatatttcaacgagttcttccataacccgctattcggcgagatcatgaccaacaccattcgcatctccctgtggacgctggtcatgggcttcatcttcccaatcatcctggccctgctgatcaaccagatcggctcgaagaagatcaagggcttcgtacagaccgtcacctacatgccccacttcatctccgtggtggtcatcgtctcgatgctcaacatcttcctgtccccgggctccggcatcctgggccgcttcttcggcgacgaatcgctgatgggctccaccagcgccatcaccgccgtctactggatctccgaagtctggcagcacgtcggctggaactccatcatctacctggccgcgctcgccggcgtggacacctcgctgtacgaggccgcgaagatcgatggcgccggccgtctgcaactgatccgttacgtcgacctgccggcgatcatgccgacctgcgcaatcctgctcatcatgaacatgggttccgtgctcaacgtgggtttcgacaagatctacctgatgcagaattcgctgaatatgccggccaccgaggtcatcgcgacctacacctacaagatcggtattattaacggccagtattcgtattcgaccgccatcggcctgttcaataccttggtcaacttcgtcttcctgatcaccgcgaacgcgatcgccaagcgcgtttccgatacgagcattttctaggaggcagtcatcatgtctgcaacaacaaccggggccgttgcccaaagcaagaacgatattccctggaacaagcatgtacgtcagaagaaaacgccaggtgatctggccgtcgacttcgtcatcgtgctgcttctggtgttcaccgtggtcgcagtgctctaccccctgtggttcgtggtcatcgcatcgttctccgacccgaatgccgtggccggcggcgaagtgaccctgctgcccaaaggcgtgaccttcgtcgggtatgcgaaggtgttcgccaaccatcgcatctggcagggctatctcaacacgatcatctactcggtggtcggcaccgcggtcaacatggccgtgaccatcccctgcgccttcgcgctgtcccgccgcgaattcaagccgcgccgcgtcatcatgttcctgttcaccgtcaccatgttcatcagcggcggcctgattccgaactatttgctgtacaaagccctcggcatcaacaacaccatgtgggtgttcatcctgcccggcgctgtctccgtatacaacgtgatcgtggcgcgctccttcttcgaaacctccattccggaggaactgcatgatgctgcgcagatcgacggcctgagctacttcggctacttcttcaagatcgtgctgccgttgagctccgccatcctcgccgtcatcggcctgtactacttcgtcggccactggaacgacttcatgacaggcttgatctacatcaccgacgacacaaagcagccgttgcaggtggtcttgcagcagttgctgctggtggcgcaaggcaccggtacgaacgtcaacgccgcggcccaacagcaggcggccgaccagatcaagttcggcatcatcatcgtctccaccctgcctctgctggtgctgtacccgttcctgcagaagtacttcaacaagggcgtcatgctcggcgccgtcaagggctgattgaaagggattcgccatgctcgctcgtttttccgtggcctatgaacggttctgccgtctgctgctcacgatcttcgtggtgaacatcgccatgctcgtgcacacactgctgggtgccgtggtgctgggattcttcccatcctgcgccgccgcgcaaaccacgttccgcacgtggctgcgtgctgaggatcggtcgatgcgtgccaaggaagtatggggcatcttccatggcgcatggaaaaacgagctcaagcaggcgaatctcttcggctggccgttggccgtatgctgggtggtgctcgccatcgactactacatgatgaactggcatgcacgcggaacgttcgacgtggcggtttccggcgtactgttcgtgctggcactggtattgctggccttcaccatgctggtctgggtggtgcgcgcgaactatgacgaacgtccgctgtggatcgtccgcacaacactgaccatgatcgtggcccgtccgctgtgcaccctgctgcagatcggactcgcactgctggcgatccttgcctgggcgcaatggccgggtctgctcatggtgttcggcatgtcgctgccgatgttctgcactgcgtggatcgtgtactcgttcggccggattccgggaatggacatccatgaccgggagcagccgggcatccgatacgcgaaaagctgaacggcagagtgtcgccaaagaaaggcgggcatacaatggaatccgcttcacaaagccgccaagcagacaaggcaaaaccattggtatcgatcaaagacatcgcaaaagaggccggcgtctccatttgcaccgtgtcattggtcatgaacaacaaggaccgcaatcgcgtcagcaaggcggtggtgcaacgagtgcgcgaaacggcccaatcaatgggatacaagccgaactccgtggcgcgtacattgcgcaccagcaggtcgtatgtcctcggctttatcaccgatgagatcgccaccacgccatatgccgggcgcgtactggtgggagcgcaggaggcagcgcgcaaactcggctatattctgctcaccgtcaatacgggaaacgatcgggaactggcgaaccaggagatcgcggccctgcggcagtaccgcgtggacggtttcctgtatgccatgatgtaccaccgtgttgtggagatccccgccgaactcgaaggcagccccacggtcgtcgtcgacagcgaagacgagaatcgcaagattccctcgatctaccccgacgacgaaatggcagggtacgatgccaccaatcggctgattcaggccggctgcaaacgcatcgtttactacggttcctcaatcaccattatcgcccagggggagcggttccctgttcacgaccgtaagcttggccgaacggccttgagtgtgtcgtgaacaggacctgcgggaagcaaagcggcgccgcaagcaagcaacactgcgagccaaacagcagccatcacccatcactcattcatcgcaaaaaatcgcaattcagcaagctcaaaaaaagaaaactactcgctcaccttaggctgcaatccaatcgacttctcaaccgcggaatcctgcccacacaccttaagccagttcgccaacagccgatacccgtcctgggtcatgacggattccggatggaactgcaccgcatacatcggcttgtcgcgatgcttgatgccctgcacgatatgatcgtcctgcgtccacgcggtcaccaccagctcgtccggcacggaatccggttcgacagccagggaatggtaccgtgtggcgaccatcgggttggcgacgccttcgaaaatctcatcgtcgatatgctccaccaaactggtcttgccgtgcatgatggtcggcgcgtggctcactgtggcaccgaacacttcggccaatgcctgcatgccgaggcacacgccgaacatcggcttgttctgcgccgcgcacaggcgaatcatgtcctcactagcgccggattccgatggagcgccaggaccgggggaaatcagcacaccgtcgtagtcgtcgatcacgcccggggcggacgggtcgatcgcatcgttacgtaccacggtcactgtggcaccaagcgtcttcacatagccgacaatcgtgtaaacgaacgaatcgtagttgtccacgaccagaatacgtgcggaatcggtcatcatgctcctatcaacgtttgaacagcagtgtacgtgcgaaatgtctcatgacaccgcgcgcgtctcacgctgcagccatcgtgcggcgatgcggcaccagcaaacgccctgcacagcccgttagatggccgtgtaattcgacatctcctgcaatgccgggatattcgtcgcagcccacgggaacagccattcaaagcaggatgcgcaggccgcgaacaccagcagcaacagcaatacgatccgaataggcagcacgcccggctgcagtcgcaccaggctgccgtacaggctgaaatcggccttctttcgtcttccggcgcgcacgtcggcgagatacggccatcgccaggcgacggcggcggaaataaatatgatcacgtatgcggcgagcgcgccgaagatccacggtttcagcgtatcgatcgacgacaggaacgacgactgttcgttgttgacgaatttgactgtgccgttggcgttttgggaggccagttcctgtgggatgccgtcggcgaccttcgcccagtaggagaattcggcgtagctgatccagcggtgcgtcggcgtggagtatttcggttcgcaggtggtcatggtcagcatgcgtttggtcggtgtctcgcccggatgttcggggttggcggccacgacttccacctgcgacggcagcacgattttgtagctggtgtagtggtacacgtaccagtaatcctgcgtgcggacgatgatcgggtcgccttcctgcagtttgtcgacgtcgccgagcggctgcccgtagccgttgcggtggccggcgaaggcgaagttgccgacctggccgggcatctgcgaatccgtgtagtggccgaggccgtgcttgttgagctgtgtcaggtccgtgccttccaccaggttgcgctgccattggctgccgaatcgcggtatgtagatttgggcgatgagttcgccttccgtggcgctttgcggctgtacaggcgggtcaccctgctgtgccttcgccacggtgacgttgccggactttcctggatcggaccaggatacggattggcgggtttcgatctggttatgctccgactgcacgcccgtccaccacatctgccatgcgatgtacagcgcgcagatggcggcggcggtcagcatgagttcggcgaggatgccgagtatcgtccacagcgcgcttttggtgcgtccgccacggcttgtcacatgtttcatcgactgttatttcccctcttgcgattcgccgttcttgtcgttttcgagcgctttcgcatactgcaacggctgctgcaacgcgtcggtcgcgtcgaaatgcagtttcgttttctcgtcgacctgccatcccaggccgaacgcgctcacgtactgcttgtagatggacacttcctcggaatcgtcgagcgcttttctcatgccctccactggtccgatcgccgagattttgaacggcggcgaatacttcttgccttgcagcagcagcacgttgccggagcagcgcacggcggagttgaacaatacgcgctggtccatgatctgcatggattcggcgcctcccgcccacagcgcgttaaccacggcttcgatgtcctgctggtgcaccacgtaatcgttgatgttggcgctggatccgttggcgtcgaccatgttctcccatagcggcgaatcgtcgagcgtcaccaccagtcccgggccttccacggcggggagcatggtgccgttgccggcgctttcgctgtcttgcgatccgtcggcgttctggctgtcgagtgttttgctcagatcgttgactctggtgctcagcgcatcgatttcggaccgtagcgagttcacttttttcacgcgctgttccacgagttcggcggtatcgttgctcaccaccacggaacggttgacgcgcaggttggtggacagcaggaatccggagaacagcagcacgaggaacgccgcgacgccggccgccttcgaccgtttcgcgctgtgctttccggtatgcttcgccatacgcgcctttccaaacctgcctgaatccgccgggtttcactgaacaattgtcctgattttgaacagttttacgccgtgagttcgccgctttcgagtctacccactattatgacttttagcctattaaaggagactatgctgatggctgacgaagagctgcacgaaaccaccgcggatgaccagaaggatctgcagtccgccgacgacaccgctgccgtcgaggaaatcaccgaagatgtcgtcgacaagacttccgttgacgaggaccagtccgacgatgacgatctcgatattcctatggaccgtgtcgaagcggtgctgaacgccaccgttgataaggattcgctgtcaccgcagatgcaacgcatgatgaaccgtcaggcggagaacacccgccgtgtggaggaaagcatcaagggcaccaagtccaacccgcgctggttcgtgccgctgttctgcgcgctgatgatcatcggtctggtgtgggccgtggtctactacctgaccaccgattatccgattccgcacatcggcgcttggaacctggccatcgcgttcgcaatcatcatggtcggtttcattatgaccatgtggtggcgctgagtcggttttctccgtttcacctatcccatcgaagcttatgtaagagacgccgggtccattgcgatccggcgtctcttttatccgcttcaaccactttacttaccgcgtctgcatcgccccgcttcagctttaggaaaagcggtttcctgtcaagtggaaagccgccgcttacccgccgattatctgctgatttttgccgtccgaatcagcacgtggtcgccgccttgcatggtggtgccgaacaggtaggcgtcgccgccgtcggcgagcttgagtttcttgcgcaattgcggcgcggtgagtgggaaattacgcacggcgatgttggcacggtccaagccggacagcaatcgcttcagctccttcttgcccataccgccgatcgtttcgatcgcaaaaccgcgccccggaaaaccatcgaccggctcgtccgatacgaacaggtggctgctcgggccgatttgcaccgccccgaatcgcgcttccaccacgtcgaagcagccggccttcatgatcgacgcgttcggctcgtacaggtaacgcagctcgtgcggcagcggcgcgtccccgatgcgcaggccgcgcgtataggcggccgcatcgtagtcgagccgctgatcgtcgttcacgcagtacacgtgcggcgcgcgcgtgtctgccgctgcggcatcggacgttgccccggcaaccttgccgtccagcaccagcagcagttccttgcattcgttgccggtggagacgatgtgcacttcggccacagtgcccgcgaaatcgtcgaccgccttgcgccagtcgagcatcggcgacagtttgatcatcacatatcgcgccttagccagcagcagatcgcgcagcgccagcacgtcgggcgtgcagtcctcgatcgcgtaggtgcgggcgccgtgctcgtcgcggcgggccgggtcgatgtagatcagttgtaccggctccatcgcacgtaggtattcgacgccgtcgccgcacaccacctgtgcttgcgtgaggcccagcgccgccatattgtgcgcggccagttcgcacaggtgcgattgacgttccacgtacgtggcgtgaccgaatccgcgggcgagatatgagaaatcgacgccgaatccgcctgtcaggtccgtcatggtcgcgtcgttggccgtctgtcccgccgattgcggcagagatcgcaacagacgccgggcgatttcggccttgtattgcgccgtgaactgcgatgagcactgttccatggaaatatgcgcgggatagacgatatccgcgcaggcggcccattgcggcagtttgttgcgggcgatttgccagcccgcgatctggtcgagcgcggccggcaggtcaaggtccgccgtccgtttggttttgagcgccaggtcacgcacgtcttcattgcgatgcgcctcggcgaaggcgcgcgtcacgtcgttgagcagtggtccgtcactcatggttcctctccccttcttcgcgagtatctgccatgtcgcacgcatatcgtcgcacgcgtatcctgcgtccgtggcgcatcggtattgcgtccttgtcgattgccttcgtcatcttatctttcctgtggataacaagtggacaaatgtggatgaatgtggataacgcccatattttgtgcctgagtcaacgtcgcaccacgaaatatcggcggcgattttccccatttttgtggggtgtggatatcggttatccacaattttcacataggaaattccttatgttccgccattttgtgaatatccttgtggataatccaccacgttatccccgacttacccacaggtctgacctcacttatccacaaagttatccacggatgtggaaaactacatgtgtgtagttcccgcattactggtacagaagtgacatatgcatcagcggattgccggcgttgcatcccacgatgatcgccacgaccaccacgaacaccgtgatgccgtacaccgtggtgcgccacgccaggcttttgccgcggaacgcatgcaggccagtgaccagcagccacgcaagcacgccgccgacgatgaatccgccgacatgcgcctgccatgcaatgcccggcgtgatcaccggcatcaggaagttgatcagcatccaaatcagcatcgaacgaatatcgatgcccattctcctgtacaccaccagaatcgcggcgaacaggccgaacagcgcgccggacgcgccatatgcggcggtcatccatcccgacggcgagcacacggcccacaccatcagtccggcaccgccacccaatccggacagcacgtacaacgcgaggtacggccaatgccccatcatgcgttccagcacgggccccacgcaccacaaagtaagcatgttgaacaggatgtgccacagcgaggtcggctggtgcaggaacatcgaggtgatgaaggtccacgggtgccggacggccgtggcgggcagcagcatgccggcgttcacgaacgcgttgccgccttcgggccagacgaggaagagaaccgcttcgatggcccacaccacgatgcagatcgccatgatggcggtggtgatgaccgggtcgccgttgcgccaccggtatcgcagcgatcgggcggagaacagatccttgaacgatggggaatcgggaaacagactgaatcgttggtatgccatagctcaacactaccggcacatgcggtattttccggcgcgtaaatccacccaatcgacacattccacgaattaagatagggaacagagctggcttgaacgagcaggtcagccagtgtttggaaaccttgaaaggagccgtcatggagaacaagtcttctaacggttggaagttcttcgcactgctcttcggagctttgcttgctggcgtcgtcggtctgtacatctacaagcagcagaatcccgactatgacccgtgggaggaaccgtgggagaacagctcctcgccggtcgacctgggcctgaccaaggacgccgagccggaggccgacgccactgccgccgctcctgccgctgagccggaagccgcctgatttcgcctttcccggcacacctatgccgcgttgggtttgttgcttcgccctgtatcttgcgatacagggtttttcttttgcttttgcgattgcgattggcttgcggccttccgtcgtactgtcactgtattgccacgtacgttcgggcactaccggcatacgcaatcggacatgcgaaaaacatacgaaaaggcccttggaaaatcccaagggccttcgtcgtcatcacttatccgcccattgcgaaacggacggagcggaagcgatcatgcgtgcgtcggcgatgccggcgacgtttcatgaccgctccataatcacttgagcggaccggtgtgccagatgcgctcgaggtaatcctcgatggagcggtcggagctgaagtagccggagttggccacgttgagcacggccatgcggctccacttcatcggatcgcggtaggtttcctcgatctgggcctggatgtccatgtacgcgcggaagtcggcgagcgtcatgaagtaatccttgttcagccaatcgttgacgaggtccttgtaggtgtccttgtcgccgtcggagaaggtgccgtcggcaaccatatcgatggcggccttgagctgcgggtccttctcgtagtactcgcgggacagacccttggtgtcgtagcccttggcgtacagcgcggagacttccggctcggtcatgccgaacaggaagaagttctcggcgcccacacgctcacggatctcgacgttggcgccatcgagggtgccgacggtcagagcgccgttgagggcgaacttcatgttgccggtgccggaggcttccttgccggcctgggagatctgctcgtcgaggtcggtggccgggatgaggttcatggccagctcgatgttgtagttccacgggaagtagacgttcagcttgcccttgacgtccgggtcgttgttgatgacgcgggcgacgttgttgatcagctggatggtctgcttggccaggtagtagcccggagcggccttggcgccgaacacgatggtgcgcggcatgatgtcgtcggcggagaccttgccggacttgatgtcggcgtagtcggcgatgacggacaggatcttcagggcctggcgcttgtactcgtgcagacgcttgaccatggtgttgatcatggtgttcgggtcgatgtcgaagccgtacttgcgcttggcgaagttggagaagtcgaccttgttggcctgcttgacggcggcgaacttcttgacgaactcgtcatcgtcggccagcgggatgaggcccttgagcagttcgaggtcgctcagccacttgtcggtgccgaggccttcggtgatgacgtcggacagacgcgggttggccagcttgatgaagcggcgaggggtcacgccgttggtcacgttggtgaacttgtccgggtagacgtcggagaagttcttcagggtgacgtccttgagcagctgggagtgcagctcggccacgccgttgacgtgggagccgccgtaggaggccaggaacgccatgcgcacggagtcgccggtgtagatggccatgtccttgatggtggcctcgtcaacgcccttggccttgagctcggcctcgaactggtcgttgatcttctcgatgatctcgaggtgacgcggcagcagttcgccgatgagcttggacggccacacttccagggcttccggaagcagggtgtggcaggtgtagttgaaggtcttgttggtgatcttccaagcggtgtcccaatcgtagccgtactcgtccatgaggacgcgcatgagctccggaatgccgatgaccgggtgggtgtcgttgagctggaaggtgatcttgtccgcgaaggtggtcagatccggcttgtcctggcccgggtagaagacgcggatggcgtcgtggatggaggcggacacgaagaagtactgctgctcgaggcgcagagccttgccctgcggggtggagtcttccggatacaggatcttggagatgttctcggcctcgacctgcggcttgacggcgtccagatactcggacttgttgaaggtgagcagatcgaactcgtcgtagctcttggcggtccacagacgcagggtgttcacacggccggaggcgtagcccggaaccatgtagtcgaccgggacggcgcgcacggaccaagccggcttccagaccttcttgccgttctcttcgacgacttcgccgccgaaggagaccttctggtcgcggttgtaatcgatgtggccccacggctcttcgttggccagccagtaatccggggtctcgatctgcttgccgttctcgtcgaattcctgcttgaagatgccgtacttgtactggatgccgtagccgaatgccggcacgccgagggaggcgagggagtcgatgaagcaggcggctagacggcccaggccaccgttgcccaggcccggctcgtattcggcgtcgatgacttcctgcgcatcgaagccgagagcttccacggccttgttgaactggtcggtcagtccggcgttgagcagcgcgttctcgagctgcttgcccatgaggaactcagcggacaggtagcccacggccttggtgttgccgttgaccatgtcggactgggtcttcatccaggaatccacgagatggcgacgcactgcggcggacgcggcaacgtacacgtcggccggcttggcctgctcgacggtgacgccctgggtgtacttcagctgctcacgaatctcgtcagcgaactgttccgcggtgaccgcggacttcggtgcggtaatttcagtcattgattgactccctttgacggatactctccaggaacattatgccttacttcagcgtccttgcatttgcggccgcatgaacactaagtaacatcatgcatacgttctcatgtacagcatactacgtaatcataaaaagacgaaattcctagcaatcgtaagcaggcattcgtttgcaaaaaacattgcaaaaactgcaaacgcaacgcatggcgcccattaagcgagggcaccacaatcgcaggaaaatcgcccctcaaacccctatttagttacgactacatcgtttgcaaagttccatcatagtcgtttgcgggctgcacaataccggtatggctgtcatacgagaacaagacttgggcaaaggacgcgccgccttcgaacagtggcaggacgcggcgcacaacattttcagcgagcagctgccggccgatgacgacgccgctttcgatttccggctcaacttctcgccgcgtctgccgcgccagctgtgggcgatggcggtgcgctactcgctatacctgctggaaaagaaggcgccgggcgaaggcgtggaggtgcgcgtggcaccgtggggcgccatcaagatcctcgacgggccggcgtccgatccgcacaatctcacgccgccggacgtcatcgaactggaccccgacgtgtggatgaggctcgccaccggcatcaccagctgggacgaggaaaaggacgccgggcgcatcaccgccgtcggcgaacgcgacgatctgagcgggttgctgccgctggcataggaataggtcgcggcgcggcgcgaccggcgatggttggcgggacgagcacgacaatcgcccgacaatcgaaatcgaaataataaaaaatggcccgcggtcgaaaccacgggccattcgttgaaaaaatctgtgcagtcagtcctgcttcttcggcttcagcgcgctgggcaccggcatcgggatgggcttgtgcggcttcgacgcggcctttgccgccggaaactcgccactcgtggccttcgccgcggcttccgcggcccacttggcgtattcgtcaaggtcatcggcggaatcggaagacgtttggccgtccccaacggtctcatcttcggcgtccacatcgtgagaatacttggcttcgatatcggcaaacgggtcgaaggaaccagaaccgggctcctgcgcaccgagctccttggcaagctcatcgtaatcggtgtcggtggtcaggtacttgagctttcgggctattttctgctgtttggctttctgacgtccgcggcccatctgaccccctgaaattactgtgctatcaattcatcaaacaagagagtaccacttattgcgcattatttcgttgtcggctcagacttttacgataaaatcgttgattttcttaagaaaaggacacgtatgacggacgaaacccaggagcagcagatcactgctgtcggcaatgaaatgagcgccagcttcctcgccgcaaagaagcgttcgaacgcgacgctggccaagctggaggagcatccggagaagttcaccatgctcaccggcgaccgtccgaccggccgtctgcacctcggccactacttcggctccatccgcgagcgcgtggccatgcagaaccgtggtgtgaactcgaacatcatcatcgccgactaccaggtgatcaccgaccgcgacaccacagagcacatcgaggacaatgtgctcaacctggtgctcgactacatggccgccggcatcgacccgaacaagaccatgatctttacccattccgccgttccggccgagaaccagctcatgctgccgttcctatccctggtcacggaggccgagctgcaccgcaacccgaccgtgaagtccgaaatggaggcttccggccatgcgctgaccggcctgctgctcacctacccggtgcatcaggcctgcgacatcctgttctgcaaggccaacgtggtgccgatcggcaaggacaacctgccgcacgtcgaaatcacccgcaccatcgcacgccgcttcaacgagcgctacgcgaagaagaacccggtgttcccggagccgagcgccatcctgtccgaagcgccggagattccgggtcttgacggccgcaagatgagcaagtcctacggcaactccatcatgctgggcgccaccgcggaggagaccgccaagctcatcaagaagagcccgaccgattccgagcgccgcatcaccttcgacccgattgcccgcccgcaggtctccgcgctactgaccaccgccggtctggtgaccggccgcgatccgaaggacatcgccgaggaaatcggcgactccggtgcaggcgcgctgaagaagtacgtgatcgaatccgtgaacgagttcctggccccgcaccgcgagcgccgcgccgaattggccaaggatatggattccatccgcgacatcctgcatgacggcaacaagcgcgcgaacgaaatcgccaatgagacgctgcagcaggtgcgcgacgccatgggcatgcgctactaagtttgcaatcggcatcctgacgcgttagcggattggccgtgttcctccgggagcacggccaatccgcttattcatggcagattcagaggctaccgttctgctaggtggcttatttgtggcatggaaaacgggaaaccccgtgtatgtccgtcggaattccaatggacatacacggggtttcctgaatcaggtgccacaaacaagccacttgacatttccctgttgtcggaatctgccataaacaagcgacacggcaccaaaggccgaccttcggcgttgcaggaggtgcaacacccaccgcggggcgattcagatctgcgagcgcttctcccctgcggcgatttctgcggccacaaggtcgtcgtccacgtgacggtcgtccggatcgtcgagatagtggtcgaattcgtgcagcacttccgcgcttggcgcaggcgtgagcagcgagaccaccacgatgaacagcagcgagacgatgaacgccggcagcagctcgtagatggcgaagatgccaccgagcggcttgacgaggttgtgccagatgagcacggtggccgtgccggacagcatgcccgcgatcgcgccgtacttgttggtgcgcctccagtacagcgaggtgagcatcagcggtccgaaggatgcgccgaggccggcccacgcgtacgagaccacttggaagatcgaggagttctggtcgaacgccaccacgatgccgaagatgaacatgacgagcagcgtgatgcgcgccaccatcatcacctggcggtcggtggccttgcggtgcagcagtccgcggaagatgttctcgccgacggccgaggcgccgatgatcatgtacgaggacgaggagctcatggacgcggcgaagatgccggacacgacgatgccgcacatgaagctcggcagcagcgcctgcgacaccacgatgaagatgttctccgcggccgcctgcgtggcgaactgcgtcggcatcatggcacggccgaccaggccgatgcacacgccgcacgccagcgagatcacgcaccacgtggtggcgatgatgcgggatttcttgatttcctcggaactgcggatggacaggaaccgcacgagcacctgcggcatgccgaagtagcccaggccccacgcgagcatggagatgatggtgatgatgccgtagtcggcgggcgcgccgaacatggcctgtccggccttgacgatctgctcgccggcgtcgttgaggatcggcgtggccacatgcgtgccgtcgaggaatcccggaatgcccttgaggaaggcgacggtgttgtcgatgccgccggcggacgccacggagccgatgaacaccacggccagtgcgaagaacatgagcaggccctggatgaagtcggtcacgaccacggacagatagccgccgatgatggtgtacgcgaacacgatggcggcgccgatcaccatggtcaggtggtagtcccagccgaacagcgtggagaagagtttgccgacggtcacgaagcagctgccgacgtacacgcagaagaatacgaggatgatgagcgcagcgatggtggatacgatattgcgatcgtcatggaagcgcttggagaagaagtccggaatggtgatcgcgtcgccggccaccacggagtagcggcgcagacggcgtgcgacgagtttccagttgaggtacgtgccgagcgccagaccgatggccgtccacatcgggtcggccgcgccggtgaagtaggcgacgcccggcaggcccataagcagccagccgctcatgtcggaggcttccgcgctcaatgccgtcagccacggtccgacgccacgcccacccgcgaaatactgtttggtggaggaattggacctcttggagtagatgaagccgatggtcagcatggccgcgaagtacaagaccatggccagcagcacccagaaatctttggttaccaagtgtttttacccttctgcaggttattaaatgtcgtagcgccaggatttatcggtcactactcgtgccatcgccaggccgattggcaggcagatgatcaccatgaacgcacggaacgcccaatcgagcgcgttcagcgtatcgaactggccgaggtggaacatggcctggtacatatacaaaccgggcaccatgatcacaatagacggaaccgtcaggcaaatgcgcggatatcccaaatgcggagcaagcaggccgtgacgcaccgccgaacgccatgcggaggcgagcaggccggcaaggaacgcgccgatgaacgcgccggcttccgcgggcacgcccaagtcgacgatttccaatcgcaaagtatcggtgatggcgccgatggtggcggcgacgaggcacatgcgctgcggggaattgaacatcacggagaagccccacacaccgatgaacgcgaacagcatgcgcagcaggcagttgatgacggggttcagtccgagcggctcgaatccctgcggattcaggtgcacgatcgaagcgaccatccagcctgccaacgtggccatcagaatgatgcacagcacgtaggtgagtcgttgcacgcctgatgggaagtcgattttcgccatgtcaagtccgccggttatcagcgggaatccggggatgacgaacagcatcgcgccgatatacgcggtgtcgtgctgcaaggcgatcggatcgaacaggccgatcagtcgcagcatgccggtgcatgccagcgcggcgacggccacgcagacgaacgtcacgaagaattggttgagatggtgggcgaacaggcggcgacgcagccagtggccgaggccggcgccgacgaacgcgccgatcatgtcgtacgggccgccgccgagcaggaacacgaaggatgcacaggcgcaggcggacgcgagtcccgcgaaggccggcgaatacagcggtttgcgacgttcgatcatgtcgagtcgctcgtgcgcctgccgtacggtgacgccttgcgattcgcccgcggctttcccgatatggtcgaaatgctcggcatattccttcggcggtttgcagttgcggttcttacgcggcttttccgcgaccgaatcgccattgctacgtccggccgcggccgccgcctcgatatcgcgcatgtgcagcggacgtgcggtggaatcgccttcctgcgcgcgttccgtgaccatttccagcgcgtcgagcacgggatcgtcggaaccttcctggttctgctcggccttctgccgttccttgagctgcttggacagttcggccgacacctgcgaggcgtcgcgcttgtcgagatgctgcatcagcccttcggaaacgtcggattggctgtggtacatagagcctttgccgaggttgacgttgaaccagtcggcgaagtgctcgagcagccagatgcgttcggtgttgacgccggtggtcggcaggtcgacgacttcggtgatgcggtccttgccgtccgtgcaggaggcctcgatgtcggtgaggttcacgtcggcgcgcacgtgcacgcccaatggataggcgatgcggtgcatcatttcacgtacgcggaagctgcctgttccggcgccgaggtcaagcatgccgacgcggacgatcacgctggctttcgccgcgatgccggcttcggttaccggcttgtcccaatcgcgttcgatgtcttccatatcgagcggaatggagtgggtgtggaatttgctgaccgccttcgcgctgctgtcaacgcgttcggtgttctcatcatgttcatgtagtgcgctcacactattcaggtctaacgtgtgggctggtcggatattttccgaacattcccacatgcccattttccggacattcaatgtccacgatgcgaaccattccggcgtttccgtaaccaaactgtcgatttgccgcgcctacaatggtcgagcatttacccaccaagcttagggctgtgggctcgcaacagacggccaaaacaatcgcggaggtgccgcgaaggaccgacagaccgagcaacccgatggtttggagaaggaggtctgatgacaactgaaaacgaacagatcacgcctgcggacgcggctatcgtctcgtccggcaccggcaccaagggccctgaggagcgtgatcttcccgcatccctcaaagaggaaatggatctgtgtctgcagattcttcgcgaggtgctcggtgagttcgatgaaaacctgctggccaagttcgatgaggtgcgcgagcacgcgctgaaggccagtgacgaacgtttctccggcattctttcggatacgaatcccgaccaggacgacctgcagaaggtggtcgacatcgtcgacaagatggatgtccacgacgcccagctgctggctcgcgccttcaccacttacttccatctggccaatctgtgcgaggagaactaccgtgtctccgtgctgcacagccgtgaggccgccgttgacgacacccaggccgtcgatccggtgaacgaaatgacctgcgcctaccaccagctcatcaacgagatgggtccggccagggccaaggagctgctcgaccagctcgagttccatcctgtgttcaccgcgcatccgaccgaagcccgccgtaaggccgtggaaggcaagatccgccgcatctcccagctgctcgaagcgcataagctgctcggcggctcggacaagaaggaaaactcccgtcgactcttcaacgagatcgacgcgctgttccgcacctccccgatcgcgctgaagaagccgactccggtcgaggaagccgacaccattcttgatatcttcgacaacacgctgttctacaccattccgcaggtctaccgtcgtttcgacgactgggtcctcggagacaaggccggcctcgtgccgccggtgtgcccggcgttcttccatccgggaagctggatcggttccgaccgtgacggcaacccgaacgtcaccgccaaggtgagccgtcaggtggcccgcaagttcagcgaccacgtgctgggcgcgctggagatcgaaacccgccgcgtcggcaagaacctgacgatggaggccgagaccaccccgccgagcgccgagctcaagtccctgtggaaccaccagaaggaaatgagcgagcgtctgaccgacaaggccgcgctgatctccaccaaggagctgcaccgcgccgtcatactggtcatggcagaccgtctgaaggccaccatcgaccgcgacgccgacctcatgtaccactcctgcgaggactacatcgccgatctgaagaccgtgcagcgctccctcgccgaagccaacgccaagcgttccgcctacggcccgctgcaggacctcatctggcaggccgagaccttcggcttccacatggtcgagatggagttccgtcagcattccgtcgtgcattcccgcgctctggaggacatccgcgagcatggcctgcacggtgagcgtggcgagctgcagccgatgacccacgaggtgctcgacaccttccgcgcgctcggttccatccagaagcgcaatggcatcaaggccgcccgccgttacatcatctccttcaccaagagcgcccagaacatcaaggacgtgtacgaactgaaccgtctggcgttctcccaccccgaggatgttccgaccatcgacgtgattccgctgttcgagcagcttgaggatctgcagaactcggtggacgtgcttgaggaaatgatcaagatcccggaggtccaggctcgtctgaaggccaccggcggcaagatggaagtcatgctcggctactccgactcctcgaaggacgccggcccgacctccgccacccttgccctgcactccgcgcaggagcgcatcgccaagtgggccgaatcgcacgacatcgacctgaccctgttccatggccgcggcggcgccgtcggtcgtggcggcggcccggccaaccgcgccgtgctcgcacagccggtcggctccgtgaagtgccgtttcaagctcaccgagcagggcgaggtcatcttcgcccgctacggcaacccggtgcttgcaatccgccacgtggagtccgtcgcagccgcaacgctgctgcagtccgctccgagcgtggagaagcgcaacacggacatgaccaagaagtacgccgacatggccagcaagctcgacgaggccgcgcacaaccgcttcctcgacctgctgaacaccgacggcttcgcaccgtggttctccaccgtcacgccgctgaccgaaatcggcctgctgccgatcggctcccgtccggcgaagcgtggtctgggcgccaagtccctcgacgacctgcgcaccattccgtggatcttctcctgggcccaggcccgcatcaacctggccgcatggtacggcctcggcaccgcgtgcgagcagttcggcgacctgaacaccttgcgtcaggcgtacgaggagtggccgctgttctccacgttcatcgacaacatcgaaatgtcgctggccaagaccgacgagcgcatcgccaagatgtacctcgccctcggcgaccgtgaggacctcaacaagaaggtcctcgacgagatggagctcacccgcaagtgggtgctcaagatcgtcggcgacgaatggccactgcagcaccgccacgtgctcggccaggccatccgcatccgctcgccgtacgtggatgcgctgtccgtcacccaggtgctcgccctcggctcgctgcgcaagcgcgtggacaaggaagagctcacgcacggccagaaggagaactacacctatctgatcctgtgcaccgtttcgggcgtcgccgcaggcctgcagaacacgggctgatcttcggatgaccgattgatacgagcggggaggttccgtgccgataagaggcgcggacctccccgctcgcgtcgcgcggccctagcctggccggcgacagcgcacaaaacaggcacgcaggccgagcgacagactcccaatcatccgacgtaacccggcgcctatccgcgtttacccacgccgcgacacgacagccatcgtgggcttatacaactggttcggtcagacttatattctcggcagattgagcctagtccacatttctctatttcttcctcgtcctgcttataaccccaatgacaacccttttggttacggctttccttcatgacaaactgtcttggaagaagattgttcgcatcatagcgctgtcttactgtttgaccatattgggtgtatttctgaacgagttgtgttgttgacggaagacgccgcactcgaaggtttttgttcagcgcctaacatgcagcactagcatacttatcctcaatccactcatgattcagtaacaactgcatgactcctgaaacacagacacatagcgaagccctcgtttgtaacttccacgagagagaacctttgctattttcactagaaaatcacaccctaaagtgcatccctactcattttccattagaatactcttaatatcttaatcattgtcgattgagattaaattttcacatggaggaaattatgaaatccagaagagttttttattctccacaattatctcagtttgcctatgcacagttatgaccactccagcctttgctgtaaattggtggcaggttggatggattgtcgccaataacgtcatcgaccgggtagtcaatctcgatgggcaaagttcaaatgatcaatattccacctatatggtttcaccttccattgttttcaacaatggcaccaatgggggcgaattctatatgcgccctcaagtctccagccgtgtgaccagtttcgaaatgcacgcgcatagagctaaccccgtcgattttggagccaatatagttctagccttgtccacaacctcaggcaaaagggttatcaataaaacagtagggacaaaccagaaggagaacagtgcagtacatatatctcacagcacttgccctgctaggattatgtatgcttatttttccaaggcaactctggaaaataagcaatttcctctggactcaaaaaggagatccgagcaatctatacacatccttaatgagaataagcggtgccgcctttcttgttttagctcttattcttttcatcttctgcagactgcagtaacacctacctgatcctgtgcaccgtgtcgggtgtcgcagcaggcctgcagaacaccggctgatcttcggctgaccgaccgctcgatgaacggggaggcctacgccgttgacagcgcgggcctccccgctcgcgttatccggcgttttgtcctattcttatggaatcaaacataagattgaaataacttagaaggggaactacagcattacactgaaccttttcttatactgtttccaatctggccgggttcgtcaaggaggccgtcaatggggaaaatatggtgtcgcagagcagcgtcatatattcttcgcataatattgccaacttcattgctatcacaattaataaacagcgttttatatgggagatcttccatagatggaaccatgggaatctggattaactgcgtctccataatcatagtttgcgtgatttctgcctgttctacgcgcaacggacaagcttggtcgcatcattttctaggactgcaggtagtcgatcaatattccaacctgcccatatcgggagtaaggatgggtttacgcgagatagctcactgcgttgatttcgtgccatgtttcattgggtttctttggcctttatgggacaccaaaggacaaaccttcgccgacaaaattatgagaacaacgataatcagtatagaatagatagaattaaagtgacgcaaagacgcatcactggataaaaaatactttcgaagccaaaggagactacgaatgaaccttcataaaaaaatcgcgttcaccacagtactggtggcaatactggcgttctctggtaccccatcagcaatggctagcacttctggacatgaccgaagcgccttcaattcttctgcagaagtcgctctgcaagaaaaactctctaacattgcttccacgaataacttagacgtcgaattcggcgaatttaaaatcgatgctcctcaaagtacgattgatgaataccacggtgatgccaatctatacgctgaatctattgcgaaagcatacgaagaagatacagcctctaataccagagaaaccaaaaacgcaagcacacgcggtacggcaacatatacctcaagcgtcttttctggagtcccagcaggaggagcttgttgggtaaagcaagattttcgagctacagtaacgaattacaaagttacctcaaaatccttgcttggaagctcataccagaccggggtctgtgttttccaatggtctccaaattattcctggtttgaaggaaatctgaatgttcttagcaaaggaacttttcatgcggttgtcaaaggaggtcccgtctctttcgccgcaactttcaaagcattttttcataccaataaaacatcgttgtatcaagaatttcaatgaataacagcaaatattgcagttacatgaagtgcaatgatcatcgctgaatccatatggcaacgcccaaatcaggcgccgggtgtcgcagcaggcctgcagaacacgggctgattttcggctgaccgcctggatgatacgagcggggaggttccgtgccgataaacggcgcgggcctccccgctcgcgttcccggattcaacttgtaagcgcaacgccttcttaaattagaaactgaacacttccaaacctagacaaggcgttgcacgtctatttagaacccggggcagtcgctcggttggatgagtccggcacgataccgtcagagccaaggaatagctgcgtgattatctccaagaaaacgtccgcagcccctgccttagatggcgattcaatcgaaacaacttcagaaacaccgtttatgatgaaccatagcctgtgatgaaatgacaaagaggtggaatcaatgacggacgaaccatttgtgaaccagaacgacgtggaaggcaccgcaagcggcgtgtggagccgtatgctggccggtaaccgtagattcgcggaaggcaagctggagcatccgaaccgcagcgtggaagcgcgcgaggcgactatcgacacgcatgagccggatgcggcggtattgagctgctctgatgcgcgtgtcagccccgatattattttcgacgcaggcatcggcgatctgttcaccgtgcgcacggcagggcaggtcatagacgatgctgtgatcgcctctttggaatacgcggtggacgtgctcggcgtgcggcttttagtggtgctcggccatcagaattgcggtgcgatcaagcaggcgagcaaggaatacgaggcgctgctgcacgagctgaccgccgacgcggaggattcgctgatggccgccgacagcatcgccgacatcgacgaacgcattatgaacgcggaatcgctgatgctgcgcacggtcggtttttcgatttggcaggcgcacgaatcggaactggaatcggcggaggatttcgagcgcgtgcacatcgcacgcaccatcgaacagctggtggaacgttccgaagtgatccagcacgcgctggccgaggatcggctgatgatcacgggcgcacgctaccagctcgacaccggcaaggtggaagtgctgagcttctgacgattttccggaaaaagacggcttccggatccgttgcgtcgcgctgttttgacatgccgttgctttagattggaatcatgtcgcttggtttgaacatccttctgattttcattttcctgctgctcggttccgtgttcgccggcaccgaactggcgctggtcagcctgcgcggatcgcagatcgaccagatggaacaggaggatgcgcgcggcaagcgtgtggcgcagatcgcacgcgacccgaacacgttcctgtccaccgtgcagatcggcgtgacgctgtgcggcttcctgtccgcgtcgttcggcgaatcctcaatcgccccgtatatcgtgccggtcatcgaagactggggtgtgccgcataacgtcgccgctcccctgaccaccatcgcgttgacgctgatcatctcgtattgctcgatcgtcatttccgaactggtgccgaagcgtatcgccatgcaacgcaacgagcagatcgcgcgtgccgtggtgccggccatccatatgttcgccaaagtgtgcaagccgatcatctggctgatcggcaagaacacgaacggcatcgtgcggctgctcggcttcgatccgaacgaaaccgacagcgaggtgtccgacgacgagctgcgcgtgctcgtcaacaccaacaccaacctcagcaaggacgagcgcaccatcctcgacgacgtgttcgacgcatccgaaaccatcgtggcggaggtcatgcgtccgcgtgccgacgtcgcgttcctggacggctccatgccgattgcggaagccgccgcgtacgtgcgtgaaatgccgtattcgcgttaccccgtcaccggcaaggatttcgatgacgtgctcggcttcgtgcacgtgcgcgacctgcttgacatccgcgatccgaaggcgagaaccgttgccgacgtgacgcgtgagggcatttccctgccgggcacgtcgaagctgctgccaagccttgagctgctgcgcaaacgaggcattcacctggccgtggtaatcgacgaatacggcggcaccgacggcatcgtcacgttggaagacatgaccgaggaattggtcggcgacatccgcgacgaatacgacctgccggaggaaaagggcggtgaacgcacagaacgcgccgctttcgtcaatggcgtggccaccatcgaaggtggcatgacgatcgaggatttcgcggatttgaccggcatcgagctggaagacggcccatacgagacggttgccggctatttcctggcgcacaccggcaaaatgggcgaggtcggcgacgtgctgtcatccgatgacggttatgacatggtcgtcaccgaagtggacggccgtcgtatcgaaacgctggaagtgcgccggcacaccgccgatgaggacggttccgcggctggcgattccgcggcggacgccaagtaacccaagcggcctcttacagcaccacctgccggttgatgtcgcggcgcaactgcctccattgcggcagataggcgctcatacgcctttgaaagccctctccgtggccgttctcccacaggtgggtcatctcatgcaccagcacgtattcgaggaatctaggggccattaaaccaagctgtaggttaagtcggatacgtccggtcttcggcgtgcacgatccccaacgcgaactcatcagacgcaacgtgatatgcgtcggcgtacggccaacgatcgggccccatttggcaagcaacacaggcaattgcgattcgatgttgcgttgcgcccgcgccttggcctcgtccgtccatacgaaagcgggcgggttggcggaagcgccagtatcgccaatattgccgttttgcgcacgctgcgcgttgagttgcgcgtctctggcctgccgcatgctgcgttgcgcccgttcgatccacggcttgcgttccgttacaaaccgttcgatagcgctttgcgacattcgttgcggcgcggagatgacgatatccgcgttcggcggtttgatgcgcaggtacatgtttttgatgggtttgcgcacgatggccacccgcatgccggcgatgctcgccgtcgtttcggaaatcacgcgattgcggttgcgatgccccactcccctgccgtaacggccgttaccgccgttgcgctgcccgtatgtcatgcctgcattatgccacgacacgccgatgacacggcggcacttgactttccctgtgattcaagtatcatttcaattcgttgtgttcaagacacagcaagttgggcccgtagctcaggtggttagagcgcatccctgataaggatgaggtcggaggttcaagtcctcccgggcccacgtagatggtaaggaagcggcacagccgcttttttcacctatggggctatagcgcagctggtagcgcatctgctttgcaagcagagggtcgccggttcgaacccggctagctccacggggctatggcgcagctggtagcgcatctccatggcatggagagggtcaggggtttccttcagtctgtattccttcagtctgtattccttcagtctgtattccttcagtcctaaccttcggcttctggctcgcttttccgcattttgttaccgtaacctccatgtccgggtaacaaaacatggatgcgtatgctgttccatggttttgcgatcgatttgtgattattcgaccgtgcgactagagtagcctgtggcttttcggctggcttttacaccggctggaagatttatacagacttgatttgtgtctgccgtgtgcctgcgacgtatttacgtcgtgccggcacgtgcgcggaagcagatcgcaagcgaatggttctcagtaccatccatgtgagtcaagcacacatctttgagaagcagtcgcgatgccgggagtcgggttcgtcggtttcaaccgtcgttcccgttcccggcttttttatcttcgaaggggaatgaacggtaacgctgctgtttaaagcgatgcttcacggtatgaaaaaccacttaaccattgaacagatgttgcattccgcggagcgactttttgtttcgaaagtatggcgactgttacataggagttggctagggtgatttataatcagttttggttcttgccgcaagtcgatgaagtcaatgaggacgaagggcagcgtgcggtacgtgacacacaggatacggtagaggttctgctgctgcgcaaatgcgatgatgggattcatttgcttccttgggtgggggatgagcatgctgatgtggagaaggggtctatcgtcccgacgactgtcattcctgatgatacggtagcaaaaatcgcagtgcagtgcgcggtgagattgccaatgggactgtgcatgccggatagggtcgatgcgctgattgcttcattggaggaagcatgcgctgacgatgtggcttgttggcaggactcgccatggcttgcgggaaaactcgcattgttcctgcacggggatgcagatggtttcgtgtccgatgaattatgcggttatgaaataaggtattcgcgtgataccggattgacatattccagaaaagaggataattgaaatgtcctcatttcgggatgatcccatgaaaatatcgggatgcatagtgttccccgctgatgcggggatgagttcggcagttttctgataacgaaatttgctgaactgtaacctcattttttatacattcgaatatattcaactaagaaatgagggaaatcattatgttcatggacattcattgcattcagcaggttccgccgagcaacatcaaccgagatgataccggtagtccgaagaccgcatatgtcggaggcgcgttaaggtcgcgagtctccagccaagcttggaaacgtgctatgcgcggcgtcttcggagatatgttggatagtagtaagttaggcaagcgcaccaaaggtgttgtgacgttgattgctgattccattacgtcgaagcgtcctgatttggcggagtccgccgaggggctggcacagaaggtgatggctgcggcaggtttcaaagtcaaggcttcggatcgtgcgggcgcagataagggctctctggcgaccgactatctgattttcatcgcaaacaatgagatcgataagcttgctgatttggcgattgctgcttttgatgagggtgaggacgtttccaagatgaagaaggaagtttctgcgatcttccatggtccccaagctgtcgatatcgctctgtttggacgcatgttggctgatgctccggatttgaatactgatgcttcggcgcaggttgcccatgccttctctatcgatcagattacgccagaatatgactatttcacggcggtcgatgattgtgcatcggaagacaatgccggtgctgccatgattgacaccgtcggattcaactcctcgacgttgtaccgatatgcaacggtgaacattgatgtgttgcgcgatcagttgcaggacgattccgctacggtggaaggcgtggttgcttttgtcgaggctttcgtcaaatccatgccgtccggcaagcagaacacgtttgcaaaccataccctgcctgaggatgtcgtggtgacgcttcgggaatctcagccaattagcgccgccgacgcatttgaagatccagtgaggcgtaaggacggtatctccgtttcccgtcaaggtgtggagcgtttgggagagcgtctgaacgatatccgcgtgaattatggcgaagagccggtgaaagcttggtatgttgcaactggtggggcggtgtcctctttgaatgaatggtgtgagcaggtttcattgccggacctcgagcagagcttgaaggaaacgctgaacgccgcatattccgcatgatattcggaaggagaatgttatgagcgttctattattgcaattggctgggccattgcagtcatggggggattcctcgcgcttcgttcgccgtgagactcgtaatgagccgaccaaaagtggcgtgattggcatgttggcctcagcccaggggcgtaaccgagaagattccatagaggatttgttgggattgtcgtttggcgtgcgtatcgagcaacgcggcagaataattcgagatctgcagacggagaaatccatgacacggaaacgaaattccaatcgattcgacaaggagatgccgctgacctaccgatattacctatcagatgcgcgttttctggtggcactaggtgcgaaacgagaattgttggaaaccctagaccaggcgattcatacgcctaaatggccactgtttctgggaagacgatcatgtcctcctgactatccgttatcgctgggtatccacgatgagtatgcggatgttcgtcaggcattagactctgaaccttggcatgctgcaaaatggtatcgccgacgttatcggcagcccgatttggagattgtatgtgatgcaatggaaggggaggacacatccgtgcaatccgaccttccactgagctttagctcgaccggccgcaaatatgcggatcgcgttgtttatcggtaccgtatccccaatccggacgcatctgaaaatgtcggtgacaatacagagaaaccaccttccttcgattctacgggggaagctgatcctatgagtttcatctagaggggacgacgatgtttatctcgagaattcctttaaataaagtgcgatatggcgctcgtcaacttatcggttctccatataagctgcatgccgcagtggaagctgcttttcctcctgatgccgttcgcagaacggatgatggacgaattctgtggcgattggactctttagggcaagacggtggcgtctggttgtatgtggtaagccctcaaaagccggattttacacatatcgttgagcaggcggggtggcccatgcatgcagagtgggaaaccaagaactacgatgcattgcttgaccgtgtcaccaaaggccagcagtggcatttcaaacttcgtgcgaatccggctcgaaaggcgggtgtagacaagggacgtcgtcatcgttcggatggcattgtgggtaaagtgcaaggtcatgtcacagccagccaacaactgcagtggctggttgatcgttccgtggttcacggcttcagaattcttgaagacgaatatgggcagcccaatgtggtggtcaaagagcggcataaggaacagttcaagcgtggtggcgcgacggttaccttggtcacagctgttttcgaaggacgtctggaagtgatcgacacgaaactgttccgtgacgctttgtgcgaagggattggaagggcgaaaggttttggatgcggattgctgaccatcgcgccggaaacaaggagtaatgctgaatgaatgatgagctgggggaggacggcgccgattttgagatggctccttctgaaatgtcttcggaagaagctgcgaggaaaacgtcagacgcgaaaatctcggaaaggcgccgttccactcttggcacgcctccaccggaaattcaggatcttgttcgggtggaggataggctgtcctttgcgtatttcgagcattgcactattggacgtgatgataatgcgattacggtgactgatgtcactggtgttatacatgtgccggcagcggcgttaagcgtgctgatgcttggtcctggggctcgggtgactcatcaggcaatgaccgtcatcggtgaaaatggcgcgacggtaatttgggtgggggaacgaggcgttcgtatgtatgcttttggcaagccgttgacgcattcatctgcgttattgcagaaacaagctgaattggtctctaacacgcgtaaaagattatctgttgctcgcatgatgtatcagatgcgattcccgggtgaggatgtgagcggattgacgatgcagcagttacgaggtcgggaaggtgctcgtatcagacgagtttatcgtgaatgttccgaacggaccggtgtggaatgggataagcggacatatgaccatgatgatttcgatgctggttccgagattaacaaagcattgtccgctgccaacacgtgtctgtacggtttggcacatgctgcgattgttgctttgggatgttctccaggtttgggttttgtacatgtcggacatgagcgttcttttgtgtacgacattgctgatttgtacaaggctgaactatcgattccggttgcgttcgaaacggtggctgcaaaacctgaagatatcggttccgctgtacggcacaatattcgagatgcgatttatgaccttagcttgatgaagcggatgatgaaagacattagatacttgttggggacttcagaactcgaggatgatgtttttgaatcagatcatgttgggctttgggatgataagcagggcgaggtttctgcaggcaagtcctactcggataatgacgaatgggatggtgggacatggtagtgattgtgctgactgcttgtcctgtgggattgcggggtgatctcactcgttggttgcttgagatagccccaggagtttttgtgggacatatcgatgctcgaattcgagataggttatgggagagaatcattgatttgctcagggatggtcgtgccgtaatggtttattcggacagaaatgagcagcatatggcttttaaggtgtatggggctgactggtcaccggtcgattgcgatggattgcaattgatcaaacgtcctaaggaagcaaaagaaggatcctttgttggcactcctagaaaaggatggagtaatgcgagcaaataccgaaaggcaaggaaattttcaaaacgaaactgaatgaaaaacagccagttgtcctttcttttccttggaattatgctattttcgaagtgtgctccccgcacatgcggggatgatcccacgctcacccttgaaactaagattgagccggggtgctccccgcacatgcggggatgatcccgggcacggcttctgctcactgccagcgtcaaggtgctccccgcacatgcggggatgatcccaaggctagcgaactgtggccgctgtatcgtaagtgctccccgcacatgcggggatgatccccatttgcaagattctttgtcatgccccgaaaagtgctccccgcacatgcggggatgatcccggctatatcgacttaatcgacacccggataaagtgctccccgcacatgcggggatgatcccggaatggcatctccgtagaggagaatcttttcgtgctccccgcacatgcggggatgatcccgttaggaaaaaaagcgcattaaaaccactcctgtgctccccgcacatgcggggatgatcctcagtccagggacggcggcgaagccgcacttgagtgctccccgcacatgcggggatgatcccattgggtcggattccgggttgtcggggtcgacgtgctccccgcacatgcggggatgatccctggcacgccacgcctatgccgacaatgcttctgtgctccccgcacatgcggggatgatcctagcgacacgcaaatgcaagcgattatgttacggtgctccccgcacatgcggggatgatccctcggtaagtggaagatcgccgccaaatatgaagtgctccccgcacatgcggggatgatcccaagaactatgccacgggggagaagcaggccacgtgctccccgcacatgcggggatgatcccgctttcacgtcgtggcagccgacggtcgagatgtgctccccgcacatgcggggatgatcccacgcgcatcagtgcgacttcctcgcagttgaagtgctccccgcacatgcggggatgatccccgacgaggaacttgcccaggaaacatacactggtgctccccgcacatgcggggatgatccctgttgaatcgggcgtatccgtgcgaggagtggcgtgctccccgcacatgcggggatgatccctgttgccggtggctgtgtcgataaggtcaagcgtgctccccgcacatgcggggatgatcccacggtgcactcaccaatagcaagttccttggtgtgctccccgcacatgcggggatgatcccgccgactatgtgctcggcccggactaccggttgtgctccccgcacatgcggggatgatccctgcggcaggctggactggatccatgtctcggcgtgctccccgcacatgcggggatgatcccacttcccgagggattttcatctcgttagcgcatctccatggcatggagagggtcaggggttcgaatccccttagctccacgattggaaggcttccggagagattcggaagcctttttctttaccgtttcccgtcggcttccgggcaatccgctgatcggatgcgaaaaccaagaaagcgagaaccatgatcgacgaagtactgttcctgcgccacggacgcaccgcatacaatctcgccagacggctgcaaggacaaatcgacattcccctcgacatcgtcggacggtggcaggcggaccaaagcgcgtacgaactcgccaaaacctactattgggcgaaagtcgcgcatctcgccgaacataacgaccagctcgcgcaacccacgtatgaaggcgcgcatctcgcagacatcagcgaaatcaacaacgcgcccgccgcggcccgccgcatgctcgtcgtctcatcggatctgttccgcgcgcagcagaccgcgcacgccttcgccgacctcatggggctggacgtggaactcgacccgcgtctgcgcgaacgcagcttcggcgaatgggagggcatgacccgcgaggagatctgcgagcattacgccgacgactaccattcctggcgagcccacacgggaggcgaaaccaagcatggcgtggaaagccgcatccatacgggccgacgcggcgcggaagccgtgcgcgacatcgtcgccaaacaccatgacgagacaatgcctaccacattgcttctcgtcggccacggctcatggatcgtggccaccgtggcggtgctgctcgacatggaccccgacgatctcaacaacgtcggcgcgatgcgcaacgccttctggacgcgcatgaccccgcacaccgaccccaggaacgcggaccgtcccacttggaagcttgaggaattcaaccaaggccccgccatcgcatcattcgccgactgggagaacggtcccgaatcgttgcgcgcgcccggcatgccgctgtggaagccgatcatccaataagcatccaatacacggcgccgaaaacatcatccaaagtgaactcttgatgaaatcaccgccgtccgtacggcaaattctcacggtgggactatccttaatgaggttgtttgcccgaccatgcggcgagccgggaatccggcgatcgttccgcatgcggatcgggcttccgtacagcgatagaacgttggaaagcgcgaaaggcgggtgagagacatgttgagaatgttcagaacgattaacggccaggtggagcaaatccaaaaaccggagaacggctcctggttatgtctctcggcgcccaccgacgtggagctcgccaacgtgtccatggaaaccggcatcgacctggccgacctgcgcgccccgctggatgacgaggaacgctcgcgcgtcgacgtcgaggacgactacacgatgatcatcgtggacattcctaccgtggaggaacgcggcggccgcgactggtacgagaccatcccgttgtcgatcatcatcacccagtccgccatcatcaccgtctgcatgcaggacacgcccgtgctgcacccgttcatggaaggcaccatccgcggcttcaacacatacatgaagacccggttcatcctgcagatcctgtaccgcaacgccaccatgtacctgcgttacctgcgcatcatcgaccgcgaaagcgacaagctcgaactgaagctgcgccactccatgcaaaaccgagagatcctcatgctgctggaactgagcaagacattggtctacttcaccacatctctcaaatcgaacgaaatcgtcatggagaagctaaccacgctgccgcggctcaagcagtatccggaggacgaggacctgctcgacgacgtcatcacggaaaacaagcaggcaatcgagatggccaacatctacagcggcgttctcgccaacatgaccgacgcgttcgcatcgatagtgtcgaacaacctgaacaacgtgatgcgcatcttcaccatcatctccatcaccctgtcgattccgaccctgatcttctccatgtacggcatgaacttccaggaaggcatgctcggcatgcccctcacggacaagccatggggcttcgcggtgatcatcggcatctcactggtcctttcggcgatcgtcacctggttcctcacccggtcgcgcatgttcaagtgacgtccatgatgggaaaagcgcgatacgtggccgcggcggcatgcgcggcattacttgcggccggcgccggcgcgtgcggcacatcggtttccgtggtgaccgaaggcgcggcgcaggggccgacgatcgcgataggagtggccgccgaccagccggggctcggatacctgcatggaggcgaatactccggttttgacatcgacgtggccaaatacgtggcgaaaaccctcggatacgcggaaaagcagatcgtgttcaaacagctgtccccggccatgcgagcctccgcgctcaccgacggcacggtggacatggtcgtggattccttctccatggacgggacccacgatggtgaggccgacgtcgccggaccatatctgacggtccgggaggcgctgctcatccgctccgacagcgcatccgaaatcaccggaaccgacagcctgtccgataaaaccgtatgcgcggtcgctggaagcgcggcggccgacaacatccgcaaccgcacgaaaaacatccgcacgacggtggcggaacgcgacacgtatccgcaatgcatgacggcgctgatgatcggcgaggccgacgccgtcgccgccgacgacgcgatcgcggccggattggcgtcgaacaacacaggcgaccatctgaagatcgtcgacgttcccgacaccacctggtcctacggcatcgccgtcaaatcaggacaggacgagctggtcgggcaaatcgacgccgcattgcgcgccatggtcaaggacggctcgtggcagaaggccgcggccgacatgggcaagtcgatcggatacacgcccgacgcgtccatgaatccgccgaaggcaacggccaaggccccgtcctccggcgcgtccgcggcatcggaaaaataacggcggcgcacgtgcctgaatagtggttgattccttgcgaagtgtccagttgcgcggctaatttcatgcattatgagtgacactgagaaaagcgcgcaggcgcaaccgaacgaatccgccgaaccgtcgttccgctacaacgcgaagctggcgcagggcatcgaagagaaatggcagaagatctgggatgacgaaggcaccttctgggccgccaacgtcaacggcgacctgaaggacggcaagggccataacgccgaaggccgcccgtcctatttcgcgatggacatgttcccgtacccgtccggcaagggcctgcacgtcggccacccgctgggctacctcgccaccgacgtggtcagccgctaccaccgcatgaagggcgagaacgtgctgcacgccatgggctacgacgccttcggcctgccggccgagcagtatgccgtgcagaccggccagcatccgcgcattaccaccgaacagaacatcgccaacatgcgccgccagctgcaccgcatgggcctgagcttcgacaaccgtcgttccttcgccaccatcgaccccggctacgtgcgttggacccagtggatcttctcccgcatctacgacgcctggtacgacgaggacgccaccaacccgtccggctccaggggctgcgcccgtccgatcagcacgctcgtcgaacagttcgaatccggcaagcgcgccatcccgggcttcgaaggcaaggcctgggccgacctgagcgaagccgagcaggccgacgtgctcaacgactttcgtctggcctacatctccaagtccccggtcaactggtgcccgggcctgggtaccgtgctcgccaacgaggaggtcaccgccgaaggcaagtccgaacgcggcaacttcccggtgttccagcgcgaactgcgccagtggtccatgcgcatcaccgcatacggccaccgtctgatcgaagacctcgacaccatcgactggcctgagaaggtcaagctcatgcagcgcaactggatcggcgaatcccacggcgcttccgtgcatttcgacgtcgagaccccgaacggcgtcaaggacatggagatctacaccacccgtcccgacaccctcttcggcaccaccttcgcagtcgtctccccggaacaccacctgcttgagaacgttccggaagaatggccggcggaaacccccgaggattggaagggcggctacgccaccccggtcgaggccgtgaaggcgtaccgtctggccgccgaagccaagaccgccaaggaccgcgtggacgaggcgggcgagaagaccggcctgttcaccggcctgtacgccatcaacccgatcaccggcgctaagctgccgctgttcaccgccgactatgtgctcatggactacggcaccggcgcgatcatggcagtgccgggcggcgatcagcgcgattacgatttcgccgtcaagttcggcctgccggtcatctacaccgtcaagccgctgccggaatccggcgacgacctcgccaactatgagggcaaggtgccgttcgtctcccatgacggcatcgtcatcaactcctccatcgacgcgaccaaggccaagggcgattccctaagcctcgacggcctgcgcgtggacgaggccatcgacaaggtcaacgcctggctcgaatccgccggcgtcggcaagggcaccgtcagctaccgtctgcgcgactggctgttcagccgccagcgctactggggcgagccgttcccgatcgtctacggcgaggacggcaccccgcacctgcttcccgacgagcagctgccgattaacctgccggacgtgccggactacagtccgaagaccttcgacccggaggacgccgaatccaacccggaggctccgctgagccgcaacgaggactgggtcaaggtcgagctcgatctgggcgacggcaagaagacctactaccgcgacaccaacaccatgccgaactgggccggctcctgctggtactacatgcgttacctcgacccgaccgacaccaagcacatggtggagaaggacgagttcgactactggatgggtccggaccacaacaagaccgccggcaagtccggcggcgtggacctgtacatcggcggcgtcgaacacgccgtgctgcacctgctgtactcccgcttctggcacaaggtgctgttcgacctcggctacgtcgactccatggaaccgttccacaagctgttcaaccagggcatgatccaggcatacgcctacaccgacgaccgcggccagtacgtgccggccgccgaagtggtggaaggtcccgccgacgccaacggcgagccgacgttcacatggaacggccagcatgccaaccgcgagttcggcaagatgggcaagagcctgaagaacatcatcacgcctgacgacatgtatgagaactacggcgcggacaccttccgcctgtacgagatgggcatgggcccgctggccgaatcccgtccatggaacacccgcaacgtggtcggctccatgcgtttcctgcagcgcctgtggcgtaacgtcatcgacgagaccaccggcgaggtgcgcgtcaccgacggcgagcttgacacgaagacgctgaagctgcttaacaacacgatcgccgacgtgaccgtcgagatggaggccatgcgtccgaacacggccatcgccaagctcatcgtgctcaacaaccatctgaccagcctcgacgccgtgccgcgcgccgccgtcgaaccgctgatcctgatgctctctccgatcgccccgcacatctgcgaggaactgtggagcaagctcggccacaccgaatccctggcgcacgccgactggccgaaggccgacgaacgttacgtcggacaggattccgtcaccgcggtcgtgcagatcaagggcaaggtgcgcgccaagctcgaggtctccccggacatcgatccgaaggagctggagaagatggcgctcgaagccgtcgccgaccgactgggcggcaaggagccacgcaaggtcatcgtcaaggctccgaagatcgtctccatcgttcccgcggaatgatcttctgacgagacggcccgcataagaggacgcgggttcttccgcaccatggcgacacgccaggaatgtggataacccgcgttctccgaccacaggagccgtttcggctggacagtatgcccatgcatcctccaatgttggatgcatgggcatatttgcatttcgcggcactcaccccatccgtgccatccacacggcggacggcggcactggcatgccggccgccacgaagcggctgcggggattgggcatgcccgaaaaaccgtcccgccccaacagccttacggccatggaggcgcaatcggacgaaccgtccgcatcacacgaacccgcacgaccgatgccgcagcggaagacgcatgacgcgaaaccgacattggcggagctcgccggcgtccggccgacggacaaacccgacgagggggagcggacgaaacgcgacaggccacgattggcgttccgcccgttccacgcgctcatggcgatcctcactttgtcgtgcgcgctgtgcgcgagcctgaccatgctcgtccaacagacgatccactacagcgaactgcagcattcgcggtcgcagatacgctcacaggcccaacagcagccgcaacaggccccgcgaacggaacaaacgccggcaccgcaagaaaacgggccgacgcaggacgcgtccacaccggacagccatgacgggcaagacggagcgcagcaatcgaaccagcttgacctcaacaccgcagacctaggcgaattgcagaccctcaaaggcgtcggaccggtcaccgcgcagcgcatcctcgactatcgaacgcagataggacggttcgacaacgtcgaccagcttttggaagtcaagggcatcggttcgaagactctggcgaagttccgcgaccaagtgtgcgtgagatgacgggcacacgcgattggctgaccagggagcgcgggagccgagactggagactgctgccggccgcaatatgcggttgggcggccagtctggccgcgcacgccggcttcgcatattgcatgtcgcatgacggcatgctcggcgctttgccggccgttctcacctgcatgataccgctggcggtcctggcgggactgcccttcccacgattgccggcgtccgttcgacgacggataacgctctggcatgcgagcgtcacggtctgcgcgatcgctgcgatggtttgcgcggcaagcgcgttgacctatgatttgctgcaatggcgcgacccggcttctcgggcggccgcggaaggcgacgcttccgtcgtcgtcacggcgcgcgccacctcgccgaccgtcatctccgacagacggtcgaacgactgccgtgccgacgcgcgcatcacatcggtcaccatcgacggcgtacggcaaaccagttcggcacgagcgcgtatatacgcggaccggcctgaatgcggcaaactcaaacaggacggcacctacaagatcgcgggtcgcatctccgaagcgcgatacggtgccatgccgttgtggctgaccgacgtcacgacagtcgaacacgtcaggccgccaaacctgccgatgcgcgccatcggcatgatgcaggaggcgttcttcgtccaaaccgcacgtctttccgaccaagggaaagtgctcgtccccggactgacattgggtgttctcggacaggactacgtgccggccgagggcgatggcaccgacatcgattccacatacgccgcacaggtggaggacgcgttccaaaggtccggaatcgtgcatctcatggcggtcagcggcggccatctggccgtgaccgccgcattggtgcgttccgtctgctcgttcttccttctgccgcgacgattcaccgcactgctggtcgccatgtcgtacatcatgctgtcggcatgcgtgtttccatcggattcggtatcccgcgcgcttttgatgggattgtccggcgcggcatgcctgttcatcggcagacgaggccaggcgatggcgtcgttgagctggaccacattggctatgctgatggcatgcccgcacatgtcgcaaagcttcggattcgccctgtcctgcgccgcggtgctcggcatcgtgctgttcgccgacaccctcaacgcatggatggaaccggtcctgccacggttcgtggccgaggctctgtccatgaccatagcggcgcaagtgttcaccctgccgatccaggtgctcatcgaaccggaactgccggtgttctccataccggcgaatctgatggtggcgccgttcgtgggtttcgccacattggccggcttggccagtcttgccgtctcatggctgattccgtggctcggcctgcaactggcccgtgcggcctcctggggcaccgcggtcatggaactgaccgcccttgaactgggttccggcagccaggccacgataccgtgggccggaggcgtcgggggagcggtcctcgtctgcgtggtggaagccgcctgcgcggccgccgcgatcatgacgcaccggctgttcggacgcatgatggttcaggaacccgatctgcccggaaaacgtctgatagccaaccctgtggaacggctgcgcatgtggatggaacgtactcggaaggcattgcgcgaactgcaatgggaggaataggccatgccggttttgtccaccgatacagcgagattgaatggtatgccgaaaccatccgcagccaccacgcccttccacctcgtgtacggaggcgactcgtacctgaacgaccagacggtgcgcgacctcaaacacgaggcgcaacgccggtatcccgacgcggaaaccatcgaactcgacgcggcaaacgccgaccattacgccttcgacgaagcggtaagcccatcattgcttgcggatcgcgccatcgtcatcgtcaccaacctgcagaacgcggacgaaaaactgggcgacgccatggtctcttactgcagacaggcgtgcaaggagccggcggacgcgtgcatcgtcatctgccagcatgagggcggtgtgaagggcaaacgtctggtggagcagctcaccaaggccggagcgtacaaggacgctgtcgccgacctgaagaagcccgaggccaaactcaacttcgtcatgcaatgcttcgaacggcgcaaacgccgcgtcgagccgatggccgcgcagcaactcgtggccgtgttgggggataggaccggcgagcttgcggccatggtcggccagttatgcttcgatttcgacgacaatcccatgacgctcgaccgcgtcaaccaatatctcacctccaatccgcaggtggatggcttccgtgtcgccgacctcgcgttgtcgggacgtacggcggacgcgatcatcgccatgcgatcgtccgtggaacagggcaccgctccgatcgcgcttatcggcgcgctggccatgaagctgcgaacgatggcgaaggcgtcggcggtgcgtgcgggcaccatttccacggccgaggcgaaaacgaacccctgggtgttgaagaatgcgacccggcaactatccggatggacgtcaagcggcatgagcgcatgcatccagatgctcgcatgggccgacgagcaaagcaaaaccaatggctcggacccggtctatgctttggaacggtccatcgaactgatcagccgcaaaggacgtgccgcatgagcaacaccattaccatcacagccgccaccggcgaggacatgcaggcgttgggggagcgtttggcgaagcttgcccgtggaggcgacgtgctgttgctgtccggtccgcttggcgccggcaagaccacgttcgcgcaagggttcggcgcgggacttggcatcggagagcccatcgtctcgccgaccttcaccatcgcacgcgagcttgagggacggttcgcggacggttcgccggcgcatctggtgcacgtcgacgcctacaggctcggcggcaacgcctacgcgcccggccaggacacggtcggacggctattggacgaattggaatcgctcggcttggacgaggaattggaggatccgggcgagcataccgtcatcctgatggaatggggcgagcagatggccgccgcattggctccggaacggcttgaaatccacatcgaccgtccgcttgacgcgcccgccgtgaccgcggacggcgagctgaccagcgcgggcgcacgcacggtgacgttggtgccggtgggcgctgcctgggattcgttcgatttcaccgcgggaaaacgctgaccctgtctaagccgcatccgacgtggccgaccgcaccgcatgccgtggcttccagcgccggttgtacagtggttggcagtttggcacaaggagttttcaagcatatgcagacactggtgattgacacctcatatggttcgaccgtaggcgtggtcggacatgaacccatcgtcgaaacggattcgcgcacccatgtcgagaaactgcaggtgaacatcgcgcaagccgtcgaacaggccggactgcaggcgtcggacatcacccgcatcgtcgtcggcgtcggaccggcgccattcaccggcctgcgcgccggcatcgtcgcggccaaggcattggccttcgccacaggcgcgcaactggtcggacaggacgtgctcgcgccgcaatgcctggcacatactcaagctacggacgatcgccgccatctgacgcttgccgtcaatgacgcgcgtcgccggcaactgtatttcgcgctgtatgacggcggcaccgttgcggacggcgtcggacaatcgcccataacgttgatcgacatggacatcgactatccggattccatcacgatgcgcgtcaatgacgttcttacgaagctcgccgacacgggcaagccgtacgtcgtcgacgtcatcggccatggtgcggtcaaatacgcgcagtcgtggaatgcgattgcctccctcggcgaagtcgacgaccatgctctgctcgacgaaggcgcggaaggattggcgcgattcgcggccttcgccaccagcgaacaggcgttggcagaaccgacccccgtcgaaccgttatatctgcgtcgtccggacgtgtcagtgcccaacccgctcaagcatgtgctcaaccatgccggcgccgaacgaacggagtgacggcacgcccatgatcgtcgaccattcccagattccggaagacaccgccgtcggacagatcgccgcattggaaaaggacctgttcgaccgcggcgcgtggagcgaacagtccgtacggcaggaattccacgctccggcacgcacgtatctgctcgacattgaaggcgatgccgtacagacggcggatcccgtcgtccgaggctacgcaggctactggtacgacggcgacgacgcggagatcatgacgatcggcgtcggcagaccataccaacggcaggggatagcggcggcgcttctcgaaacactgatcgtctcggcgcgtcggcagggcgccaaacgcatgcttctggaagtccgcgtcgacaacgtgccggcattggcgttgtacgaaaggttcggcttcacgcggatgggattgcgcaaacgctactaccagccagaaggcatcgacgcgtacaccatgagcctcgacttggagccgcgcgtcgtcggcttcagcgcaacagcggatacagagcacacttcagcaacacacacaacggagcagcaatgagcgaaccaatcgtactcggcatcgaatcgacctgtgacgaaacggcggcggccgtggtgcagggacgcaccctcatttccaacgtggtcgcgtcctccatggacgagcacgcccgctacggcggcgtgattcccgaaatcgcctctcgcgcgcacgccgaagcgttcgtgccatgcgtctccaaagctctggccgacgcgaacatgacgctgtccgacgtcgacgcgatcgccgtatccgcgggacccggcctcgccggctgtctcgcggtcggcgtgtccggcgcgaaatcgttggcatgggccgcgaacaagccgatctacggcatcaaccacgtcatcggacatatcgcggtgacgcagctgcagttcggaccgttccccaaggacacgcttgcgttgattgtgtcgggcgggcacacttcgctgctgcatgtcgaagacgtggcgcggcatatcgacgtggtcggcaccacgctcgacgacgctgccggcgaatgcttcgacaaggtggcgcgtctgcttggtttcccgtatcccggcggcccgcacatcgaccgtcacgcgcagctgggcaacccacatgccatcaaagtgcctcagggccttacacaaggcaaggcggggcagcagcatccgtacgatttcagtttctccggcgtgaagacggccgtggcgcgttggatcgaacagcagcaggcggaaggcaatgagattcccatcgacgacgtgtgcgcgtcgctggccgattccgtcgcgacggtgctcgccaagaaggcgatgcgcggttgcgagcagtacggttcgaagaccctgatcgttggcggcggcttctccgcgaactcccaactgcgcgccaaactgttggaggtcggagccaagcatggcgtcgaagtgcgtatcccgcaaatcaaactgtgcaccgataatggcgctatggtggccatgctgggcgtgaacctggtggagagcggcgtgaaaccgtccgaaccggatttcgcaatcgattccgccatgccgttgacgaagatcagcatgtgacggtagtcccgccgcagcaggggagacacgcgcgggatttgcattttgcgttttaccgcgtatgattcatgtcttgtgcacagcgcattcctgcgtagctcagttggcagagcatccgactgttaatcggacggtcactgtagcgcatctccatggcatggagagggtcaggggttcgaatccccttagctccacagaattgaaggcttccgagtaatcggaagcctttttcgtattcagcctcttgtcgaccatccaacggacgcgatcgcccgcaaaccaaataaaacggccgcctgcatacccgcaagcggccggaatcatcaaatcaataggggagtggcaccacgaatcgcaactagttgcgggccgcgttctgcttggacagctcgtcacgaatctgctgcagcagctggacggtctgctcttcggcagacggctcttcagcggccttttcctcggcttccttctgctcggcaagcttggtcttggcaagcagcgcctcggtcatgtcgcggaatttgttgatcggcaccagaatgcagaaatagacggcgacggcgatgatgaggaaattcagaatagcgcccagcactgcgccgaacgaaacggtcgcgccgttgaatgtgatcgccagcagaccatccatgttcggcttgccgaagatcatggcgatgaacggattgatgacgctgttgacgatcgcgttgaccacggtggtgacggcaccgcccatgacgacaccgacggccatgtcgatcatgttgccgcgtgcgatgaatttcttgaatccttcgaacatttttgctcctgttctgcattcgcgattccgtgaatcgcgtcaatggacaagtctctctttggacgtgtctctcttgcatgcccgaatccatcctatatccgcacgctccagccaaatcttgagcaatatcttgtgcgtctcacaatcaagcacatagaatgaaatcgccgtattgataacccaactatcccgaaggggaaaaatatgctcactgatgagtacgtcaagcgcgtgtacgcgcaggtcgagaagcgcgatggcgaccagccggagttcctgcaggccgttcgcgaggtcttcgaaagcctcgagccggttgttgagaagcacccggaatatgagaaggcgggcgtgctcgagcgcctcgtcgagccggagcgcgtggtgaagttccgcgtcgcctggacggacgatgagggcaaggtgcaggtcaaccgcggttaccgcatccagttcaactccgcgatcggcccgtacaagggcggtctgcgtttccacccgagcgtgaacgagggcgtcatcaagttccttggcttcgagcagattctcaagaactccctgaccagcctgccgatgggcggcggcaagggcggctccgacttcgacccgaagggcaagtccgatgccgaagtcatgcgtttctgccaggcgttcatgaccgagctgtgccgtcacatcggccagttcaccgacgttccggccggcgacatcaacgtcggcgcccgtgagatcggctacctgttcggccagtacaagcgcatccgcgacgaatactccggcgtgctcactggcaagggcctcgaattcggcggctccctggctcgcaccgaggctaccggctacggcctgtgctactacacccaggaagccctgcgcgtcctgaagaacgattccttcgaaggcaagaccgtggtcatctccggctccggcaacgtggccatcttcgccaccgagaaggcccaggccctcggcgcgaaggtcgtcaccgcctccgattccaacggctacgtctatgatccggacggcatcaagctcgacatcgtcaaggacatcaagctcggccaccgcggccgcatcaaggaatacgccgagcgtgttccgggtgccgaataccacgagggctgcaagggcgtgtggaccgtgccgtgcgacatcgcgctgccgtgcgccacccagaacgaaatcgatgaggagtccgccaaggccctcgtcgccaacggctgcaaggtcgtgtgcgaaggcgccaacatgccgtccaccccggaggcaatcgccgtctatcaggacaacggcctgctgtacggcccggctaaggccgccaacgcgggtggtgtggcggtgtccggccttgagatgagccagaactcctaccgcctttcctggacgttcgaagaggtggacaacaagctcaagtccatcatggagaacatcgtcgccaattccctggccgccgccaaggagtacggccatgagggcgatctgatgctcggcgccaacgccgccggcttcgtcaaggtcgccaacgccatggtcgcccagggcgtgctctgatcgtctttcacgatccgtttcgacggtccgtgcgattcgttcgcacggaccgttttcatatgcgttacggcataacgcgcaacgcagtatgacgattgcataaaagcgaccgcataatcgcgattacataagaaaagacggcgcctcccgaagtagggaagcgccgtcttcttacgttgcacgaacggcttacgttgcgcaaacgccgtacgaacgccgtatgacgaatcgatcagtcgtcgccgagcgtcacgtggatgccgccgaccagcgtgctcaccacgttgtacagcagcgtgagaatcaccaccagcacggtgaacagcaccacttcgatgatggagaagatggtggccgcgctcagcacggtgctcagcgaaagcacgttggcaaggtcgaatccgccggcgtcaagaccggtggaggacacgatctgcgtcacctgatcgaacacgccgaccacgttcagcagcagccacagcagcgtcaccgcgacgatctggatgatgcctcccgcgatggaaagcatgaacgccaccttggccgcggaccatgcgtcgatgcgggtcagggacaggctcatgcggcgggcgcgaggcgcgccacgacgcgctttttcacgaaccttcacaccgccggacgcggcggccatgttctcatgcgcctgagactgttccgtaccgctcaacggctggctggatgcggaacgggccacgcgtggggcctgcgcccctgcctgcgcctgatggctttcattgttctcgctcatcgttgctccttgcagaatcttgcctacttctagccgaggctaccagttttcgcagacgattccccgcctgtgtctcaggcctctacattctcgccatcgccggcatcggaagtggcttccgtaccggtttcagcggagttttcagtagtggtttcggcttgcgattgcgcggctgcgtcgttctggactgctccgttttccgcggcggcctgctcggcgtcatcctcgtcggtctcctcgttacgtgctatggagatgatttcgtcgttcttgtcaggcttggcgagcgtcacaccctgggtggtacgtccggtgcgcttgacttcggcgacgttggagcggatgaccttgccggacttcatgatggccatgatctggtcggattcctccacgatcacggcacccaccagggagccacggccttcggcgagctgcacggccttgacgccgtagccgttacggccctgcagacggtattcgctgatggcggtgcgcttggcgaagccctcgttggtgaccacgagcagatccctgtcggaatcgccctgcaccacatccatggccaaaagctcgtcgccgtcgcggaacttcatgccctgcacaccggcggtctggcggcccatcgggcgcagctgctcgtcgttggcttcgaacttcaggctcatgccctgcttggagacgaggatgatgtcgtcgtcggcgttgcacagcgcggcaccgatcagctcgtcggcgttctcgccgttctcgtcggtcatgagtcgtaccgcaatcagaccaccctgacgcggggagtcgtattcggcgagcgcggtcttcttgaccttgccggaacgggtggcgagcaccaagtacttggccacgtcgtagttcggaatcgacagcacggtctggatcgtctcgtccgggccgaactgcagcaggttcgccacgtgctgtcccttggaatcgcgggagccttccggcagctcgtatgccttcagacggtacacgcggcccttgttggtgaagaacagcagccagttgtgcgtgctggtcaggaagaagtggtccaccacgtcgtcctcgcgcagcttggcgcccttgatgcccttgccgccgcggtgctgcgcgcggtattcgtcggccttggtgcgcttgatgaaaccggagtgggtcacggtgacgaccacgttttcttcggcgatcaggtcttcgacgttcatctcgccggagtacggcagaatcttggtacggcgttcgtcgccatacttggcgacgatttcgtccagctcgtcgccgacgatcttgcgctggcgttccggcttggcgaggatgtcgttgtagtcggcgatcttgcgcatgagctcgttgtgctcgtcgaggatcttctgacgttccagggcggccagtcggcgcagctgcatggcgaggatggcgtcggcctgcacctcgtccacgtcaagcaggtccataaggcccgtgcgggcggtctccgcggactcggaggcacggatgagggcgatgacctcatcgatcatgtcaagggccttcagatagccctgcaggatgtggtcgcgttcctcagcctcgcgcttgaggtaggcggtacggcgtgcgatgacttcgagctggtggtttacccaatgacggatgaacgcatccagggacagcgtgcgcggcacaccgtcgaccagtgccagcatgttcgcgccgaaggtctgctgcagctgggaatgcttgtacaggttgttgagcacgaccttcggcacggcgtcgcgcttgagcacgagcacgaggcgctggccagtacggccggaggtttcgtcgcgcatgtcggcgatgccttggatcttgccgtcgcgcaccgcttcgcggatggacacgaccagacgatccgggttaacctggtacggcagttcggtgatcacgaggcacatgcggcccttgatctcctcggtgttcaccacggctcgcatggtgatgaggccacggccggtacggtacgcctgttcgatgcccttatggccgagaatcgtggcgccggtagggaagtccggtcccttgatgatgcggatcaggttgtcgagcagttcctcacggctcgcgtccggatggtcgagcgcccaatgcacgccttctgccacctcgcgcatgttgtgcggaggaatgttggtcgccatgccgacggcgatgccggacgagccgttgcacagcaggttcgggaagcgggccggcagcacggtcggctcctgcgtcttgccatcgtagttcggcaggaaatcgacggtgtccttgtcgatgtcacgcaccatttccatggcgagcggcgccatacggcattccgtgtaacgcattgcggctgccgggtcgtcgccgggggagccgaagttgccctggccgtcgacgagcgtgtatcgcatcgaccacgactgcgccatacgcaccaacgtgtcgtagatggcggaatcgccgtgcggatggtacttgcccatgacttcgccgacgacgcgtgcgcacttggagtagccgcggtcggggcggtagccgccgtcgtacatcgcgtagatcacgcggcggtgcaccggcttcatgccgtctcgcacgtccggaagggcacgatcgacgatgacggacatggcgtacgccagataggattcgcgcatttcctgctgcagatccttcttctggacgcgttcgccgaccatcaggccataatcggtgttgtcggcctcctgcgggctcaacggttccatggagccgtcaggcacgaactggccgtcttcgttgctgttgttttcgtctgccaatttctaatccttgctttgaagtcctgcgaaaccctacgcgtttacgcgtcgatccagctgacgttgcgtgcgttgcgctggatgaacagacgacgtggttcgacttcgtcgcccatgagcatggagaaggtctcgtcggccgcggccgcgtcttcgatctgcacctgcttcagaatgcgatggtcaggatccatggtggtctcccacagttcctggtagctcatctcgcccagacccttgtagcgctggatgccttcgcccttcggcagctggcggccggcggccttgccttcggcgagcacgcggtcgcgttcggcgtcggtgtacacgaagtcgtgcgggcccttggtccacttgaggcggtacagcggcggcatggccacgtacacgtagccggcggtgatcatcggacgcatgtagcggaagaacagcgtcaggttcagggttgcgatatgcgcgccgtccacatctgcatcggccatgatgatgaccttgtggtagcgcaccttgttgaggtcgaagtcctcgccgtagccgccgccgacggcggtgatcagcgattcgatggtgtccgacttcatcatgcggtccaggcttgcgcgctcggtgttgaggatcttgcctcgcagaggcaggatggcctgcgtgatcgggttgcgtccctggatggcggagccgcctgcggaatcaccctccacgatgaacagctcgcattcctccggattgttggactggcagtccttgagcttgtccggcatgccggccgattcgaagatcgacttgcggcgggtgttctcacgtgccttcttggcggccaggcgcgcacgggaggcctcgatggccttctggatgatgttcttggcctcgttcgggtgggcgtcgaaccagtcgccgagcttgtcggtcatgacgcgctgcacgaaggtcttcgcctcggaattgccgagcttggtcttggtctggccttcgaactgcgggttggtgagcttgacggacacgacggcggtcaggccttcgcgcacgtcgtcgccggacaggttctcgtccttgtccttgaggatgttcttctcgcgggcgtagcggttgaccagcgaggtcagcgcggcgcggaagccctcctcatgggtgccgccctcggtggtggagatggtgttggcgaaggtgtgcacggcttcggaatacgcggtggtccactgcatggcgatttccgcggagatgccgatcttcaggtcctcggcctcgaagtcgatgacgtccggttcgaccggggtggccttgcgggacttcaccaggtagtcgacgtagtccttgatgccgtcgttgtactggtaggtgacggtctggaacttgtcttcggtttcggattcctcgccggaaacctcgtcgccggcctggtcgggctcgcgcaaatcggtcagggagatcttcaggcccttgttcaggaacgccatctgctggaagcggttgcgcaggatctcgaaatcgtaggtggtggtttcgaagatcttgccgtcggcccagaaggtcacggaagtgccggtggactcgccttcctccatcggcttgcccttgagcagacgcgcggtcggcttctggtcgatgtaggtctgggtccagtggaagccctgacggcgcacttcgatgtccacacgggtggacagcgcgttcaccacggagatgcccacgccgtgcaggccgccggagaccgcgtagccgccgccaccgaacttgccgccagcgtgcagcttggtcatcacggtttcgacaccggagatgccttcgcccggcacttcgtcgaccgggatgcctcggccgtcgtccaccacgcgcacgccgccgtccggcagaatcgtcacttcgatgtgtgacgcgtagccggcaagcgcctcgtcgacggagttgtcgacgatctcatacaccagatggtgcaggccgcgagggccggtggagccgatatacatgccagggcggatacgcaccgcctcaaggccttccagcaccctcagatcggacgcgtcgtagtgttccggagacagcgaatcgtcaagttgcgcatcttcgagctggtcgttctggatctgatcctgaatctgatcttcctgcgtgttttcagctgattcgttcagcgaatccgcatcaaggtctgccacagagattccttcctgcatttttcccgccatcaagggtcatttccgcaggtgataccacctagaacgcaaataaaggccccttctaggcgtttacatacactgctggatattctactcatggagggggacagcgcgctatagacatttgtccttggaattcaacggtttccaacggcttcggcatggttccgaacgcgtccgacgagccggaaaacctccgtaaaccccgtcgcaacggcctgtttcacgcgcgccacaatcgatctctcctgtcagagaggtcgattgtaagtcgacttcgcaatagccctcagtagcgaatcttccttgagatacgcccacggctgaacccttggctctgcgggccggtgaccctcacctcattgatggtcagaccttcgagtttcctgcggatggtgtccgtcagcaacggcgtcatatacgacagggtggtggtccaggccgggctgtcgcaacgtatcgtcagcacgccgtctcgcaggctggcggggtaggagtgcttcgcgttctccacgcccaccacctggtcccaatggtcgcgcatctgcgccattttgaggtggggtatccatgcgccgttcgatgccagcagattgaacaggctgccgacggtttccggatcgcgtccgggttcgccgaagctttcccacgccttgcgcgcgcgttcctcgcgttccttgagccgcccggcacggtcgctgatgcggtcgaacacttcggccggcagtttgcgttggtcgaggttcagcagttcgcagattggtggtttcggcattaggattcggcctcgattccttgcgattgcgcgccacgtccggcggcaagcatggccgccatcgccgcgatatcgccgtccgtctcctgcgattgcgcacgcagcgcggcaacgtcgatgacatgcgccttgccttgcggaatatcgcttgccgcggcaacggtgatcagcacctggtcctgccgtcgcgcgaagtcgaggatctgcccgcgacgggactcgtcgagctgggcgaacacatcgtcgaggatcacgatcggcttgacgtcgcgctgcgccgaaaccacttcgtacagcgccattttcaaggccaacgccatcgtccacatctcgccgttcgaagcgaattcgcgggctggcatgtcgttgagccgcaatgtcagatcatcgcgctgcggtccgatcagattctgcccacgggccacttcgccggggtagatgcgttggaaatgacggctgatttccgcggccggctcgtcgaacagaagcacctcgtcgaaggacggctcatacaccaggtcggcctgttcctcttcgcccgccagcgaagcatagatgcgggtgaacggctcgcgcagcagtccgatcacatcgttccggtccttggtcaattgcacgccgagggcgatgaattggccggtccacacttccagaccgctcagcacggcctgacgcccgtattcggggtcgatgccggagccgtcggacagctgtttgagcaatgcggcacgctgtttggcaacgtgcgtgaactgttgcaacgactgcgcataacggggcaacagcagcgaagccgcctggttaaggaagttccgtcgggtggccggatcgccagacaccaaccgctggtcttcgggggtaaaggacacggaggggaccaaacccacgatatccctcatatattgcgattttccgccgtccacgcgcgccctgttggcgcctcgcgcggcgatggtgatctcatatgtgcgctgttcgcccgcatcttcgacgttggcccggacagtggcggaagggtggcctttttcgaccagcggcagcgatgacgaggtgcggtggctggagccggtggacagcacttccacggcttccacgatattggttttccctaggccgttcgagccttggagaatgttgattcccggttcgaaatcaagcacgcaatggtcccatgaccggtaatggtcgagcgcgagacgggagatatgcatgaaaaccggaattccttgaaggtgatggcatggtggcccggacgggaacttgccgtccgggccacaggtggaacgaaatcagttgttgaagcgcatcggaacgagcaggtaacggtagtccatggattcgtcggaatccgcttcctgctggccgttgaattccacgggcttgaccgcggtggtcatcttcatgcgcacgaacggctcgctgatggcgctcaggccgtcgaccagataggaggggttgaacgccacggtgatgtcctcgccgtccatgtcgatgtcgagaatctccttcgcctgtgcttcgtcggcggtgccggccgacagcgtcagctcctggccggagaagaccatgcggatcggggcgttgcgttcggcgaccagcgaaacgcgcttgatggcgtcgatgagggcctgcttgttgatgacggcatgaatcgggtattcatcggcatacaggcggtcaacggccgggaattcgccgtcgatgagctgggaggtggacacgcggccggcgttctcgaagcccagcagggacgggttgtccgcatcgaaatcgatggtgacgttctgatgctcgtccagcgaacgcgccatgtcgcgcagcagcgagccacggaccaaagcggtggtgctgatggtcgcatcctccggcgtccaggtgaagctggaacgggccagacggaaacggtcggtggagctcatgatgaccttgtcgccctggaactggacgcggatgccggtgagcaccggacggttctcctcacgggagaccgcgacggacgcctggttgacggcctgagcgaaggtgggggagtccacctgacccagtttcatcggcaccacgggcagatccggatattcgctttccggcatgagctgcatggtgaaggtcgacttgcccgacgtgatggtcatcgtggaaccatcagtggaaagataggttttcgcagcgggcagtgacttggtgatgtcggcaagcagtttgcccagcaccagaacgctaccggcctcatccacgccggcttcgatgtgatggcgtgcggaaatggcgtagttgaaggcggaaagctggagtgtgccgtcaatggcttccagacggatgcccgccagaatcggggttgcgggacgtgcgtcgatgacacgtgtggtccatgccacggcatcggcaagagcttgggaattgacttcgactttcatggggtattcctcgtttcgttcgatccacatgccattctagcgataagagcaacgacgacgaaagcgtggggaattccccgcattacgagaatgacgatgaaagtaagaaaaacgtactttcgtaataataagccctgtggatagtgtggataagctcgttcagcccaagcgcagcaacgtctcagtacgaggcgacatctgtggataacttctgagtcgaatgtggataagagcatgggttatccacaggctcatggccgcgcaaaacttatccacaatccactgtgaataatccacgagctatacactgccgttttccgtgtttccaacggcttttccacagacctttccccgaaatgtggatatgtatgtggaaaactcgatgtacaagaaattatgtccgggcgtgtcacgcggatagtaaaaaggctggtaaataatttaccagcctaaggaaaaccgttggaaatacgccgtttgttgtggttgcttccgttacttgtcgttggaacgctgcttgagctgcagagtcaactcggtcacgtagttgtagatctcctgcttctcctgcatctcgtcgttgatgcgcgtatacgcgtgcatcacggtggtgtggtccttgccaccgaagaccaggccgatgtcgttgaggctcatgctggtcagctcgcgtaccagatacatggcaatctggcgtgccagcgcgatcttcttggtacgcgaacggccgacgatgtcgtcgaacgtcaaatagaagtacttggccacctgcgtgatgatgtccgcgggcttgatttccacgtcggtggtgaagaagtcctgcaaagtctgctccgcaagggctttggtgaccggctggttgctcagcgacgccatggcggtcacacggttcagcgcgccttccagctcgcggatgttctcggtgaaccgttccgcgatcaggttgaacacgtcgttgggaatattggagccgttcatggtggcgatcatgcgcagaatggcgattcgcgtctccagatccggcggtttgacgtccacggtcaggcccgattcgaagcgggagatcagacgttcgttgaagccctgcaggtccttcggcggcacatcggaggcgatcacgatgcgcttgttggcctgatgcagggtgttgaacgtgtggaagaactgctcaagggtcgcgtccttgccgctcaggaactggatatcgtcgatgagcagcacgtcgacctcgcggtagcggcggttgaattccttgatctggccggaactttggttcgtatcggccagagcctcgatgaattcgttggtgaattcctcactggtgacgtagcggaccttcagattggggtccttgaccagcgcgtagttgccgatggcgttcagcaaatgggttttgcccaggccggagcctccgtagatacacaacggattgaaatcatggccggaaccctccgccacggccagcgccacggtacgtgcgaaacggttggaatcgccgggcacgaaggtgtcgaaggtggcgttcttgttcaaatgcgtttcggggtcgagcagcggcctgttctggccgctctggaaatggtcctgttccggcggcatcgtcgtgggaatcggcaactggccctgcatcgtctcgttcgcaggggacttcgccggtgatttcgcgggggagaagcgcggataggtttcctccggctgttcctccgttttcggcttcatttcaacgattttgaaggcggggaagatgtcctgttcggcggattcgcgcaacgcctccatcaacggcttgttcaattcggtctgcaaagcctgctgagccgcctcactgggcacgcacagcatgatggtcggaccccacatgccttcgggatagacgttctccagccagcttttgtcgcgtacggacagcgacggattctggtgcagcagggccaaagcgtcggaccacaccccacgagcctgctcgagaggatctgttgtcgtgttatcagccacggataatcctttctcgacagacgtaccactgatgtgcaactgtatatttgtactctcttttccccgagttatccaccggcatgcgtgttgaaaagattgaaatgtgaataacattgttgtagtttgtggataacttttgtggggaattcggcggaatcgcaacgattatgtggattgttttatgcggggaatccccatgaaaatgtgaagaaaaatggacgacgcgacaatctgttcaggggtcagagtagtttagtagagcttgactcatgaggagccgtgccttggcatggctaaaaacaccgggagcattaattatgaagaggacattccagccgaacaaccgccgtcgccacatgaagcacggtttccgtcagcgcatgcgcacccgcgcaggccgcgctctgatcaaccgtcgccgcgccaagggccgcaagtccctcgctgcctgattttttagtggcatagagcggtggaacggctgaaaagccatcgcgattttgttgcggtgctcaaacgccgtcgtagggtatcgcgagaagacatcgtcgtgcattatctgatgcacgacgatgtcgtaacgggcgatacagcgacggtgcaaggccgccgtgtcggcttggccgtttccaaagctgttggcaacgcggtcacgcgcaacgccgtgaaaaggcgtttccgtgtgcttgcacgaaagtacgaatcactattacctgaatcctgcgatatcgtgttgcgtgccaagccaagtgccgcacgtgccgatttcctgtcgcttgagcagcagatggcatcgtgtttcgaagcggtgaaacgtaaaaccgcttcccggcaatgagcaagggacatcatcgcaattggatggtgcggctcatccgctggtatcagaaacatatttccgcccataccgcacctcggtgccggtattatcccagctgctccaattatgcgattcaggcgattgaacgatttggctgccttaaaggtggtcttcttgcgttattacgccttctttgttgcaaccagtggaaccgtggaggaatcgacgacgttccacagctctattccttgttttacagatgttcgtggtcgaaggcacacgaggagcctcgtctcacgcctctggatgtagatgaacctataggcgataaggagaatggcctgtaatgaatcaagatcaattcctcctcgatagtggtttctggggctggctgtacaagctcctgtaccccgtcgagtggctcatgacgcagattatggccggattccaccgattcatggtgatgctgggcatgaacgagatcggtttctcgtgggtcatgtccatcgtgttcctggtgattgtggtccaggcgtgcgtgttcccgctgttctacaagtccatgaagggcatgcgcaagatgcaggcccagatggccgttttgcagcccaagatgcagcgcatccaaaacaagtacaagggcaagaacgatcccgccagcaaagaggctttgcagcgcgagatgatgaagctctaccaggacaacgacgcgaacccgatgggcggctgcacgtcgatgctgcctatgttcgtgcagggtcctgtgttcatgtgcatgttctacaccctgtcggccattccatacatcgcccgtggcaagttcaggaacggttccggcctcggcgccttcgacatcgccaccgccaagcagttcacctccaccaacgtgttcggcgtgaacgtggccgagaacttcaccaccgccgacatccacggcaagatcatcatcggcatcttcgtggcgttgatgtgcttctgcctgtggctcatgcagtacaacagcatgaagcgcaacatggtccagagcgctgcgaacaagcagactgaaatgatgcagaagatgatgctgtggatgttcccgatcatgtacatcttctccggcgtcgccatgccgttcgcagtgctggtgtactggctgaccaacaacatctgcaacctgctgcgttccgtctggcagatccacgtcttcccgactccgggatccccggccgccgaagcgaaggaaaagcgcgaccacgcccacgagaacgcccgccgcgccaaggccggtctgccgtccctcgaagaggaggagctgcagaaagccaagaaggccgcggaggcgaaggaaaagaacggcttccagcgtcagcagccaagccgcaaaaagaagaagaagaaataacatcaagtgtgtgtcctgtgtttcacgtgaaacgcaggacacaccgcttttgtatcgggcgaatcgcccatatgatacaacccaatcagtagactttcagtagacttgaaataatacgaaccccgctcaaaggagtaaaacaccatggcgcaggatgctgagaaaaccatcgatcagctcaatgacgaagctgacatcgctgccgattaccttgaaggattgcttgacatcgtcgactacgagggcgatatcgaaatgggcgtgcgcaacaaccgtccgaccgtgcagatcgttgccgacgacgacaccgacatcaaacatctgatcggacgcaacggcgaagtcgtggacgccctgcagcagctcacccgactcgccgtacaacagaagaccggcgagcggtcccacctcatcgtggacgtggacggctatctgaagcgcaagcgccagcgcctgcacgaccttgcgctggatgccatcgacgaggcgcgcgagactggcgagccggtggacctgaagccgatgaactccttcgaacgcaagatcatccatgatgtggtgcgcgaggaaggcatgaagtctcggtcccatggcgaagaaccgcatcgttacgtcacggtgtacgtcaaggcttccgcagccgatgacgccgacgagattgacgaagcctgaaatagtttcacgtgaaacatgaagcgtcgcgagtttctcgcggcgcttttttgatgcctgtagattaggatggtgtgcatgagtgatgtgaatgacgaattggatgggtcgccgattcttgaggaagtgcttggcgatgcattgggcaagttgaaggtgtttcacgtgaaacttgctgcggaaggagagccgcgcgggctgatagggccacgcgatgtcggtattatttgggaacggcatattctgaactccgcggccatcgtaccgttcatccgtgaagcaacggccaagaggcaattcaagacggtggcggatatcggcagtggtggaggattccccggtatcgtggcggccgcctgcctgccggaccaccagttcaccttggtggaaccgatggaacgccgtatcgaatggcttcatgagtgcgttgacgaaatgggattggacaatgtctcgatagtgcgctcccgagccaacgccgtaatcgaagccgtccgtggttcgaacggtggccggaagggcaggggagaggatgccgtcgatcttgacgggaatcccatcccggtcaagcatccgtttgccgtggtgacctgccgtgcggtcgcgccgatggccaaactatccggatggacgctgccgttgctggacaaaggcggacggctggttgccctgaaaggacgatccgcgcaggaggaaatcgtcaaggccaccaaagagatctccaaaaacggcggtatccatccccgcgtggtggaggccgaggtcggtccgggtctggaaccgacgcatgtgctgatggtggacaagcgataagttatccacaaaatcgcgtgagttatccacagtatccacaatcgcggaaatgtgttacgaagcatcttgaagaagcttggaattgcaacgattgttctgtggataacttttgggtggtcggatgagttatccaccaactatccaccgttgttcacaatggtgcacatggccgtgaacaggtgaaaatctgtccacccaaatgatgaaacttgattgttgaatatgtataggaaggctagttcatgactggacctgaagaaccagacaatttgacgtcgatggaatccgccacggaaaccatcaagcgaatcttcgaaggctcgacatcccccgtaggcgcgcaaatcgctgatgaatcgacgcgatacaaggcattggagcatgcggtctgcccgaagccggcccaaacgcgcctgatcgcagtcgccaaccagaaaggtggcgtcggcaaaaccacatccgcggtgaacctgtccgcggccttggcccgtttcggatgcaaggtcctgcttattgatatggatccgcagggcaacgcctccacggcattgggtgccccgcacgcctccggtcagccttcggtgtatgacgtcatcgaagggcgcaagcgcatcgcggaagtcaagtgcacgtgccctgatttcgacaacctcgacgtggtccccgcatccatcgatttgagtggcgccgaattggaagtcgccgacatggcggaccgcaactcgctgctgaagaacgcggtggacgagttcctcgccaccagcgaagagcattacgattacgtgatcatcgactgcccgccgagcctgggtctgctggtgatcaacgccatgtgcgccgtgcacgaaatgctgattccgattcaggccgagtattacgccttggaaggtttgggccagctcatcaacaccatcggactggtgcaggaacattacaatccgtcgctgctggtctccacgatgctcatcaccatgtacgacaagcgcacgctgctgagccgcgaagtgcatggggaagtgaagaagcactatccgacaatcgtgctcgacaccaccattccgcgcacggtgaagatttccgaagcgccaagcttcaaccaaagcgtgatcgcatacgaccccaagggcatgggtgcgatcgcgtactgcgaagccgcgctggaactttcgcgtcgttccgatacggtgctgcaggcaatcgatgcaagaaggaatgagaactgatcatggcaactaagtcgcgtttgggtaaaggtcttggcgcactgtttccttctcttccgggggagccgcagcatcaggagcatgcggcgcctgccgctgccgccaaagaaatcaaggcttccaagactgatgagcatgtggaatccaagagcgcgtccgctaccgcacaggcatcggtgaacgccgtgcaggggatgaagcatgctgtttcacgtgaaacaaccaagaaaaaccagcatcgtcgtgccagcatgccgtcgatttcgttgaacgaaagcgcgcatcccgcggacatgttcttcggctccaccgctcagccagcttccgaacagggcgagcagcaggggagtgtttcacgtgaaaccacgccgaccgaacataagaaggacgaaccggaactgcttcccgtgcagggtggatatctggttgaactgcgtttgagcgacgtcggtcccaatctgcatcagccacgtaccattttcgatgaagacgacctgcgcgagctagccgaatccatcaaggaagtcggcgtactgcagccaatcgtcgtacgcaagcgtccgcaatcgcaaatcgaagccgcccgcagggaagccgcagccaaaccggccgaaccgcacaacatgttcgacgggcgcatggatagcatgtacgagctcatcatgggcgaacgtcgttggcgcgcatcgcagatcgccggcctgaaaacgattccggccatcgtcaaaaccaccgccgatgacgacatgctacgtgacgcactgctggaaaacctgcatcgcgtcgcgctgaatccactggaagaggcggctgcctaccagcagatgatcgacgatttcggcctgacgcaggcccaactgtccaagtcggtgtcgaaatcccgtccgcaaatcgccaacaccttgcgattgctcaacctgccggccgccgtgcagaagaaggtcgcatccggactgctgtccgcgggccatgcgcgtgcgctgctgggactgccgacggaagcggatatggaacagctggccacgcgcatcatcgccgagggactgtccgtacgcagcaccgaggaaatcgtgtcgatgaaggccgccgaaagcgaccagcccaagaagccgaaggccagcaagctcaatccgtgggctggtacccccgttcaggttggtctggagcagcgtttcggcaccaaggtctccatcaagggatcgaagaagcacgggcgaatcgaaatcgtgttcaaatcggaagacgatatgaaacgcatcgtcgacctgcttatgcagcagcagagctgaacgaaccgagccaatcgagctcggcgagcgataatgatttgaacgatttgagccttacttgagcgaatcgagataagcctgcgcgtccagcgcggcgcggcaccccatgcccgccgcgctgatggcctgccgatagacgctatccacgcagtctcccgcggcgaaaacgccgggttcgctggtacgcgtgctggcgccatcgaccgtgatataaccggctgaatcgacgtctacaagcccgttaagaaaagcagtggcaggagtgtgcccaatcgccatgaaaacgccgttagcggggattacagaggtcttttcggtggcggtgttgcgcacctccacctcctgcacgccgttctcgtcgccgcgaatctcctgcaccacagcgtcaagcacgaaatcgattttcggattgcgttgcgcacgctccaccatgatgcgggaagcacggaacgtggaacgcctatgaataagggtgacggacgagccgaaacgggacaggaaatcagcttcttcgaaagcgctgtcgccgccgccgaccaccacaatcggcttgttgcggaagaagaaaccatcgcaggtggcgcagtaggagacacctttgcctgcgtattccgtctcgcctggcacgcccagcttacgatagtttgagcctgttgcgatgaccagcgcgcgtgcgtcgtacacgtcgccgccgtcaagggtgacggttttgatgccggaatcggcattcgaagcaaccgaaacaacatcgtcccaaacgatatgcgtgccgaaccgttccgcctgcttgcgcatattgtccatcagatccggacccatgatgccatcgggaaagcctgggaaattctccacttcggtggtgttgaccaactggccgccgggcgtcagcgcgccggcgacgaccagcggctcgaagccggcgcggccaagatagatcgcggcagtatagccagccgggccggaaccgataatcaccacatcacgcatatcactcatggttgctactgtaatgcagtttccacgacggttgcgggcggttttgcagatggcgttcaaaaaagcgtcaaaaaggcgttcaaaaaagtcagctatccgtcacgttgtttcacgtgaaacaaaaagagggtgtgcggaacaatccgcacaccctctttgtctgccgatgcgtcagaaaatctgcaccgaatcgatgtacagctggttgccgggaaggctgtcgaacggcacccacaagaggatgtcctgggtctccacggccttgttgaacttgatttcggtggtgccgctggcgtcgaactcgaactgggcgacctgttcaccctggttcgggctggacttggcgttcacgcgaatgtagccctggccgccggaagaacggatcttgatgaccatgcgatacgctttctggggctggctgaggtggaggtaataaccgtaaccttgttgtccgtccggattggacaggaactggcggttgtcgatctcatacggagtcgtgttctctggcatcttcggttccggaaccttccgcaccttcttatccgaagtcaccaccttgtcgacgtccttcttggcggaatggctcttcttcgtggttttcttcggcttgctggaatcggagctgccgttgtcggagctgttggcatcgttggaatcgttgtttgcatcgctggcggagctgctgccattgccggaatcgccattattgccgaaaggcacgtcgtcaaggttcatttccggccacggattgttggaattcgtattggtgatgccgtcatccggcttcttggtcaaaccatgaatggcgaatcccaatgcgacggccaccacaatgaacgcgaccacaatggccacgaccttggtggtgagcttgccgaacaatttggcattggcgacctcggccggactggaggaagaggctttaggggcaaagctcggcggcaccgcaacgggggctccgttttcgttctgatatgccgcgtcgatcgcttcctgctccgccttcaacgcgcgtgcggattcctcgcccggctcgatgacccgtccgtcaggtccgatcaccggaatgcgaccggtcttctccaattgcgaatcgtccgtatgataatcgccctgcggcgacggcgtggaaacacggatggggaaggagaacggcgaatccacatcttcggaggatccgtcgaggtcctcttcgctgagtagttcgcggctgttgttccacagcgatttcacggcaccgccggtcgcggccatacccttggccaaggcttccttgctgtcggagaaatcagtgtgtggttcaggcgcttcgaacgtcatttccggaatgcttccggtttcagccagcgtatcgggcaaggcgatggcatcctgctcgagaatctgcagcaggggcacgttcacaatcgagcattccgaatccgcggacggtaacgcaatatcggggccgttaagcttcgccagcggctcgtagtcgcccagcaacgcctccaattcggcgatggtggccatcggaacggtcgggaaaccgtccttctccttgagatccagaccacgcttgcaaatcacgcggaactccatcggcacgttcggtgaaatcgcgtcaagatggtagttcgtggacagcgtcgacggcgtgcgcgtcagcagggaatacagcagggaagcgacctggcgaatcgcaagctgctcctggttttccacggattgcacgcgcgaagtatcggccagcatgatgcttaccggcgcgtcggcgatttcaatgccgttgcgggtcaatcgcacggtgtccgtgctgatcgagaaatgcgtgagattgtctttctgcaacacgtgcagggcttcgacgacctcaccaagaatggaacggatcgcggtgaagctcagcggcttgctggactgcgtgagatactcgctcaacgacatgccggcatcgagctgcgtgatcaccaacgccacctcgcccacgtgctgaagctgcagcacctgcgtgaaatgggcgtcgtgggaaatcgccagcatggaggccgtcgcattgacgtcctgcaaagccttgcggttgttgacgataaaaagctggcaatcccgggcaagcacgtgatcgcttgccttccaaacctgcaagccggtttcctcgcgcaatggcgaaaccagcacatagcggttgctgatggtatctcccagttgaggtttcatggtttccttcaactctgtaacgattgttctacctacgctgttattcttggtcgccgttttcggcggtactttgctcaagtttaccgttggggctggccgttccgccagacttaggcttgttgccaagccctggtatgcgggcggcgagcatgcccacgaccgaagtgagctcctcggcacgcagcgcccacaggcacgccagatagacgatggcgatgacgatggtgagcagtatcgcggacagaaccgcctgaccccagttcatagtgccgtcgtcggggccgatatgcgctccgaccagccggtagacgccgttgcggcacagcaggccaatcacgcaggcggctatcgtggccaccagcgccttcgcataggcggtgatgatgcgcttgtcgtccacatcgccgtcgaaacgggagcggagcatgtgcgtaagcagcggatacggcaggatgaagctcaccgaaatcgccaatccgatgacggtgatccactgcgtgggcggcagaatgaacgtcgacgcgatgatgacgccaccctggatggccatggtgatcgccatgaaaataaacggatgcttgccgtcttcgaacgcgtagaacgtgcgttggatgaccaaatacgagctggaaagtggcaggccgatgcccaaagcggcgagcggcgcgctgatgagcagcgcctcacgcgcgctgatggacggcagcagtgcgaggatgatcggcaacggaagcacgatgaacgcagctgcgaagaagcacatgatgagattgagattacgcagggccgagctcagatccttgcgcgcctcgtcgatattgcggtccgcgatggctttcgatattttcgggaagatcgcagtggcgatggacacggcgatcagcgaatacggcagcatgtagatggtgtacgcattctgatacgaggcgttgccggccacgtccaactggctcatatgcagctgttccgaagccttgaacggcgcgctggtggccacgcgggtgacgatgatgttgacgatctgatcgacgccgacgatgccgaggctccacgcggcgaccggtcccatcgaacgcagtccgatgccgtgaacgccgaatttcggacggtatttcaggccgattctcgtcaaaggaatgaacagcaccagcgcctggaacgccacgccaagcgtccaagtgccggcggtcagcgcgattttcgtcggcgtccagaagtccagcggacgttccgtggccctgccgaacatcgcgatgaacgcgccgaaaccgatgcagctgatgatgttcgcgccgaccgagctccacgcatacgtgacgaaatggtccttcgccgcgagaatctgcccgatcaccgtatacaggccgtagaagaagatctggggcatgcaccacaaggtgaaggaggtggcgagggccatggtttcggcgctgccgttgacatacagtttggtcaacaacggcgtggcaacggccatgagcagcgtcacacccaacaacagggtgatggcaagggtgatgagcttgttgagcttggtttcggcgtccttcgatttcagcgtgcgcacgatctgcggcacaagcaccgcgttgaagatgccgccggaaaccagtgtgtagatgacctgcggaatcatcgaaccggcctggtaggcgttggcggcatagccggtggtgcccaaggcccaggcaagcaggatggtgcggatttggccggtcacgcgcgaagcggcggtaccggaggccatgatcagtgagttacggccaacggaagaactcattcgtcgggatccttcttacggttgaattgacgccacagtcccacagcgcccaagagcacggcgaagccgatgatgacgaaaccgctcttgtcgctgatctgcagcgcgctggtgatgtgggtgacctgcgtggctccaaacgctgcaccattcctgtcgaacaggctgatggtggcgttggcggtgccggacgtggacacacggatggtgaacgccacctgtgcctcgccgtggggcggcacctgcacggtgtcgaatcgggacgtgacgatctgcatggaatcggtcagcgacgagaccttcacctttaccgggtacgggtggctgttgctgatggtcaccggcattttcgcggtttcgctgaccacgttcacgctttccgtcggcgtgatcgccacaccgttgatcagcagggccgcgagctggttcgcgccttccgccatcgtgcttctggaagggctttcgccgcccaacgcgtgcagggccatgatggtgtgggcgttcgtcagctgcctgctccaggtgttgacgtcggattcgtcttttccgttcggcttgacgaggatcgacatattgaaacgtttgatgttgctcgatgagttcgccagcgcgctcagagtctgctggacgtcgctgcgcatgccatcggtaaggccgtccgtttggggaaggtcggttgacatgctggccgcatcttcggagatgtcggcatccttcaacgtggcgagatcggtgaggttcagccacggcgactgctcgatgtcgctcatcagcgcgtccacaacactggggtcggaatcctcgttcagacagaccagcaggttgcgttccgcataaggctgttccatctggtagaacgcgctttgcgcgacgaatcgcgccaatctgccggccgtggttccctcgctgtcggcgttggcatcgtcactggtcgccttgccttgggccaggccggaaagcacattctgcgcggaaagcacggtgatgtccccgacatcggtggagaccaccgtcttgccggtacgtacggtagccgcatcgtcctcttcgaagtcatgcgtggcgatgacggtgccgtacccctgctggcgggccttcgtcaacgcttgtagggtccaattgccgttgccctgccacgcgtatgcggtgatgtccgcgttgctgtcacccaatgccgattgataggttttccgggctttggctgcggaccattgacggtcgttgataccggctgcgctgtaggccggagcgttgttcatggcgctgtaggcggtcatgtcgaacaatgcgggctgggtgatgccgtcgacccgcgttggcatcgccatcgcctgcaggtaggtcggatcgcctacgacctgcagcatgtcgtgcttggcgaaggtctgctgcaacgatttgagccgtgcgtcgtcatccttgctgggcatggcgattttcgccagtttcgaggaggaaatacccccttcatcgaccagctgtccaagcagcttgctgtcggtggtccacccgttggcggccagcggctgggcgacggtgatgtgcagcgccggcgtgctgggcgtgtggagtcccgcgccggtgcgcgtcacgaacgtatgcgattgagcaaggggggttccgttggcggaatagctcagcagcaccggcttcggcccccaagagttgatggccgcgagcgattcctgatgggcgtccgcgtcgatgctcacgttggcgctggctcccggctgcaacgcgggcacatcggcctgtcccacggattgcggggtggggattcgcccgttgccttcagaccaatcctggatgtcgttgcgcgaaacgaacgtgtagaaggcgttcatggccagcgtcagcgttcccgcgggaatctcctgtccggtcgtgttggtcaccgtggcgttcagatggtatccggaggtgtccgtcaatacggccgtggaagagttgatggacaacataccgtccgtcgactccgccgatgtggtcgattccatggcccttgccgatggcgtgggtgcgtataacaacatcaacgccatggtcaataccatggcgaggatggatgataacgcgcgaaggccacgcgaaacgtgccgttgtgcggattgattcactattacgcctgtctgttgagtttccttgcgtacaaccatgctatcttccgttcgttcggatagctcagcacatcgtccaaatcagcaaaatccacccaaatggcgtcttcggcctcatggtcgggatcgccttcgacggtcagctcgccgccgatctgccgcaacgcgaagtggtgcaccagcttgtgcacgcgttggctggtaccggtgaaccaatagtcgatggtggcgatggaatcgaccacctcgcccagaatgccggtttcctcatgcacttcgcgcacggccgtctgctgcggcgtttcgcctttttcgatatgtcccttcggcaggcaccattccaaatgcccgctgcgtgaatgacgtgcgatgatcgccacgcgacccttgtcgtcgaacaccagcccgcccgccgaatactcgcgcaccaccggcagctcctgcgcgtcaagcgatgcgaacgtggtcggaccatccgcggtgcgccggcgcggcatcatcgccggcgtaggcgcgctcggcgtgatgatcgtgcgctgctgcaattgctgtagttgttgcagctgctgcagcgaaaccgactgcgatgtgtacagcagttcgtccggttccagcggattttgggcatggtcgtccgcagcatgggcaagcatgcgtgcaaggtctgcgggcgtaatcatgattccaaccatactcaattctgtgtgcaggtggggtaacggtatgctggtaaacggaaaacttgtggtgctgaaaggtatggcgtgaacttcgaagtgtggccagaggccattgaattaggacgtatgtttgctgcggaaggctatgaactggcactggtcgggggtcctgtccgcgacctgctgctgcatcgcaaatcgcatgatttggatttctgcacatcggcgcgtcccgagcagtttgagcatattctgcgccgttttgggcatgatggcttctgggatatgggccgcaaattcggcacgctcggcgcgatgcgcaggcgtgaggacggcaccgaggtgaaagtggaggtgaccacctaccgttccgacacgtacgaccccgactcgcgcaagccggaagtcaattacggcgacacgctggaaggcgatctttcccgccgcgatttcaccgtcaacgcgatggcgttgcgtgttccggaactcgaattcgtcgatccgttcggcggtgcgaacgatttggccaaaggcgtgctgcgtacccccgtcgatccgcggcagtcgttcgacgacgatccgttgcgcatgatgcgcgccgtgcgtttcgtggcgcagctcggcttccgcatcgagccggaaaccgccgaagcgctgtccgacatggtcgatcgcatcgaaatcgtctccgccgaacgtgtgcgcgacgaactggtcaagctgctgctgtccgatcgcccgcgcgccggcatcgaagcgttggtcgattccggtcttgccgacatcgtgctgccggaaattcccgcgctgcagctggaaatcgacgagcaccatcgccataaggacgtgttcgaacacaccatgatcgtcatcgaacgcgccgtcgccctcgaaaccggttccgacggtccggtgccggccccggacctgacgctgcgtctggcggctctgctgcacgacatcggcaagccgaagacccgtcgtttcgaagcgggcggcaaggtgagcttccaccgtcatgacgccgtcggcgcgaagatgacgcgcaagcgtttgaaggcactgcatttcgaccaccacatggtcgaggacgtcagcgagctggtcaacctgcatctgcgcttccacggctacgtggaggagccgtggacggattccgcggtccgccgctacgtcaaggacgctggcccgctgtacgagcgtctgaaccgccttacgcgcgccgacacgaccacgcagaacaagcgcaaggccatgatgttctcggcggccatggacgagatggaacagcgtgtacgcgacctgaaagaaaaggaagacttcgacgcgatccgtcctgacctcaacggcgacgagatcatgcagctgctcagcatcgaaccaggcccgatggtcggcaaggcgtacaagcacatgctggaataccgcctcgataacggtccggtggagcgtgacgtggccgttgccgagctggaacgctggtacaaggagcagggcgaatagcgattgacatgcggtggtttcgccgcatgcatggaacagtgtgcttggaacagctcgaatacgaaaacccgcgttcccgattgggggagcgcgggtttttcatattgcctatatcgatttcgattggcggtcagctttgcggattcaccgcatcatgctcgggcgccttgggcaggtcggtcatcttgtccaccgcgacgcagccctggatgccggtgatcgccttgcctgcggcgggaaccttcttcgtatcctgcagattgtcgaatgtggcgcccacgatgacgtcgatcagctggtcctgacggtcgtccataaccagcatggcgtcggtgaaattgcttgccacggtgtacgcctgattcacgccgttcttgccgaagacgatcatcgtgcgatccaccttcttggtgtagttgtccggcgtctgggggttgaactcgcggttctgcaacgcgtcgctcaccgccttggcgaagccggagaacttcgtgccgttgagcacacgcagcgtgatgttgcgattctccacatacttggccttgttgccgtcggcttccttgatggggcacggtgcctgctggccgtagttcggctgtacggcggccgacttgacgttgcccaggcctccgacatggaaaaagaacagcagggacaccaccatggcgaccaccatgacggctccgacgatgctgaacaccgtcttctgacggcggcgaatgtactctttgcgcgcggcgcgctcgtcgttagcctgggtcatttacgaattccttttgaacaaaccaattgccatcaactttactgtcatgcggtgatatgtgtcatgcggtgatatgtacaatcggtcgggctggggcgttcgtggcgatgatgcgatcgacgcaacggctgtcctgccatgcccgctgcacggcgtccgccgcatcctccgtcggcacgaacgcgatgacggatgggccggaaccggagacgaacgcctggctggctcccgcacgcaaggcttcctcgatcgcctgtccgctacgcggatgcagggagaccgccgccttctgcaggtggttctcatcgccatcgccggcaccgatctgatcgaatgtggcatacacttccggcgtgcgcagttccgcacggtatgcgccgaccagcagatggccggtaaacccacgttccgtaagatcgcgtacgatatcgccatcgtcatcaagctgttcgatgcgttcgccgaaaccggtgccgcgcgcgtaaccgccggtcagacagaacggcatgtccgcgcccagcgtggccgcgacttcctgcaggcgttcgatcggccaatcgagatcccacaacgtgttcaatgccagaatcgtcgccgccgcatcggcggaaccgccggccatgcccgcgccgacggggatgcgcttgtcgatgttcaacgccacgtccggctcatggccgctcgcttcggccatggcgaacaatgccagcacggcatggttgcggcgcatatcgctgccggaagaggccaggtcgcccagatacgcgccctcgagattcagcgagaagccgcttcccggcgctttgcgcgtggcggtgacggtgtcgtatacgccgaccgcgcaatagatggtgtcgagttcatgacggccgccccattcggcatgcgacgggcccacatgcagggtcagattcgttttcgccgggcagtccacgctcacggcgttgatggtggccgttccgatggcgggcgaatcaatggtgctcatgacgcgaacacctcatccaacgcgcgtgccaacgccacgaattcgtcgatggtgagcgtctcgccacgacgggtcgggtcgatgccggccttctcgaacgcttcggacggcacgattttcttcaatgcggcgtgcagggtcttgcggcgctgcccgaaagccgcgtcgatcaaacggaacacggtttcgcgatccaccacggaaccgtccgcattgtccgcggcgggggtgtgaccgcccgggtagcgcttgaacagcaccagcgcggaatcgacgttcggggccggccagaacacgttgcggccgatgacgcccacgcgttccgcggtgccgtaccatgcgagcttcacgctcggcgtgccgtagatcttcgaaccgggcttctcgctcaaacggtccgccacttccttctgcaccatcaccaggaaggtgcccagattgtcgaaacgttccaacagggtgagcagaatcggcgtggccacgttgtacggcagattggccaccagcgtgaaggaatcgtcatccttgaaatcgggcagattctccggattgacggtaagtgcgtcgcggttgaccacacggaagcggtccacggcgtccggcatgaattcggcgatggttttcggcaggcgttcggcgaccggcgggtcgatttccacagccgtcatcgtggcgccggtttccagaatcgccagcgtcagcgaacccagtccgggaccgacttccagcacatggtcgtcggcggtcacgccggcctcgcgcacgatgcgacgcacggttcccggatcaatcacgaaattctgcccgaatttcttcgtcgggctgatacccgcgtcggcggcgatgcgtcggatgtcggccgcccccagcaaatggccctgcgtatgctcgttcacgttttccgtcattccctcttctgtcattccctcattatccgttcatgccggtacgaaaatcgttggcgattagccggatcagtaccatccggtctgttcggagtgctgccacgccgcggacgggctgccgtaccgctgtgcgatgtagctcagaccccagtcgatctgcacggcggcatcgtccttccaattcgcgccgaacgtggccattttgctgcccggcaacgcttgtggaataccgtatgcgcccgaatacacgttttccgcgctccagctccatccggattcgcgattccagagtttgaccagatccgtccagttctggccggtccagccgcgctgcgccgccgcgccggaagcgtaggcctgtgcctgtgccgcggaaggatggtacaagcggcagcctgcggaaggattgctcggctgcggcgtgggctgcggtttgggctggggtgcgggagtcggctgcggtgcaggggttggtgtgggggtcggtgccggatcgtccttctcggtgttgttggaattgttattcgagttgttgttcgaattgttcttatccgaggaatccgacttgttcgaatcggttttgtcggaatcggacttgttcgaatcggacttattgtcgtttttattcgagtcgttcttacccgaatcgttcttgccgtcgtccgtcttgccggaatcgccgttatcgccgttgctgttgccgttgccgctgttgtcggatttgtcggacttgtcggtatcgtccgtagttttttccggtccgaccgcaatgactttgtcgatggcgattttcgtggtcttctctccggtcagcgtctcgctttccttcacgccatccacgtaggtgacggcatacgtctgctggatttcgccgttttcgccttcctgccgtaccgtgacttcgcccggctgcaggttcgggtcgatgatggtctgcgtgccgaacggcacttccttcgtgcgggtctcctcaccatgcgtcacgcggcggacgcgcagaatggtcgtcttgccgtccttttcgacactgacgcgatcctccttgcccaacgtgatgcctttggcgtcaagaatggaggcagcgggcagcttgccgttcggcgccaccgagcttttcccgtccgcgatgacggtgacgggccccttctggttgatgatgagaccgccggtgagcttgttgtagacgttgctgatattgacggtgattttcgccgcttcggtttcgttttggttgaagaagtccagcaactgctcggcgctggacgcgaccgtccagaacggcacttcctggccgtcgatggtgatggtggtctggtatgcgctctgcacgttcaccacatcatggttcttcagcatgctggtcgggctggtcgattccaccaggtcgtgcgttttgactttcacgccctgctcctgcagcagacggtccacgctcatcgcatatgtggtcaccgtggtggtctccccattgacggtcaacgccacggatttgcgcgcgcccacaccaaacgccaacgccgaagtcaaagtcaatgaggccacgcatgccatgacgcggacacgacgaagcgtcacgaatctccgaggggtccaccttctcgtcatttatcctcttttcagcgctgcctacaacgccgttattgtaacggctcagctggaacggtcgccgtgctttccgatggttttatccataccgccacatttttgaaagcaggtgcgaaaagcgaaaaataaaaagggggcaggagagaagtggatgtcctgcccccggtcggacgagacaggttgggggacgtctcgtccgctttgccagaagtctcaagttgggggaagacttctggagcacttacccatggtaagaggtccaagcccgtcatacgggttcgagcctcctgtcgggatcgaaccgacgacctgccgcttacaaggcggccgctctggccatctgagctaaggaggcatgtcctcttttgctatgaaaacaacagaggaacgatgaatagcataaccagcgcttccaccgcagtcaacttagcattgcgggttgagacgcgccggctgcccgtaaggggttattcgcccgtggtgacggaaatcggccccttcttggctccgatggacggcatcttgccggcaacgccgacttcgctgtccttcaggccgatcgattccaacagaccgtccttaaccgtcgtctgggcggtggtcagctggtccatatcccaatacttgccgttgatgatcacggtcggcgtggtcatgctgcccttgtagctgccggactgatgccacagttcggaacgcttcggcgtgtaagtgtcgatcgcatcaagccattcctgataatcgcggccaaacgccttgtccgcaacatccttggaaacacccgcggcgatcatctgctccttgatcttggcgtcgctcaccgacttgtatgcggagccttcctccggctggaaatcctcggcgtagaccttctccaggaaggagatcagatggttcgggtcgctgtcatgctcggccaggtagatggccgcgttcgccgcgcgactggaatactcgtcggtggaccaacggtccatgaacgccatgaaatgcaggtccagattgatctggccggcatcgaccatcttctgcaggtcggcgtccaactggcggtgcaggttgccgcagcccgggcacaggaaatccatgtagagctcgacggtcggcgcgccctccacagccttgccgtagccgttcttggaaatcagcaggccgcccttcttatcgacgagcttcggagtgttcttcactttctgcaacgccgtgtacgcttcctgcacggtttcggtggaagccttcgtttcggccttcttatgcatgttgtggtacacggtgaacgcgccgatcgccaccagaatcaccagcaccgccaccacgatgccgccgatgatcgtctgctgcttgcgttccttctccatctgctcggcgcgcgccttcatcgctgcggcctcagcggccctacgctcggcgcggctggtacgcttctgcgcatccttgctgttctgggccatcgatattcctttcgacctcacgttgttatgctgggcaccatactagcgatgccttgctatcgattcgccgggaattccgtattgccttgcgattgcgtcggcagctcgctcaagtggcgcagatacggctgtttacgcagtgcgccgccgcccaatcgcagtacgatcgcgcccggagcggccacggccacaagccagccgatcgcgcagaacgcagcctgcgccagcccgctttcggaaagcggaccgccaagcagcgtcggcatcggaatcgtcaatccaaatatccacgtatccatcacggcatacggaagctgcagcacgaccgtggtgagcgacaaacccagcgcggccacggccaacatgatcagcgtccgcacgatggcgacgccgaagcccttcacgatgtgccagggcagtcccgccaatcgcagcagccagtcggaacttttcttctcgccgccacgtttgccttcgcgctcgagctgcgcctccgtgttgaatccgatggtggccagcgcacaggcgaacagcaacgcggctgccatcgccgtccacagtgagaacagtccgcagacggccacgggaatcgccatcagcgcgcaggggagcatgccccggcccaacatcgcgccacgcttcacatcggcgggattgggtgcttccgcaacgttcggcccatccataccgggtaccggcgggaatgacattgcgggcgattgctgcgccgcggccaccgtggcctgcggtatgacggacggtggctgccgcatggcgatgcgttgcaacgcgggtttgatggtcgggtcgacttgcgtcggcgcttccgctggattccatgcgttctgggccggcagcatttgtgttgacggcatggattgcggcattacctgcgtgcctgtcggcatcgcccgcgtgctgcccacgttgggaagtgcgtcggaaagcacgctggtctcggcatcgtcaacaggtgcgatcacctgcgttgcgctcgcgtcggattggctggtcacttgtttcccgattacttgagttgcgctcacatcgggctgcccgatcgcctgcgttgcttcgctgagccttggcatcgtgcgcgtgccgatggcgttttcgccggttatgtcgtcctgcgattgccacaacgtgcgcggattgtcgggcgattcaacaaaagggggcatcgcctccgtatcgccatccgctgcgccaccattgtcggccgcaacccacgcctgcggattcaacgcatccacggcgatcgcctgcagcaaatcgtccggcgtgcaccgcttcgtccgatccggattgagcgccgaacggaacgcggccatcgtgcccgcgggaagtcccgcaagattggcgctgccggccgcggcgcgttccaacacggtcatcatcggcttcgtgccgaacaccggctcacccgtagcggcgaacgccaatacgctcgccaccgaccaccaatcggtcatttcatccgattccgcgccatcaatgatttccggcgcgatgaaccccggcgtgcccatcaccagaccggtacgcgtcacatggctttcgccttcgcccatagcgatgccgaaatccaccaataccgggccggtgctcgacaccatcacattcgtcggcttgatatcgcggtgcacgatgccggccgcatgcacggcacgcaccgcctcaatcagcttgcgtgccagccgttccaaatcgtcgcccacatatcggccattgacgcgcacatcctcacgcagattcttgccttcgatcaactcggtcacaataaaagccaacgcgtcgtcaagttccatatccacaatgccgcacacgcccggatgccgcaccttctgcaacgccatcgcctccctgcgcaggcgctcgcgtgcggtcaactcgtcgcgctgctgctgcggggaatcgtcgtcggagagggaatcgcgcaaaatcttcatcgcatattgatggccgccatcgtcccgcacacgccataccgagcccatggcacccgaaccaagccgggaaatcaacgtgtagccgccaaccaggctgcctgcttccagattcaatgcgcttaagtcgctcatacttccatcgtacttggcgtgcagattatgcacgcgaattgacaggctggggaaaacgccatgtgccgcacgttgaagtctgatgaaatcgaatcatcgacatgaagaagtgtcttcacttgccgcacgcatctgcagccacttcaccgaaaccatgagatgcggggcagtgttgaatggtttcgcggttccgataaaggcatcggagcctacgtgtcgtttggttatgagaatcaaggaggaggcagaccatgctgcaaatcaacatggctgacgttatgaacgtcatcggctcattgacgccgtaccttattgcgattggcgtgctgttcgcgctcgcgctgattatcacttttgccgtcaacaagaagacggtcaaggaagtggcgacccgtaagatcgtccattccgaatcctggctggtggcgcttgtcggcatcgtcgtggccgtgtccatgatgctgaccggcccgctttccacgctgctcaacaacgcgaccaccaccaagtacatgctgtccgacaccaccgtttccaaagccaacgagctggccaaggaagtgcagtcggaagccatcaccatgctgaagaacgacgattccaacctgccgctgtccaacaagaaggtcaacgtgttcggttggggctccaccaacccggtttacggcggcaccggctccggctccatgtccgaccagtacgagaccgtttccatgcttgacggcatgaagcaggccggcatcgaaaccaattccgagctgaccaagctgtacaccgactaccgcaaggaccgcccgatggtggctatgtggtcgcaggattggaccctgcctgaggttccggccaagcagtattccgacaagctgatctccgacgccaaggacttctccgacgaagccgtcatcaccatcacccgcgtcggcggcgaaggcgctgacctgccgacgaacatgaaggcgaagggcatcacctacaacaacaattccaaggactacgaagatttcaaggatggcgagcacttcctgcagctgtcccagaccgagcgcgacatgatcgacctggtcaccaagaacttcaagaaggtgacgctcgtctacaacggcgccaacgcgttccagttcgacttcctgtcccagtatccgcagatcaagtccgtgctgtggtgcccgccggccggccagaccggcttctccgcactgggtgaggtgctcgccggcgatgtgaatccgtccggcaagacctccgacacgttcgcgaaggacctgaccaagaccgctgtgttcaacaacaccgatggcaccgccgccggcaacgcttcgtccgtcggcacgaacggcaagttcacttacgacaatgcggatgatctcgctgcttcctacatgggcttcagtggcgacaaggtcacggtgaccccgacgttcgtcaactacgtcgaaggcatctacgttggctacaagttctatgagaccgccgccgacgaaggtctgatcaactacgacgacaccgtcatgttcccgttcggctacggcctgtcctacacgacgttcaagcaggagatgggcaaggtctcctacaagaacggcaagatctcgttcgatgtgaccgtcaccaacaccggcgataaggccggcaaggacgtggtcgaggtctactacaacccgccgtacaccgatggcggcatcgagaaggcatccaagaacctggttgcgttcgaaaagaccaagaagctcgagccgggcgcttcccagaccgtgaagatcgagttcgacgatgacgacatggcctcctacgaccagaaggacgctaaggcgtacgtgctggagcagggcgattacgacatctccatccagtccgattcgcaccacgtgatcgaccatcagaaggtcaccgtgaaggacgccgtcacctacgattccgactcgaacacccataacggcgatgccgtggccgccaccaacgagttcgattacgccgccggcgacgtgacgtacctgtctcgcgcgggccacttcgcgaactatgccaaggccaccgccgctccgaccaacttctcgatgagcgacgaagccaaggccgagttcaccaacaacagcaactacgatccgaagaagtatgacaacgattcggacgagatgccgaccaccggtgccaagaatggcctgaagctgtaccagatgtatggcaaggattatgacgacgccgattgggacaagctgctcgaccagctcaccttcgacgatatggacaacctgatcgccaatggtggttacggcactccggctgtgaagtccgtcggcaagatccagctgaccgacgccgacggcccggcctcgctgaacaacaacttcaccggtgttggctccatcggcttcccggcctccaccgcgttcgcctgcacctggaaccgtgatctcgccaagcagttcggtgagatgatcggcgacatggctcacgacatgcacgtggctggttggtacgctccggccatgaacatccaccgttcggcattctccggtcgtaccttcgagtacttctccgaggactccctgctctccggtgcgatggcctccaacgaaatcgccggcgccaagtccaagggcgtgtactccttcatgaagcacttcgcactcaacgaccaggagaccaaccgcaccaacatggtgtgcacgtgggccaacgagcagtccatccgtgaaacctatctgaagccgttcgagatgagcgtgaaggaaggcggcgcccaggccgtgatgagctccttcaactacatcggctacacctacgccggcgcttccagcaacctgctgcagaccgtgctgcgcggcgagtggggcttcaagggcttcgtcctgaccgattacttcggcggctacggctaccagaacgccgatcaggaagtgcgtgcgggcaacgattcgatgcttgccaccacgaagatcaccaaccacatcaccgataagtccgccacttccgtgaaggccatgcgtcaggccgcgcacaacatcctgtacacggctgccaacagctggcagtacgcgaatggcgagccgaaggtcgccaccccgatctggaagaccgccatgtacgtggcttggggcgtgaccgcggtgctcgtgatcggcctggagattgtggccatcaagcggtacctgaaccgcaagaaggctgtcgccacggtcgagtcggctgcagaaccggttgccgccggcccggccaatgccgagtgagctgcctgatcagcgataactgaagtaataactgaaaacagtcggctacaggcagcattagcaatggtcagcgattcgaatgaccaaagctgaatatccagtagccgaacaacaaagccgggagtctccgctaaccacggagcttccggcttttgttatgcgagaaccgtggttggaccgcaaaatgcggatgtggttgaccatgttgatggtcgacacgccgacagctattggttttgcgttcacctggttgtggttttcggggtctattctgatggtatcggcgctttccggacgcattttcccggttttcgacacgccgatggaacgttggatttccaacggttccgtgcttcattgcgccctgcgggttgcgcgattgcgggttctcgtgtaagtttatctcttgctgctcagcacggcggcctcgctcctggagattggggcggcttgctggtgcggtggtggtttgagaactcaagagcgtatttgtactacttctttatagtcaatgaattagacagtccgatgagggacgaatgacatgagattggaggccgacgatggccggcccggaacatccccgccaccacgacgaggcgttcaaacggcagatcgtgcagtcgtgcgagagcggcaagccatcccgggagatcagggccgggcacgacatcgcgcgatcgaccccgcggcgccgggtccggggcatccgcgacagcggctccgcccgggccgcggacaaccgcacgcccgggcggaacgagccggtcgagccggggaggcgcgaccgacagttggagatggaggtggacgtttcagaacaggcggcgccggtattcgcacgaaggcaggcgtgatacgggccaacgccgcccgctacccgatatcggcgcgatgcgggataccgggcgttccccgctccgcctgctactggatgaccgggcatcccgaagccgagcgtgcggatccgatccccggcgacgtgcgcgcggtccggcgcgacggccgcgaacgctacggcgccaggaagatcaaggccgccctggaaaggaaggggtgtcaccgcgtccaggagacgcatcggcaacatcatgcgcgaacagggcatgacgagcgcgtacgcgcgcggacggtccgaaccgcacaggacgcgggccgacgaggccaggctcgcgaacctgctggaccgcgggttcgacggctacgccccgcacacgcatctggcgggcgatcttacctatgtccgcgtcggcggagactgggcgtacgtgtgcctgccggtcggcctggcgaacaggggcatcgtcggccattccgccgggcggacccgggacgcgagcctggtattgggcgcgttcgccaccctcggcttcccgctgacggacgtccaggaaacaggggtttgccggccggaagggtccgcaggcccctcttcccgtattctgacgttaggagacaacagcatgcaggcggatcgtgtgagagagacggaacgaatcaacgacgcgttcctcgaggaggtcgtgccattcgcggtgcacggcgccacaatcgtcgacgcgcgtggaatgacgaaaaacggttggctcgtttccgacggacggtcgatagtcgaaacgggatgcgccgaaacggacttcgaaacggcctgccggctggtccacgtcgagcaagatcatattgttaacgctaacggaatggtgatgacgcccggatacgtcgacatccactcgcacggcgcatggggaagctcgttcgatgacggcgagaaggggatcacgaccgcccgagccggacacatggcgcacggaacgacgagacaggtcctgagcctcatcaccaatcccatcgacgtcatctgcggtaacttgaagacggtccacgacatgatgccggaccgcccggatattctgggcgcgcacctcgaaggaccgttcctcgccatgccccggaaaggcgcccatgatcccaattgcctagtcgatcccactccggatctcgtatccagaatgctggacgccgccgatgggtgtctcagacagatcaccatcgcgccggaacttccgcatggaatcgacgcaatccgccgtttcttcctagccggagtggttccggcggtcggccactgcgatgccgactaccagactgccagaaaaggattcgacgccggagccggaatcatgacccatatgttcaatgccatgaacgggctgcaccaccgcgaccccggcccgattccggcggcagtggaggatccgagggtcaccatcgagcttatcaacgacggattccacgtgcaggatcccatggtcaagctcggattcgggcttgcgccccatagaatcgccttcgtcaccgacgccatggccgcgaccgactgtccggacgggcattacctcctcggggctctggatgtagatgtgcgggacggtcatgccagactcgcctccaatggagccatcgccggttctacactgctattggaaaaggccgtgtctcgcgcggtgctggagctcggcatcagtccggtcgacgcggtggaagcggcgacgctgacccctgcgcgggcatttggcttcgaccgtcgaaatgacgtgacaggcttcccgatcggtctgctcgctccgggattcgcggccgacgtgctgctccttgatcaggaaacctggacggtgcgacgcgtctggtgcaacgggcatccggtgagataattgatttcaaggttcaatgacgaacgaaaggaacaatgacaatgaaccaacgtagagaacatcgttggcctcggccgttggagggccggcgggcccgtatctggtacggcggcgactacaatcccgaccagtggcccgaggaggtctgggacgaggacgtgcgcctcatggtcaaggcgggagtgaacctcgtatccgtgggcatcttctcctgggcgaaaatcgaaccccgcgaggacgtgtacgatttcggctggctcgaccgaatcatcgacaatctcggcaaggccggcatcgccgtagatctcgcttccgcgaccgcatccccgccgatgtggctgacccaggcgcatcccgaggtgctgtggaaggactaccgcggtgacgtgtgccagccgggcgcgcgccagcactggcgtcccaccagtcctgtgttctgtgagtacgcattgaagctctgccgggcgatggcggagcattacaaggacaatccctatgtggtcgcttggcacgttggtaacgagtacggatgccacaaccgcttcgactattccgaggacgccgaacgcgcgttccaagactggtgcgaggaacggtacggcacgatcgaagcggcgaacgacgcatggggtactgcgttctgggcccagcatctgaacgatttcagcgaaatcgttccgcctcgattcatcggcgacggcaatttcatgaaccccggcaagctgctcgacttcaaacgcttcagctccgacgcgctgaagtcattctatgtggccgaacgtgacgcattggccgaaatcacaccagaaaagccgttgaccacgaatttcatggtctccgccggcggttccgtactggattacgacgattggggcggcgaggtcgatttcgtgtcgaacgaccattacttcattccgggcgaggcgcatctggacgagctcgcgttctcggcttcgttggtggacggcatctcccgcaaggatccgtggttcctgatggagcattccacctcggccgtgaactggagaccgatcaactatcgcaaggaacccggccagctggtgcgcgattccttggcgcacgtggccatgggagccgatgccgtgtgctacttccagtggcgccaatctaggtccggcgcggagaagttccattccgcgatgctgccgcatgcgggggaggattcccagacgttccgggacgtgtgcgaactgggccgtgatctgggcatgcttacggatgagggactgctcggcaccaagctggcgaaatccagcgtggccatcgtgttcgattacgagtccgaatgggcgagcgagcacaccgcgaccccgacgcagaacgtccatcatgtcgacgagccgctcgcatggttccgcgctctggcggacgtcggcgtgaccgcggacgtcgttccaatccgttcgaactgggacgagtacgatgtcgcgatactgccgagcgtgtacatcctctccgaggagaacacccgtagggtgagggactacgtcgcgaacggcggcaagctcatcgccacgtactatacaggcatcagcgacgaacgggaccatgtgtggctcggcggttacccaggttccatccgggacgtcgtcggtgtgaggatcgaggagttcgcccctatgggatccgattggcccggagttccggaccacctcgatctcgacaacggagccgtcgcacacgacatcgtcgacgtgatcggctcaatcgggaaggacgcgaaggtgctcgcctcgttcaaggatgacccatggaccggtatggacggacgcccggccatcgtgtccaatccatatggcgaagggcgtagcgtctacgtcggagcccggctgggacgtgacggcatcgccagaagcctgccgatgatcctcgagacccttggtgtggaagtcaaagactcctcggatccggacttgcttcgcatcgagcgcgtcgatgagtcgacgggggctcggttcacgttcctgttcaaccggaccaaagaacctgtcagcatgctggtggagggacgcccggtcgtcatgtcactggccgactgtgctggcgcgacggttaccatcaatcccaatggcgtactcgtcgtcaaacaataatggctcattaatgaggcgatatgccatgtgaacgttcacatggcatatcgcctttcttacgacagatggcatcgtcgtttttgatgatatgttcacaatatgttgtgttatatcgtatgacaacacttaagttaagtcaggcatgtcttttgccctaccagcttctctgcgtgtggcattctcctcgcctctacagacgtggagaatgccacaaaaggataatatccagtagaccgctaacgataaatatggccgagctgttcttcgttgtcgaataacggttgtgattgttgcttaatgttcggctgtgggattggcggttcgtgctctatggcttttttcttgcgtggctttggttgtttgtcatcatcataacgatcatcactccccagcacgttcgcttctcgtcaatgtatttgtatgcgattgcatggaatttagatgggattccatcgatagtgatagtgcaagacctttttttggcggttgcctttgccttgatttggccaatgttgccgactgggacgatccaccacgtattatgcatttcggatttcgatttgatgaggcgtgtcattctttcaagattttttaggcgaggattcccccgcctaaaaaatcttgaaatcgcaggagatctgcatgtaggtgccaggaaaacgctcatcctcgcgcagatgctatgcgaacagctgattcccacgttcataggactcgtcatggcatattcggcactgttcattctcatcggcacgatgaatccaaccccgtccgactcacttgccattttcctcctggagctgcatgacggtctgccgttgccgtgcgccacggccatgggaacggcgatcgcagtcatactgattcgtgaaaaagacctgttccgcttgttcaagaccagatgaatcggacatataccggtggaacgaatcgccattggaggatcaagttcgtgtgatgtcgtagaccataagtcatcagttaagcgttgtgtgacaattccatacaacgctttcttcatcgccgtacaccctttatggcgaagtcgaaggatagccacgggaagacgaggacacgtgaaccggtccgcataagcaaagcccagaggcaaagcatccgcccatctgtcccatcgaaaccgtccagtttgattctgtcgtgtccgccgacgaatcatcggcgcaatgcgcatcgaaacatatcccgtcaggaccttctgctgtgagggacacgaaggtctgacgggatatgccggatccgttaaggttggatccgacggagcaatcgctggcgttcattccggtcgcttcatccgggatacgcctggcgtcctccatcttgcgatgcaccattcgatgcgttttggctccaatcaggaacgaatcgagatctgccctacagacaatttccgtggattgactccacctaatgtgacgacgcacgcgttcgacttcgaaccgatgggaaacgtgcgatgcggacatcgcgcactttcccgatctcgtccggaacccgaaggcgcacagctttcttaagtgaaaatcgctcctgaaatggagccaaaggagttcccctttaaactgccttgaccattatctctcttttgattgtttgtaaaactcgtattgtggaagtggcgaaggccatgcttccttgcccgtctccattgcgggagaagatataagatcccgataaggtccttttatagacaaaaaccggttctttcgtcaatcccgaagcgcatccattggaatgccgttgtaggccaagtcaaaacgccggggttgaaaagaaaaaaggtgccgcaccattattcccacggaatctggtacggcaccttttcttttgaaaggaaacagaagaagtctttgcgccttacttgttgatgaccttcttgaacaggtcggaggatgccttggcgagggcgaactggccgaagcccggatccatggaggcgaggttggagttgaggatctggttgaaagtgtcgttctgcatgttcattccttttccgcggcgctttgtcttccgttcgccgctattcttttttctcttgtttcgttatgccttgattgtaggcatgtcatccccgtcgccgcatgtcattccgattgattcttttgtatattcatcggtttgccagaagatttttgaaataacttaccgcaccattaccatcacataaaccaagaaggccccgacatggtcggggccttcttggtgaaaaagggaaggagtggcaagtattggtatttattcggtcagggttttggcctcctcatcgatggcttcgacagtctcggcggtctgagcttcgtcatcgacgatttcgccggaggcaagcttggcttcgagctctttgacaatcttagcatgcatcttctcgtcgatcttgaccttgaacatgaacaccagcaggctgagcacgatcagaataagcggcacatagaaggcgcagatttcgaaggtgtggatgttggagggggtcatatcggccgcggtggcgttgccggtcatgccagcagcgacggcgatgaagccggtgatgccgttggacagcgcgccgccaatcttatcaagcatcggacgtacggacagggtgacggcctcgttgcgcttgccgttcttcagctggccgtattcgatggagtcggtcagggagaggatggcggtcatctggatgagggtgcccgggatgtagaagagcacgagggcgatgaacaccacggtcatgttggtggagaagagacccagcaggatgtaggccacgatcatggaggtcatgccgacgatgtacaggactcggcgtgggatgcgcttgttcaggatcgggtacagcggagccatgatgaggcctgccaccaaggcgatgacgccggtcatggagtaggcggcctggttgtcgagcacgaacttgaacaggaagaggagtacgccggtggtggccacgttggcgatggcgtacagcaggtaggacagggcgacccggaaaacaatcggctggggcccggttccatactccaacggaaccgggccccagccgtcctcatgacgaaaacaagacatatccgtaacttttctcaatcatgctatggaaaaagcaggataagcagcatgcaataaaaattccaagcaaaatattagttacttttacatcagcgcattttgcgtctcattcaagaaaatgcatttttttgtatatatttactatcagttttttatagttaactaattatgtagagtttttagaaattttgtgacaaatggaaaaatagcgatgtgtattagatctattcacccccgtctatgggaaatgaaatacttaaaagcgttctgcaaggatagaagagggtaaatggcgagcaatactaatagaaagtgcttacatgccagtagcggcttttatttagcaaatgcaatagatcagaagccgattcgcgtggctcaggttgtcggcaagatggtcggcggcggtgttgaatccgtagtgatgaactactatcggcatatcgaccgcagcaaagtacagtttgatttcctggttgatgaggattccacgtatgttcctgaagaggaaatcactgctttgggtggtcgcgtgtttcgtataccaccgtaccagcatccgattcgctaccgtcgtgagctgatttgtctgatgcgcgaacagcagtggccgattgtgcacagtaacatcaacacgctgagcgtattcccattgtcggcagcgaagaaagttggagtgcctattcgcatcgcgcattctcattcgaccatgggcaaaggtgagtttgcaaagaatgcaatgaagcttatgttgcgtccgttcgccaatgtgtatccgacagtccgttttgcgtgtagccactatgcaggagaatggttgttcgggaaaaatgcggattttactgtaattcccaatggcattgaattggataaattccagtttgatcctgtgattcgtcaagaaactcgcaaagaactcggtattgcggatgatacgtttctgattggtcatgttggtcgtttcatgccgcagaagaaccaggcattcctagttgatgtacttgcggatttgcttcctaaacgatctaataccatgcttgccttcgtcggtgatggtccggacaggctagccgtccaacaacatgccgtagaactcggtatcgctgatcatgtgctgttcctcggtcaacgctccgacgtgaaccgcctgtatcaggcgttcgatgtattctgcctccccagcctttatgagggtttggggatggtagctgtagaggctcaagtcgcaggtttgccttgcttgctgggggacgctgttcctttggaagcagatgtgaccactcaatcgcatttcctgcagattgccgatgtgaagccttggtctgaagctttatcgaatttgcctgtctcggattattccgaccaagttgatgtaacaagtacatctaaatttatacccatagactcgcatgaagaatggagttcttctatatcggcattgggaccggggacacggatcggttcttccgagaaagtgttctctgactatgatatttctgtgaatgctcgaaaactggcttcaatgtatttgaaactttttgagaagaaatgaaaagcaaaatggatccgctagtttcagttgtcatacctgtatataacgttgagtcttatctacatgaatgtgtgaaaagtgtggtcgaacagacttacacgaatattgaaattattcttgtggatgatggttcgactgataattcaggaacgttatgtgatgaatttgctttgtcggattcaagaatatgtgttttccataagaagaatggtggactgtctgacgctcggaattacggcattcgccgatcccgtggaagtttgatttcctttattgacagtgacgattatgtatcatctgattacataatgcacttgtatcaggcgttagtccgagggaacactgatattgcagccacttccatttgcattttccataacggagaacttcctaaagtggataagcataatacggcagtctttcatgtgtatgatgcgtgtgatgcccttgaagatatgctttatatgaggcatttggagcctaacgctttcccgaaaatttataagagagaattgttcgacacgattcagtatcctgtcgggaaattgtatgaggatattgccactactgccaagcttatcgataaggctggcaagatcgcatatctgaatgagaaagactattactataggattcgtccgaatagtatccaaacagcgagttttaatcccaagaagcttgatttacttgatcagcttaacgttgttaagtcgattgtgcagacaacgtatccgagtatcattaatgcttattattcaaaagaacagagcgcattattcaatttgtatatgaatataagtcctgatgatacaaaagaaatgcttggaatagcagatgacttgtggcatggaatcaaaaaaaatcggatttcagttttaaaggatagagaagcaaggcctgatgctagaatcgcttctttgttgtccttcttgggttcaattccttgtagatgtgtttataagttggtaagaaaatgaaaatattctctaatatagacaaacgatctcaagaccgttatgtttgtatacttctaatattggttttggtcgggtctgcatttcagaatgtcaaagtagttggcccgttaaatccagggcatttacttgcgttatgctttattccttttttgctaccgaagcttaaagagacaaaattcccgcctgctgtaatatgcatttttacggcgtacatcctctgtgtgtccttgttcgcaagtttcaaatggggattagacacatctattattaattatctgtttgtcttttacattatctttgtcattgtcaatttgggaagaaatatctcatttgaatcatataagaaagtattccaattagctggaatactttcttttgcaattgttatattaaatgcgattcactataaagatgccatattaagatatttttcatctggatattacgtaaaccatccgtactatccaacaatatatggaggtggtgccaaccttgaagcatcatggcccagcatatatggtgtttttttcatggataatccttacggtattatatatctcgttttatctttcatatttgcctctattcaggttagtagagctggtattattatctcgttaatttgtttggttatatatgcatataaacggttacgggaatcaaaaaatccttttttgattttattcttgatatttgttgttctttcccttggctctttttatgcgctaagacttggaatattccaaccaattttagatcgtttctttaagaaccaagaagataggggtgccgcggggcgtatcggtatttacgacaatgcgcttccttttctttctagtcatccttttggtgttggtttggggaatgcagtttctgcagtgaataaagtagctgcgaatacagtggggatggagccgatagtagatgacaatttacataatctattcctccagatgaccgttgaaactggtgtgtttggcggggtgttttatgcatgtttggttgctttcctgtgttttaattgtatcttcaaacataaattcgccaatccttttgaaaacttcctgcttgctttctttgctttatcgttgattcaatttgaaaaaatagaaatcttccctgcaatatgccttggtatattgttaagcaaaaaatattattcaaacaaggatttcgatttataatgttattctctattattattcctgcctttaacgcagaaagatatttacatgattctttgaaatctatccggatgcagacttttacggattatgaaactataattgttgatgatggatctaccgataagacgggtgagatagcagattcttttgctagggaaacctctcggactcatgtgattcaccaagaaaacgaaggtcctttgcttgctagaagaactgggctacaagcagcaagtggcaaatatgttgttttcttagacgcggatgattctttacgttccacggctttgcaggatattgccgatgcaattcataaatataatgttgatattgtttcttttaggtattctcggcaggataatttcttgacgtctgattcaccttcccccttgccggtcgggatatataatggcgaacgattcgaagaagctaaacttcatctctgcaaaggacgatttaatgagatgtggggcaaggcgataaggctttcatgttttgactgtactgctgattattccaactatgcagggttgatgcacggcgaagatcttttacagcttcttcctgttttcgacagtgctcattctctttatagttcagataaggttctctatttttatagacctaatgattccgctagcacggctagatataagtccagtcagctatctgatatcagaaaagtgaatgctcgtcttctgtctttttcgatgaaatgggggaaagcctgttataagacggcatgcagtggcgaggtcatgcagtatatcaatcttcttaagattgctgtttcatgcctttcctatagctcttttggtgatgtgtttcgttcgatgcataaggcaatggatgatgaaggatgcttggcgcgtgctcagaattgtcaattgaggattgacaattctgttgtcgttttttgtcttatgcacaatttctgttatctttcttttcttgttttgaaagcaataaattccattaagagatgaagcataaggacttttgatgattagaacaaaagctgatttattagaatacattcaagaagacatgcgtatgcagccgcggtcttcatcttttgtgaagcgttatttgggtacaagtggggcagtggtccgttggaaaaaatgtttaaggaaatgtgagtaccatcacaatatttccaagaatatttatcacagattggcatattttgtttatctttttatgttgaaaaggtatgatcgacgtttctgttcagaaatccctattaatgttttcggcaagggattattaatttggcatccagaaaggataattattaatcctgagtcaaaagttggagattactgtgcgctttcgagcggtgttgttattgcgcaggcacatggagaatgcccgacaatcgggaatcatgtagagcttatgattgattcgaaggtgctgggaggaattactgtagctgacaatgcaagaatcggagcttctgcgttggtgcttaaaccgataaatgaagctgacacaacctgggctggtgtgccggcaaagaaaattaacaatcagggaactattgaaacgccgattcctgtttgcacttattagtgctacgaaggtgagacggatggaacagagggaaaatcagctggtcagcgtcatcttaccagcatataatgtggcgaattatttagatgactgtttggaaagtatcatttcccagacatataccaacatggagatcatcatcgttgatgacggatcaactgatgataccgcaaagaaggcggatgattggctttccaaagatgggcgtattcgtgttatccatcgacagaatggtggtctttcggcggcaagaaatacaggcctgcactatgcacagggcgaatttattatttttattgatcccgatgattgtattgataaaaatttgatttccaaatgcatggaattgttgagcgacggttcggtttctttggttcattatgggtaccgattaattaatgaaaacggagtattgtgcggaaagaattttccggatatgctcacgaatgctgagaaactattgctaacaattttaagtgacaaaattccaagtcattcttggcaattcttatgcaggaaagaactatattctgatatccgtttccctgaagggcgcaaagctgaagatctggcaacgacgtacaagattgtagctaaggcaaaaaagtgcgttattttaccggattgtctgtatgaataccgtgttcgcagcaactcaatcctcggagagctaacgtcagaccactctaaggctataaagtactatgaagatgagcttcttgcgttccacgagataattgattgggctattgctcaaaagcgagaagattatcaaaatcttgcgtggaataacgaattaatgcatttgtttaatcattacaaagagcggattgtaatcgatgataatttaggaaccaaatgggtgcacaataaaatatgcaaagagctttctgcttttaacgtagatggagtaacttcctctaatcgatttaaagcgttcctattcaggtttgggtttatgcctttttgctatcgagtaatgggaaagttgaaaaaaagagtcaaatctattttgcgaaaagaatgatataataaaagaattcttttacatctagtttagtttttgataattgaatttacgtcgtttaatcagctggtttaagattgtgccataaagattaaacccaaaaagacttactattttattttaattgaaagcgggatgaaatatgaatttcaaatcatttattaaaaaaaagatgcctgtttcttttattgtgaaaagacagcgctggaagactctttgcttgttgaagcatgaggggaaaagggaattcagacgtttttcacgggcatatgctgctcctgcatgttcagatcaagttcagatggaaagcctcttgactttctttgtccatcagattgaaaagggcttttcgtttgatacataccagtacggtcgtggtcgtggcgctttgcgtaatattgctgatctttctgcaagacttatagaggctgatgcacaatggcgtgacaaatcaatttataaggacatggtgcttgctttgggagagtattgccgacgccatgtggcagccaatcaagatatcgcatttgtgacagaattgtttgatgaaaccaccaaacttgatatagtggctgcttctaaaaaagaatatcctagtattcagctctctttgagttctaaagtagataatgccaccgttccttttaaagagttggtggaacggcggcacgcggtccgggcgtattccaagaagcctgtggcacgagttgaacttgaaaaggcaattgaaatgtctcttcgtacgccatctgtatgcaacaggcaaccagcccgtgtccgaattttcacggatcagcagttaattagcaaagctttaaaagtgcagggcggtttcggaggatatgacatcccgccagcattgttgcttgtgactgctgacttgcgcgcattcatgggtgcgaatgagcataatgaaggatacgttgatggtggactgtttggcatgtcattgttgtattcgctggaaacatgcggtctcgcggcatgtcctctaaatacgatgttcagtgaagaagctgatgagcaaactcgatctatgctcgctgttccggataacgaggtgttcattatgtatattgcagtaggacacttccgcgaaacctccaagatttgccgttcccaaaggttcgggattgatcgagtattgatgaactgattacgggggtcttcttgggtaaatacaagaatctactggtgaatatcggcttattcacattaaatacggtatcaacgaaattgattacatttctgctggtaccgctatatacgtatttcttgactgcggcgcagtacggcgtgaccgacatgtctcttacggtggcgggtttggtcacgcctgtcgttaccctgtccatcggcgatgccaccactagatatatcatcgatgatcccgatgataaggaacgatatatatctgttgggttttgggtgactttgtttggttgcctgattatgctccttctgcttccgctattagggctgtccatattcggcggcctcgggaattacaaatggttctatcttgcctattttgcttcatccgctttcaatgcgtacttggcaaatgtggcaagaggtttgaaccagattaaactcatcacctgggcatctatagcttcgtcgcttgtttcggctctatcggcaggtttgctcatcggtctgcttaattggaaggtcgagggatattttgtttcgttgattttcggcgggcttgttgcaattgttttatatcttatatttggtggctcatggaaatacgtacgtattcccaaaaaggaacgcgaccgtcattttcttaagaagatgctgctgtattcagtgccgctgatgcccaatgctatcttctggtgggttggcacaagtgtgaacagattcttcattaccagtatgctcggtatcggtgcttccggcttatttgctgcggccagcaagataccgaacgtaatgaatatggtctcttccacgttttggcaggcttggagcttgtctgcattccaagagttcaagaagactgataccggcaagttctatagcaatgtgtttgcggtgtttcgtacgttctgtttcctcgcggcatcaggacttatgttgttgacaccgtggctcgcctcattgcttttgcagaagaaattctatgattcgtggcctatcattcctgtcttgattcttgcatttctgtttaatgtgttcgcaggattctatggaacggtctttactgcaagtatgaaaaccaaacatctaatgacatcgactgctgctgctgcgatcgtcgttgttgttctgacttggctgctcgtccgtatcatgggactgcaaggagctgcgtgggctatggtcggcagcaacctagttatgtatgtcatacgcgtggctatggctcatccgattgtcaggatagcggtgaactggcctcttatgctgatcaatatcctgattgtagctgttcaagcatgcataatggcatggcatccatccaggtacttgttgatctctggtgtgctcttccttcttgtatgcatagtatctgcgttggatgcctatccattcgtaaaatctttggcaactgcaatcagcggaaagtcactgcataaaaatggcaaacatgtcgggaaatagggatttaaggagatgaataatgaggataggaaccattaccttccattgtgcatataattttggttctgcactgcagacttatgcactcagaaaatatctcacgaatttaggccatgatgtacatgttatcgattatcggagcgcagatttcaatgggtataagatttttcgtggaataggggttaaatcatttattgcagatttgctctttcttccaggtaatttacgcaggcgcagcagttttcaatctttctggcataaatgttttggcctgacgagccggacttatgagggggctgatgcagagcgttctctagctgaggatttgaaggattatgatgcgctgatttgtggtagcgatcagatttggaatttggattgcaccttagggcctgttcctccgttctttctttctttcgcttctgatggaacaaagaaaattgcgtatgcgcctagcttgtcgcatgccaagtttgaagaaaagaacttcactctagaagataagaagcatgtctccgagtggttgaatcgttttgatgcactttctgtgcgtgagctttctgtagcagggcagtttcaacaactgactaataagcatattgttgaaacgcttgatccgacgcttttgttgaatttagaggattatcgacatatacaggctccgcaacttccaaagaagctggaagcaggcaaatatatatttgcatatacgttatggccgaataaagatatggtgcattatattgataaattggcggcaaaacgtggactaactatcgtttattactctcagaagccgattcggtatcaatcgcacgcgatcaatgtatggggaattggcccagctgattttcttacattgattgataaggcaaactgcgtgatttcgaactctttccatgcaacggtgttctccattctctatggcaagccatttcttacgtttggtacggaaaagagtagttctcgcatgagaacgttacttgtcaaactgggtttacctgaaaagcatcttttgcctcctgatttcgagggcggaagtaatgttgaaccatttgcctctgtactgaatatggctcgacttaataatcttcgtgcagattctgaacggttccttaatgatgcactgatgtaaaaactctcaactagtatttggcatagaatttattgcatgctgcttattttttcaattttcatagcatgtttgagttaaggagtgcggatattttcttgaagatagtcatacagctccttatctgagattttgtgaggatgtcttgtttccgccatgaggatgactggggtccaccggaacatgggagcgaaccctcggctgtttgttttcggttattgtttggtggttactgtgcagtttggtgtgacgtcggtcacggcctgaccgcccgagacggccgcggactcgcccttcacgtcgtacagcttcccgccgttgtcatctgtcgtggaaccatacgagaacgacagaccgaccctcgtggagcccgccgcgggaaccgtggccttccaccagcctccgcacgcctgcgtcatctccatgccgccggtcgtgtccggactgccgtacacgcgccactgcacgcgcacgcgctcctgcgtggacgagggacggtaccagaccgtcgcggatttcagggactgtccgaccggcttgaacttccactgctggttcgcgccgccgttcgacgcccacacgtccacgttcgcggctgaaccgcatggtcccgttcagcaggtcacgcaggatcagcaccttccacttatcggagatcatcaacagcgtcgtctccacaggacacgccggcaattcacgttccatcagaaaaatcactccttcacgaatcgcaataaaatcaacaaaagttcccttctggtaactatagcactttattgtgccttcttccgttttggtcggtatggaaataatgttcatagcaacagcgggaaccacggaaatccgcccgctaaaccagcaagaaatacgaaaggaacaaacatgaagatcgcagtagtggcagccaacggcaaggaaggccagctcgtcgtcaaggaagccgtcaagcgcggccatgacgtgaccgccgtggtgcgcggcgaaaacaagtccgaagcgcagcacgccatcatcaaggacctcttcgacttgaccgcggccgacctcgccggcttcgacgtggtcgtggacgcgttcggcgtgtgggctccggaagaccaaccgcagcattccacctccctcaagaccctgtgcgacgcgttgtccggcaccgacaaccgtctgatcgtggttggcggcgcaggcagcctgtacgtcgacgccgagcacaagacccaggtcaaggacctgccgaccttcccggaggcgttcatcccgctggccaacggcatgggcaagtcgctggaagagctgcgcgaacgttccgacgtgaagtggacctacatcagcccggccgccgacttccaggccgaaggcgcacgcaccggctcctacgagctggccggcgaggagttcaccgccaatgccgaaggcaagagcttcatcagctacgccgacttcgccatcgccgtggtggacgaggccgaatccgccaagcacgtcggcgagcgcatctccgtgtacaccaagtaacacgcgccaaaccacgcccaggggaaggcggattagcgtctgcaagcatccagagtgtccgtttctgcagaatcggacactcatgggtccattttctgggtttcgatgtccgattctgcagaaacggacacgtggagtacgcaccgaggcccagggaatgcacggatgtgtggtacgcacgtggggcgggcatggtctatgcatggttatgggtatgaacggaaggaacgtgtgatggatcagcggcagtgtcgtggctggcttatcgggcagttgctgggagagtatccggagtaccgacgaggcggatctgccgattccgcatgacgatgaggagcagcgtctgctgttgcgtgcgttgcagaacgtccgcccgcccgctccggtgagcgaacggttcctgcacgtgcaggacgagtatctgggcgcagagctcgcacagtgtgccatcaccgacgcggatgacgtgcctccggcggagaccttgcaaaccggcgcaacgctcgccatctggcagggtgacatcaccaccctgcgttgcgatgcgatcgtcaatgcggcgaacagcgggctcaccggctgctacgcaccgaaccatcgttgcatcgacaatgcgatccataccgctgccggcgtgcagttgcgtctcgcctgcgagcggatcatggaacagcaggggcatccggaaccggtcggtcgcgccaagatcacgccggggttcaacctgcccgcgcgctacgtgctgcacactgtcggcccgatgattcccagtggcgatccgacgccggccgagcaggagcagttggcggactgctaccgttcctgcctgcgcctggccaccgatcacagccttgaaaccgttgcgttctgcgcgatctccaccggcgagttccggttccccgccgagctggcggcacgtatcgccgtacgcacggtccgtgagtttcttgcgcatcggcctgcacatcaggagcccacgcaaccgcacgaacagccacacgatcagccgcaaacgcaaacgtccaccacgtcgacagccgatacatcaaccgacacctcagccgaatcgactaccaatactcgccccgccatcaccatcaggaaagtgatcttcgatgtcttctctgaccgagaccgtcagatttacaagcgcgtattcgccgaccatgcctgacggaaccatgcctaacggcgagcatgccacctcaatcgaacggctcgcaaaggcgtggcgtgaggcggattgcgtgcttgtcggcgcaggatcgggcctgtccacgtcggccggctacacgtattccggtgaacgtttcgaccgtctgttctccgatttcaaggagcggtacggcatcaccgacatgtattcgggcggtttctatccctttgacacgcttgaggagcactgggcgtggtggagccgtgcgatctactacaaccggtacgtgccagcgcccaaaccggtgcatcacatgctgctgaacatgctgcgttccaccggcaaggacgagtatttcgtgctgaccacgaacgtcgaccattgcttccagaaggccagttttgacaagtcgcgtcttttctacacgcagggcgattacggcctgtggcagtgttcgctgccgtgcgctcaggtcacctacgacaatgagcaggccgtacgcaggatggtcgcagaacagtcggatatgcgcgtgccgagcgatttggtgccgcattgcccgcgctgcggccgtccgatgatgccgaatctgcgttgcgatgcctcgttcgtggaggacgacggctggcatgccgccgcccgtcgctatggcgatttcctcgaacggcatgggaattcgcgcatactgttgcttgagctcggcgtcggcggcaatacgccggcgatcatcaaatatccgttctggcgattgacgggcgagaatccgaacgccacgtacgcatgcctcaatctgggcgaggcggcggcaccggcgcagatccacaatcgttcgatctgtgtcaatgccgacatcgggcagacgctgagcgaactggctgtggcgctcaggaaataacgaccaagaaacaacaaccaggccgggagacatggcaaggtacggctcgcttatctgtttttccggcttggttgcgtttgtccgacgcatcggcatcgggctccatggatgtatgcgcgatcagcgcaccaaaaacaccatgatgagaatcatcacgaatccaaccaaatcggtcggttcgaacaccgcgtccgtccatgccaccgcggaaatcgtggccatcaccggttcgctggtgccgagcatggtggcacgcatcgaaccgacgcgcaccacgccggccatgtacagccagaacgcgccgaatgtgccgccgatcacggtgaacgccatcagccccacacccagccaatccaactgcggcgccgtatcccacggccgcacgaacggcagcagcacaagcccggaaatcaggaacgcgatgccattgacggtgaagttgccccaacgttcgatgagcttgaccggaagaaacaccatggccgccgtggacgccgcgttgatagcgccccaaatcaggccgaccaacggcagtttcagcgtggtgaagtcgccgccggtcgcaatcagcacggttcccgcgaaggcgagcgccacgccgatgccttcccgtacgccgggcagtcgccgcccgcgcaggcatacgacccccaagacgaacagcaggttcaggctttgcagcacggtcgcggtgccggagttggtccagttgatcgattcgaggtaggcgacctgcaccagcagcacgcatatgatggcggtggccagcagccgcggatatgatttgcgatcgcgtagcgcgccggtaagcagtttcggcgtcatgatggccgagcaggtgaggaaaagcacgccggctgccagttcgcgcacgcatgcgatccacagcggcgaggcatgatacgtgcccatgaggattttggagacggtggcgttgacgccccacagcacgccgccgcacagggtcattgcgatgccgataatcaggtccttcggcgtgcgctcgaacgttttttccgccactgcggctccttccccttcactgttcgctcatcgcacaccgtacacgccgcatgtgtcttgcagtggcagccgctcacagactgtccgcgggcgcgctgaggaagtcgagaatcttgttcacatacggtccgaccaccgtgttcggcatggagaagatctcgtgcaacgacttgccgtaccgtattttttcgattgatccgccgccttcgcgcacgcgttccacgaaatcgtcctgcggaccgttcaggacccagacgtcacggcccgcttggaacagcagcgtcggagtttcgatcgcaccgcacatgtccggtttgagtacggctcgagacaatgccatcgcctgatgcgcccattcgaaggtggccgcgttggtctggcatgccacgtcgtcgacgcgctgcttgtggaaccagcgaacgcgcgcctcggacgcgcccttatgctcgtcgagatcgagttcgggggaaaaatcggtgtgaccgaatacgcgcgctttgccgaatcccaagccgcacaacgcgcctgtagcgatgcgtgcgatccatgtcggcataccgacgacgggggcgatcatgggtgcggacagcacggccttgtcgaacaggctcggatagtgttccatcacggccgcgccgatgccgccgcccatcgaatggcagtacaggttcagtggctcgccgcacgcgtattcgcggcccacagtgtcggcgaaggctgcgaaatcggccacgtaccgacgccaatcgtcgatccacaccaggctgggattgctcacgtcgtgtgcggaatggccgtgcccgcgatgctcgaggatgcatacggaatagccggccagcaggaaataccatgccatctcgctgtattttcgcacgaattcggtgaatccgtgcgaaatgacgatcgcaccgcggaacacgcccgaagcgccgtcctcacgcagcgcatcgaatttggccgcgtcgtaacagcaatagtgcaaccggccgggttcgtccagtttgggcagcgcgtcgccgttccagtcaacggtggctggatccatccatccttccgtcatgcaggcgtccagcgcgggcagcaccttgctttccatttcggcgtcgtaattcgcctcgtcgagcagcctaagagtcatgctttcatcatacgaatcccacatgaacagccttcagagccccacgcttcggctccacggatcgaacgcgcctcctcactcgtggacgcgctcccccgtacaatgtcggtatgaaaatcatgtcattgtgtgtgtcattcgtcatgctctgcaccatgcagccagccggaacgatggccccttccaacgggaaggctgccatcttcgccgacgcggcgagaggaaccgcatccgccatcatcgactgcccgccgccgctttactggctgtgtggaaagtgagccatgcgatgaatcccacgaaatccgcagctcccataccaaaaatccaccgtgtagcgctggtcgacaacgatccgcgcgcgttggaatcgctgagccttctcatcgaagcgaaggtccccacggcctacgtggtgtggacggccacttccggcgacgaagcgatcgaacgttgccagaggaacgacgacaatctcaacctgcttgtattggacatgtccatggagggcttgcaggggccggccatctgccatcggatccgtctcatggacaggcatctgccgattctgggcatcaccagcttctccatcaacagctaccgtagcaggctgatggaagccggagcgcagggactgatcggcaaggaggattccgatcagctggcgaaggccatcgagcggctctgtggaggcaacgttatggagggattcgaacctcccgccctggccaacgtgcgcatcagacgcgaggaggagacctcaccgcggctcaccgtgcgcgaggagcaaatcatctccctgtgcgccgacggcatgctggacagggagatcgccgaacgactggacatctccgaaagcaccgtgcgcaagcatatgcagggcattctcaagaagctgaactgcaagacggcacgccaggcagtggcattgtgggtgagatcgcatgcacgctgaacccacaaaacccagacccgtaagcgccttccgctcctggcacaaccatatgcgtgccgaccatccgaaactctggcatccgatccgcataaccatcgtggtcatcaccgtatggtggatcctgttctgcctggtgctcgccccgaccgacaatcccgcggcgattgtctggaccatcatcgaaatcgcggtgctgctgctgtcaccgttctttccgaaatcgatgtcgctgctgtttctgatcatgagccagtcgggaccttggctcatacccggagccgacgtcaactcgctgccgggaatcctttacacgttcggcatgctcgcctacgaaaccaacaatctcgtggcgctgctgctgctcgcttattccataggcgaccagctgttccgtcaactggtccttggcacgagccgcagcaatcccgtggccatcatcgccatggtcagcctggtactgatgctcggatgcggtttgcgatggaaccaggccgtagccggcagccgcgccgaggcggagcaggcgaaagcgcgattacgggagatggaaagccgcagtcacatcgcggaagccatacacgacgccgtgacgggagatctgtccgccgcggctttcgtcgcgcaacgtcgcatcgatgcattgtccggcggagacgatggcgatggcagcgcctcgacggatggtgacgacggcaagaacgcggacgaaagacgcgatgagctcgacaaatggacgcaggtcaacgattacatcctgtccgccctgaccaacgtgcatcgcgtcatcgacgaactggatatggacgtcaccgtccttgaggaggatgcggacggcaaggccttctccgacctgctcaaagccacgatggccggcggcgaccggcgtctacgcgcgctcggcttcgacatcacctcgatcctccatgtggcgggcggtgcgccaagcgcctccccgagcctggccggaatcgccaatgatctgcttcgcgagacctacgccaacatcgcgcgtcacgcccagtccggcagcaaagccgacctgtcggtgatgctcaagccgaacgccgtcgaaatcacgcagatcaaccaggcgaggaccaccgaaacggatcgcacgcagccgggaggccacggcctcgcgtatttcagcaaacagctcgaatcgcatggcggcaaactcgagacaacgctgcgcgacggcgaatggacgctgttcgcctatctgccgattccggtgcccgaaaccctgccaccccttgccggacaccccgaatcgtgactggctccgacggtcgcgagaaacgaaagggtgctacaaaaggtgctacacagatgtggtacacccttacttgcaggggtgttcacgccatcctatcttccctattgagaagggttacgcgtctccctgtgacccgacggatacttggcagtccgtcgaatcgcagggggacgcgttctttttttcttcggttgtatcggaacgtcagttccgccggaacaccgtcagaccagcgcgtcggcgaggaagtcgcgctgcagcagcaacaggttgcgcgccaccgtctcgtcgttggtcatgtgcgtgatgccgttgagcggcaggaacgtgtgcttgcgtcccgcggccatcaacgcctggctcaagcgcagactgttggcgatcgtcacgttgtcgtcggcgaaaccgtggatgagcataagcggacggctgagcttcggcgcgtccgcgatgatgctgttgcgctcgtacgtggccgggtcgagtcccaggtagcgctcggtgtaatgcgtgtcgtacagcgtccagtcggtcggcggggcgcccgcgcaggccgcggcgaacgtgtcgggcgcgtccagcacggcgagcgcggacaggaagccgccgtaggaccagccgatcatcgccacgcggccgaggtcgggtttcggcacggcaacgccggtttcggcggcgagcgaggcgatcgcgtccggcagcgcatgcacggcgtcgacctggtcctcaagcgtcacggctttcatgttttcgtagatcgcgcgatcccacttcggtccgcggccggtggtgccgcgaccgtcggcggtgaccacgatgtagccttggtcggcccaccactgcgcgtcccagtagaacgactggctttccacgacctgctggaaaccggggccgccgtaaggcttcatgaggaccggcaactggtcggcatgcgcgtatgcgctgtccgccgacggcaggatgaccgccgcgtacagggcgcgttcgccgaggcggacgaatcgcacgttcggcatgaaaccgggggtttcggcgtggttttcgatcggcgaaaccaccatcgacatcatgtcggcggcgtcgacgccatcaccatcaccgtccgtcgtgcgcacgttcatgcaatgctgcatctgcatcgcggcatcgtccatgccacggccggtcaccacgcaaccgtcgccggcgcggctcatcgtccactgtccgggaacgtaggtgagcggctcccagtcgccgtcgtaacggatcgagaccacgtcgaagctgcgggcgtcgtgatcgtccgcgttggactgccacaggaacggcagatcggcggccggcagcagttccggcgtgcgctgcaccacgcacagcacgtcgttgtcggtcacgtcgagcacttcgcgcacctgcaggcccttgggtgtgaatggcgtgccgtccacggtcagacggttcgtgtcggcgtccatgtcgttcatcgcgcacacgagacggccgtcaggcgtgtatgcgggggtgccggcgatcaggtcgagccagcagtcgttgctatgttcctcaagcacgcgcgtggtgccgggctcttcgccgggcgcgtattcggggatggcgatggagaaggtctccacttcgctgccgtcctcgtcggtgaagccgttttccggcgcgctcatggtcacgataggctcgcccacgtggacggcgagcacctggtcgtgctgctgaagccggtcctgcacaagtagcagcggctcgtggccttcggtccagctgacggcggccaggtattcgtacgattcgcggtcccattccacgttgtgtgcgatgccgccgtagtagcagccgtccgtatcgtagccgagttccagcagcgtcagatgcacgtcggcgttggccgtcatcgcctgcggatagcggcgggcctgcgcggttttcgtcggattggccgggtcggcgatgtaccaggtctgttcgtgggatgcgtcgaaggtttcgaagagcacatacttggaatcgggcgaccaccagaagccgtcgtaacggtccatttcctcacctgcggcgaattcggcgagaccgattttccattcgcctgcttgcgattcggccgcgtcgctttgcgcgtcatcttgcgtgccgtcctgcgtatcggcaacgtcgtcagagtcgtcttgcggaacggacgcgacgatggacaccgcatcgcccgcgtcttcggctgcgtccgtcgtgtccgacacgtccgcaagatcgacgtccaccaaatacgtgccggtcgtatacatgatgtgtcgtccgtcggggctgatgcgcgggttcagcaccggcttgaattccggttcgtcgatggcgatgccgcgcgtcacgccggccgcgatatccgtcaggaacagctggccgttgatggtgaacgccacgcggttgccggccgcatcgaccgaatagccgacgatgccggaaccaccttcacgcgcacgttcgcggcgcgccttttcctcagccggcacatcctcggcgtcggcgtcagccagcagcgtacgcggatcggcaagcagaatctcgtcggtatcgccatcgctgccgatcacgctcatccacagggaggtgacggtgtcctccggaccgtccgaacgcaggaacagcgcacgcgaaccgtcgccgatcgcgcgggcgaaacgtggcgcgccgcaggtgaatcgcaaggtacgggccttcagcccaggaaactcatcaatcgcatcattcataccttccaatctaccgaccatcacgcaccactcgccgccaataccccggacgcaacccccttcacatgaaatttttgcaagcaagtagccttcgaattggcgctcggcaggctacagcgtaggatagtcaaggacagaaagggacaagtatgagtgttctcgaccgatttgagaagagcgtggaaggcgccgtcaacggggttttcgcgaagttcgggtctaaagacctgaagcccgtcgacctttccagcgctctggaacgcgagatcgacaaagaagccatgcccgtcacgcgcgatcgcaccgtagccccgaacgagtaccgtttcaagctcagcactccggatttcaacaacatcgtcgagtggggcgccgaaacgctcgccaatgaacttgccgacaacctcacccagtatgcgaagagccagaactacgcgttcgtcggcccggtcgtggtgatcttcgaagaggatcttgaactttccaagggcgattaccggctttccagcgaatccgtgcagggcaacaccgtgccggtcacgaccgacgcgcagaccgaggattgcccgatgctggagatcggcgagcaccagtatctgctcaccgaggaaaagaccatcatcggccgcggttccgattgcgacatcgtcatcgacgaccccggcatctcccgtcgtcacatggagatcgacgtcaccgacaatggcaacaccgtcatcgcccgcgacctgaactccaccaacggcatgtacgtcgaaggccatcatgttgaggcggcaacgctgctcgacggcaacacgatcaccatcggccgaacccgcatcctgtactgggcctcctcgcaggagcaggagtaatcagccccaacccggagagccgccttttatgctcactgaattaacgtttgcgatcctcaagtacgggtttctcgtactgctctggatcttcgtggcctgtacggtacgttcgctgtacagggatatcgaaacgctcagcccgcgcaagtcgcgggctcatcgtcgtaaggagcgtgccgcgcgcaaggccgtcgaatcgcctgcgcccgtagccgccgcagccccttcggcaagcgccgcaaccaatgccaaaccaactctgctggtcattatcgatggcccccttgccggcagttccgtccctctggccggcaacaccatcacacttggccgttccgcttcgaacaccgtggtgctggatgatgaattcgtttcctcccaccatgcgcgcgtctacaccgatcccgccaccggccgttgggccatcgaggatctgggatccaccaacggcaccgtcgtcaatcatcagcgtctgaacgcgccgatgattcttggcgcgcgcgtgcctgtgcgcatcggcgcgaccaccttcgaattgaggtgacgtttttgccgacttccaccgcttcgcaacaattgttcatgtattccaccgtcgtctccgacgtgggcaccgtgcgttccaacaaccaggattccgcgttcgccggcgagcatctcatcgccatctgcgacggcatgggcgggcatgccggcggcgacaccgcctccaccatcgccatccggtcgctggcgcatatcgaacaggacaatgttgacggcgacgtgcaggtcgtctcccatatgatggcgacttccgtcatggccgcgcacgacgcgatcgtcggcaaagccaagcgtgagcgtcgtcttgccggcatgggcaccaccgtcacgtccgtggcgctggtcgccggctgctgggtattggcgcatatcggcgattcccgcgcgtatctgctgcacgacggccatctggtccgcatgaccagcgaccacagctacgtgcagcatctcatcgacaccggccgtatcagcgaggccgaggcgcgcaaccatccgcaacgcaatgtggtgatgcgcgtgctgggcgatttcgacatcgattcgcgccctgacatcgccatccgcaaggcgcatccgggcgaccgttggctgctgtgctccgacggcctgtgcggtgtgctggaggattccacgcttgaagaagtgctgtccacctgcgccgatcaggaggagtgcgcgcagcggctcgtatcgatggcgttgcgtgcgggcagcaccgacaacgtcaccgcggtgatcgccgacgcgacgctcgcgctcgacgcggacgcgttcgacctgcctcatcagacgccgctggtcggcggcgcggccagcgcaagcttggaaaccatcgcggacatcgtcaacgaaccggtcgcttccgccccgcctctgcgcgaaggcaagcagtcgccggcggcgcgtgccgcggccctgcgcagcggcaaggatcccaacgaggagccgaaacagccggaacagcgcgtcgctcagccgtcgtcggtccgcgaagacaatggcgaccgtgtcaataccgataccggggaaattccgattgtgcagaagcgcaacgggcgtatttccgccgatccgaacgatccggaagtcgccaaggcgattcgcaacgaacatatcgaggaacgtaagacgaaacggtcgcgcaaattccgcaaccgcatcatcaccatactcatcatcattctggtgctgcttggcgttgccggcgtgggcgtgggcacctaccgttggagccaaaccaagtactacatcggcgacaacaacggcaaagtggcgattttccaaggcgtgccgacgagcatcttcggtgtcaaactgtcacatgccgtcaccgacaccaatatgaagaccagcgatctgccgccaagctggcgcgaacagcttgaccagggcatctccttcgacacgtacggcgaagcgaaaagccatacccgtctgatcaaaaagcagctgaacgatgcgaagcgcaagcaagaggcgaagcagcaggagaaggccgaagccgagcagaaggcgaaggacgaagcagccgccaagcagaagcagcaggaggaagcggcgaaaaaggccgccgatcaggccgcgcagaccaacaagtcgggcggtgacaagtcatgatcgcaacacgcttgagacagcttggcatgctgctgttcagcatgctgctgtgcgcggtggcgttcttccagatgtttgaacgcaccacgaacggttttccgcagaattatgtgtggatgctcgcgtttgtgggcgcgctgttcctgaccgcctggggtctgctgctgcgattccagccgcacgccgaccaatcggtcatgtgctgcgtgctggtattgacgggcatcggcgtcacgatgatcgcacgcctcgaccaagacaccaaaaccacagtggcgttccgacagttgctttggttggcgatcgcactggtgtttgccaacctgctggtggtgttcatgagggattaccgcgtattgcggcgattctcgtacgtcagcatggtgatcggcatcgtgctgttgctgtcgccaatgctgccggtggtcggttccgaacagtacggcgcacgcatctgggtgaagattcccggcttgggatcgttccagccgagcgaattcgccaaactgttcctggcgttcttcttcgcttcgtatctgttcgaccatcgcgaccagcttgccgtcggcggaaagaagattctcggcatccaactgccacgcatcaaggatatgggaccgatcatcgtggtgtggatcgtctccatgggcgttctggtcctgcagcatgatctgggcacgtcactgatgttcttcgccatgttcgtgtccatgctgtacgtggccaccgggcgtaaaagctggatcgtcatcggattcatcgccttcgccgccggcgcggtggcggcggcaagcatcttcagccacgtcggctcgcgtgtggacgcctggctccacccgttctccgcggctcaatacaacaaggaatacggcggctcataccagctcgtcaccggcattttcggcttggcttccggcggtctgatgggcaccggcctcggtcagggccacccgtcgatcaccccgatcgcaaattccgactacatttacgcggcattgggcgaggagctgggattgaccggcctgatggccattctcatgctgtatctgctgatcatcgcagccggcatgatcaccgcgatgaaaatcaaggacggcttcggcaagctgcttgcgtccggcttggtgttcaccatggccttccaggtgttcaccgtggtcggcggtatcacgctggtcattccgctgaccggtctgacgcttccctacatggcggccggcggttcgtcgctgatcgcaaactacatgctggccgcgctgctgatcgtcatctccaattccgcgaacaggccggaatccgagatcgacagcgacacattccagcaggaagccgtcagggtgttgcgcgaacgcgagcggaaccgtcgtaccgaaatcgccggcaatacgcgttcgggtgcagcgaaggcttcggccatcccggccgtgcgggcaagccatgcgggcgcagccgggcaagcaggtcatgccgtgcccgccaatcgaaccagccaagccgtccagaccgatcaatccaatccgacgattccgataaccggagtcctgccgacgatcgaccagcaaggagcatcgcatgaataagtcgctccgccagctgttcaccatcgtggtggccttgttcgtcattctgggcatgtccaccaccatcatcatggccatccgagccaaccagctcaccaacgacgcacgtaacgtccgcgcgctgtaccacgaatacggcgcaccgcgcgggtccattctcgccgcggacggatcggtcatcgcaaaatccgatccttccaacgattcgttctcgtaccagcgttcctattccgccggcgaactgtatgcgccagtcaccggattcttctccatcagccagcgtggctggagcggcgtcgaagcgtcccgcagctcgctgctgtcgggccagtcggagcagctgctctggcagcggttcaagtcgctgttcaccgggcaggagaacaagggcgccaatatcgaaacgtccatcgatccgaagattcagcaggccgcatacaacagcctcggcagcacggatggcgccgcagtggccatcgagccgaaaaccggccgtatcctcgccatggtcagcacgcccagctacgacccgaaccagctggccagccatgacatgagccaggcgaacagcaactacggcgtgctgtcccaggacgccaccaatccgatgctcaaccgagccacttcgcagctgtatcctccggggtccacgttcaaaacggtggtggccgccgcggctttggaaaccggccaataccagccggatacgcagattccggcaggagcaagctacacgcttcccggcaccgtcacgcaactgaccaacgccgtaccgcaggccgacggcgctgacggcaagatctccatggaggacgcgctggcatattcgtcgaacaccgcgttcgcccagttgggcgtgtcgttgggcgacaacgccgtctcgtccatggccaagaaacttggttttgacagcccgatcaccgtggacggttccgattacaccggaaccccgtgggtgtcggtcacgtcgaagttccccaccgacatcaacgacgacaagctcgcattggcgtctatcggccaaggagacaccgtggtgacaccgttgcagaatgctatggtggccgccgccatagccaatgatggcaagcttatgcagcccacgctggtcgaccgcgtgcgttccgccgacttgtcggtcatttcgcagaccaagcccacggtcatgtcccatgcgttcagtgcggatacggccaacaagctcacccagatgatggaggccgtggtcaccaaggagaacacgaatctggccatcaacggcgtgcaggtggccgtcaagacgggtaccgcgcagattggaaacggcaatacgtccatcgacggctgggtgatcggattcgcgccggcggacgatccgaagatcgcggtggcggtcgtggtgcataacgtggacctgtacggctcgttcgcggcaggaccgattatgaaagcaatgatgcaggaggcgctggcagaatgaaactggttgaaggacagctcatccaccgacgctacaggttggattcccgcctggcccaaggtggtatgggtgaagtgtggaaaggctatgacatccaacttggacgtccggtggccatcaaggcgctacgtggcgatttgggcgtcacccaggaggccaaactgcttcgtctgcgcgcggaagcccataattccgccaatcttgcgcatccgaacatcgctgcgctgttcgaatattacgagcatgacggcatcggattcctcatcatggaatacgtgccgagcaagtcgcttgcagacctgtaccacgagcagaacggcccgatggacccgatcaagctgctgccgatcctcattcagaccgcacgcggcctgttcgtcgcgcattcccatggcgtgatccaccgtgacgtgaagccggcgaatatcatggtgtccgattccggcgaggtgaagatcaccgacttcggcgtctcctactccaccaatcaggagcagatcacgcaggacggcatggtcgtgggcaccgcgcagtacatttccccggagcaggcgcagggcaagcatgccacgccgcaatccgatatctattcgcttggcgtcgtcgcctatgagggcctgtgcggacaccgtccgttcacgggcgccacaccggtcgacatcgccgcagcacatgtcaataatccggttccgccgctgcccgacaccgtcgatgtgcagttgcgtgaattcgtcatgtcgatgttggccaaggacccgctggaccgtccgaaggacgcgctggtggtgtcacgcaccctgtcccgcatcgaacgccgtctgctcgaccagcagacgcagctggccgacacgatggtcgtctcttcgggaggaaggcttccccgacgtgtggtcagcaaaccccatatctccgtgagcaatgattggaaggaacagggatgaacatcaacatgcctacctctctggccgggggccgttatcagctcggccaactcgtcggccgtggcggcatggccgaagtgcatgtggcgaccgacacgcgtctggggcgtaccgtcgccgtcaagatcatgcgcgccgatttcgccactgacagcatcttccttgagcgtttccgccgtgaagcccattccgtcgcgcagatgaacaacccgaacatcgtgaacatctacgattcgggcgaggaaaccgtcaccacggaaaccggcgagatcgagcatctgccgtatctggtgatggagtacgtcaagggccagaccctgcgtgacatcctcaaggtgaatggcgcgctgagccagcgcgacgccgagcaggtgatgatgggcgtgctcaacgcgctcgaatactcgcaccgcatgggcatcatccaccgcgacatcaagcccggcaacatcatgatttccgagcagggcgtggtcaaggtcatggacttcggcatcgcccgcgcgatcgacgattccgcggccacgatgacgcagtcgcagggcgtcgtcggcaccgcgcaatacctgtctccggagcaggcgcgcggcgaaagcgtcgacatgcgttccgacctgtattccgccggctgcgtgctgtacgaaatgctcaccggccggccgccgttcaccggcgattcggcggtggcgatcgcctaccagcatgtgtcggaagtcgccactcccccaagcacgatcgtgccgggcctgccgaagatgtgggattcgatctgcgcgaaggcgatggccaaggatcggcagaaccgttacgccaccgcttccgagttcaagaacgatctgctgacgttcatgaacggcggtgtgccgatggctgccgcgttcaacccgttgaccgacctgaccaacatgaaggcccgcaagcaggccgaaatggatgccgccaccgtgcccatggcgccggcgacggatgcgccgacgcaggcgttcaatccggtcaccggccagttcgaggccgtgccgaatccgaatggcggagtcgaaacgaagacccgtgcggaacagcgtgccaaggccgcgcaggagcgtaagaagaagcagatcatcatcgcttccgtggtcggcagcatcgttgttttgctggccgtcatcggtattttcttcgcgttgaacgggcataagaacactgcggatctggtgtccgtgccggacttcaccgacacgtcgaacatttcccaggcgcgtgtggaagaacagcttaaggcccttggtctgaagcttgacgcccgtgacgattccacgtccagccaaccgaagggcaccatcaccaaacagaacccgaagggcggcaagaaggtggcgaagggctccaccgtctccgtatggttctccaccggcccgcaggcggtcagcgtgcctgacgtgtccggcaagacgcaggaggaagcgaagggcattcttgaggcggcaggcttcaagatcggcaatgtcatgaccgtggacagtgcctccatcgagaaagacaaggtggtgaacaccaatccggccgcgcattcgaagcagaccaagggcaccatcatcacgctgtatatttcgtccggtatgaccaagattccggatggtctagtaggccaggccaaggattcggtcatcgcgcagctcaagcaggctggtctgacgcagatcaccatcgaaagcgagtattccgattcggtgcagtccggtgcagtcacccgcatcgatccgggttccggcagcaccgtcgaggcgggaacggccgtgaccatctgggtgtccaccggcaagcagcaggtgagcgtgccgtttgttgccaactccacacttgccgaagcaaagagcattttggaggctgccggattccaggtaagtgtcaacgggccacaggatgatgacgcgaccgtcgtgtcgatgtcgccgaatggcggcagccaggccgacagcggatcgaccatcacgctgaccaccaagaaatcgtccagcgacacgaacaacaccgacacgaacaacaacggcaacaccaacaaccagcaaggcaactaacaaaatcaggggagggagcggctcgaagccgctccctcccctttctctttccctcaaaaaacaaaagcagccgaaggcagctccataaagccaaaggagctttgcttcccgcaggtcctgttcacgaccgtaagcttggccgaacggccttgagtgtgtcgtgaacagggcctgaccgtcgccgtcagctgcacgctcgcgcccgacttcagggagagcttgccattgctcacgccatcacccgagatcgacaccgaagataccggaaccggattgtcagccacagttacaacaaccgaagccgtcttgccgccagcagtcgctgtaatcgttgcagtaccagccttcacagcagtgaccttgccgtcggacaccttagccacagaactattcgagctggtccaagagatcgtcttgtcggtagcgttggacggattcacggtagcggtcagctgcacgctcgcgcccgacttcagactcagcttcccatccttcacgccgtcaccagagatcgacaccgactcgaccggaaccggctgcggagtgttgcagttcaccgcgctcaccgcggcggaagaaccatcccagctcaccttgccggagaattcgatgccaggctggctggcgccaggggtctgcgagccggagccgttggagaagatcacgcgatacgtgccctcgcccaggtccggaacctcgtacttgtaggtgccggccttcgcacaggagtcgtcggcggtcagctgagtcatcgcaacgccaggccacgtgccgttgttcttggacgtagcgtcgttgtacacgtacgcgtacaccttgtcccagccggcaggcttggtggcataaatcacgttggaaacctcaggcttcacgccagtgatattgatggtgatgctatcggactgctggttggtgccggcggtggcagtgatcttcaccgttcctgccttgaggccggagactttaccggtggaatccaccgtagccaccgaagtgtcggaggaggtccaagtcacgttggcacgttttcctgccggattcgtggtcacgtcagcattcagctgcacgctctgggtggagccgagatccatggaagttgggccggagaccttgattccggtgacgttgacgttcctccagtggcagggctccctggagttgatgtagcagtccggatccagcttgttcttcttgaaccatgcctggcaatccttgtcgcacgggctttcggtgccatcgttcggatcataggtcggatcgccgtacttggtgtaggaatacgtgtgcttgatggcttcgccgtccgcaccggtacccttcaccgtaaccgtcaccacttcgtcggacttggccttggcaccaatcttgatggtgtcgccgtccttataggagccggactgtccatcggaagtggtgtaggtggtgtcggaagcctgataggaacgcagcgtgatcagcttggattctccaggaatggtgcccttgttcggatatgcctcagcagtggagaccttgccggaacgggtcttgttggagaacgcagcgatggacttcgcgttcacggaaccggaggtgactttgccgccggacacggtgatggtggagccggtgacctcatccgtataggtgccgttggcaagcttggtggactgcccggcgaggttcttctccgcgccgttcgcgttcgccacaaccatgccgtcctgagcggcggaaccggcatagcgttccaccatcaggcagttgtcatcgccgcagttggagacgctggaatcctcgcccaccatggcgttgcggaagtggttcaccgcaacgacttccggatccttccacaggtcggagccggcgtcgccgagcttggagttctcggtgaacggaccgctgccgtcggcataagtgccgacaccgccggtgccataggtgccgccgtccttgtacggacgatcgaagaacaggctcatgccgttcttctgcgcggtcacgccagcccagccgtacttgatccactcatcggacagttcctgcggaatattggcttcgccattggcgaagttatcgtgcgattccacccagttcacggacttgtcttcagtcaccttgctgtgggaggtgaagtggcttgcgccgaggttcttgaactgcacagcgttacgtacctcatggccgtagctggagtcggtaatgccaccaccgcgcggggagctgctattgaacaggttggcatagtcagcttcacggacgttggcgtcttcaagcacttcgccgtactggtactgggagccgttcttcagaatagtgttccagtagttcgacttcttgccgccgaagacctcatccggcagttcgatgtgctttgccgcatcatagcggaagccatcggcgccatcggccacggtctgcttgagcagatcggccatgccctgggtgacggtatcatcctgggtattcagatcccacagaccggaaagcttgtgctgggtgcagtcctcgcggttgttgtagtcggagatctgcttgtcctcatggaagtaggccttgttttgccatttcttggcaatcacgtcgaaatcggacgtgaagtggttggacacggaatcgacgatgatgcgcaggccatactggtgggccatcttgcacatttccttgaactcgtcttccgagccgaccacatagttgccgatggacatgtcggtgggctggtacacgtagtaccagttgagataccagttgccggtgccgagcttgcggttgtctttgatctttacgatcggctcggtctgaatggaggtgtagccggccttggcgatatctggaatgttctccatgatggtcttgaacgaccactcgaaggcgtgcagggtggcgccgtccttcatatccttcggcagaccgtacttcttgcgcgcggcctcgaaggtcggattgccgacagtgtcggcatagctgtcgcgggtggcggcactggcttcttgcggagcggcggtgctgatggaaagacctgcgaacagcgtggtggccgcagccagaagcgccacggtcttcttgctcagacgagcaagcgttgctgattgtttcatcatcttccttgattggattggttttgtttaggcagggctggggcccggttccgttggagtatggaaccgggccccagccgattgttttcccggccgccgaaatgtagaacgtggtcatgatcaccgtcatgaggttcagcaggaagctgaagaatccggacaccgtgctgatggcggtgcccgcgaaatccgtgacccacgaggtctggatgttcttcagaatctcaccgccgagactgttgatctcaggaagcttgaaatccgtgtattgcgccacgaaatcgcagatctgctggtagagggccggcagaccgttgcacaaagcgatgacctgctgcacgaacagattgccgaacagaccgaacatcacgcaaagcaggacacccaacatcagcaacgcgaaaatcgaagcgaacgaacgcttccagccatgcttgaccagcggaatcaccaccggctccacggcgagcgccaggaacagcgagatgacgacgtcgatgatgaggtattcgattttgccccaactgcgccagcagaaggagagcagcacgatggcgatggcgatgtacagcagcgcgcgacccagccattccggaggtctgcgtggatcgcctttcgcagggaacagcgtgccgagatcccaacgcatttcgtcggtattgccgcactgtccggacgttcccgtcctcttgtccgtatccatatgctgttcgcgttcgctcatggctccttattgtagacaggcaccgtgtacgggctggaacctattcttgaaaccatgctgaacgtttcaattgtcatccccgcctggaatgaacaggagcgtatcaacgattgcctgctcaacgccacccggcagaccgtgatgcctcatgaggtgattgtcgtcgataaccgttccactgattcgaccgttgccgtggtggagcagttcatgaaggaccatccggaagcgccggtgaagctgctgcatcaggatgatgagcagggtctgattccaacgcgtgattatggtttgaatcatgccaccggcgatattcttggccgtttcgatgccgactgcatgatccgcccggactgggtggaggtggtgtccggcattttcaccgaggatccggatgcgatgggcgccaccggtccggtgatgtattacgatttgccgagccgtcatttcgggcttcgcggggacaattccacccgcaaacgtatttatagggccgatgatgggcaacctctgctgttcggttccaacatggccctgcgcgccaccgcctggcgcgaaatcgccgacgaggtctgccaagacaaggcggatgtgatgcatgaggacatcgacatctcgctgcatctgttgggcaaggatctcaagaccgtgtattgtccgcggatgatcgcgggcatcagcgcacgtcgtatggacacgtctccggcatcgttcctcaactatatgcgccgtttcaagaacacgttcaacgcgcatccgcagcattaccgcaagcacaagccggaaatcctcatcaccgcgttatatcctgtgatgcatctgctgtatccggtgtggcagaaggtgttgaacaccgctgatatcaatccggccgaggccgcgtggatcaacgagcagatggaattggccgaacaggaaggccatgagctgtatgacgacactcccactgatgaggagtggagcgagaagcacgaggaatagcgattaggtatagcgattattcgcggcgtattttccgcggatagcgaacggacggcaccgaccatgcgatcgatgccgtccgttttgtttttacgattgcggttttgcgattgcgtctaccgcagtcggacctacatcaggctcttgtagatggcgaggatgtcttcctgggtggcctggcgcgggttgcccggcgtgcacacgtcgtggaaggcgtcatgggccagcggctccaggtcggcttcggtggcgccaacttcggagatcttggtcgggttcttcagatccacggtgagcttgtgcaccgcctggacggcctcttcacgcacggtttcgatgtcgccggtgtaggcgtcggcgataccgaaggcgtcggcgatgtcacggtacttctcgccggtgtagtccttgttgtattccatgaccggggccagcaggatgccgttggccacaccgtgcgccacgccgaggcggccgcccagcgggtgggccatgccgtgcaccagaccgaggccgacgttggagtaggccatgccggtgatgtaggaggcgtaggccatctgttcgccggccggaatgtctccatcggcgctcttggcgaggttcttggcgatcatgcggatggtctgcatggacaggcagtcggacaggctccacgcgcccggtgtgatatagccttcgatggcgtgggtcagggcgtcgagtccggtggccaccttgaggccgcgcggcatggagtcggtcaggtccggatccacgaaggcgacgattgggatgtcatgcgggtcgacggccacgaacttgcgcttgttggccgtgtcggtgatcacatagttgatggtcgtttcggacgcggtgccagcggtggtcggcacaccgaaaatcggcacggacgggttcttggtgtcggccacgccttcaagggacagcacgtcggcgaattccggattggcagtcacgatgccgatgcccttgcaggtgtcctgcggggaaccaccgcccaggccgatcaggaagtcggctccggaggctgcgaacttggcgacgccatcctggatgcactcgaccggcggattcggcttgacgttgtcgaacacctcatacggcatgcccgcctcgtcaagaacgtcggtgaccttcttgacggtgccggtctccagcagcaccggatcagtgacgatgaacgccttggtgaagccatgggacctggcgacgcccggaatctccttgatggctccgcggccgaaatacgcggtctggttgaaaatcatgcgatagaccatagtgctctcctttaagcgactgtgtgttcaagcgaagaccacggcatccattgccgcggccaacggtttcatcataagcccttttccatgcgaggaagcacccacgacacacaattttttcgtcaatatcccacaacaccggcaaaaccggacagcataccgtccgatgcccgaaatcctattcttcggacgacgtgtcttctttggcgaacacccacatgacctcgtccacggaatgggtgtcggggaaaatcgtaatcaggagccgttcgccgtcgtttctgacgtaggcgtaccgtatagcgccttccctgcatatccggtcgcggacgtaatcgtagtcgaacagcatgcggaagccgtcccggtaggccggcgccaccaatttgtcgcaatagtcgagcagcatctcgtggaaggaaccgccatgtttgtcaagcattttttgcacatagccgggaaccacgaccggccgttgcgtatcggcacgcagattgaccacataagcgatcgaataccgtgtattcaaatgctgcagcaacgattccatgtctttgttgcgtaccaggatgtcctcaagctgcttgttcaacgtgcgcaactgccttttgccgctgccgctggcgtagtagcgcttcttgtccttgcgcatctcgttttccgcctggttgaccagatccggaatatcctcgccgtcatcggattcggccatgcccacggacagctcgcaaccgtgatcaagcagctcctgactcatatatcccatctgccgggcgctctgcgccatcgaatgggcgaaactgatgatcacgaactcgtcgccgccgatgcggtagatattatcgtcgccgaaataggcgcgcgccgcgtccgcaagctcgcacagcaccacgtcgcctctggcatgacccaaatgattattgatctcatgcaggccaatcagatctatgtacatcaccgtcaacggcttgtcatgggtggcttggatgaattccacatcatcgtcgaaagcgttgcggttgagcagccccgtcaatgaatcccgtcggtactcctcgccgttcaaccggacaaaggaccctatcggcaggttccggccaaccatcaccacggcccatggatcgctttcggagcattcacgtgagggaatcaccgcgaaggagatcatgccggttctggccagcacctcactgcggtacactccgaacgcggatttctgcgagaacagcagcgaacggagcgaagccagatccatatcagcacggaacctgtcggcatcgtccggatgcaccacgcgttcggcgatcagcgtctgcacgtaggtttcgaaatcatcggtttccggcgtcggcagtatgccatcgcgtttgaccgcgcggtactcgcccgtcttcacattcagtcgggagagttccgccacgccattggccagaatctcgaaggtgctggcggcgagcgcggacgtctcaagcatggtacggccgttgacgggcacatagctgccatgcatgaaatcgtttgacatatcccagaaatgccggtcgtcgggacgttcggccaacagcttctccatccgtcccaccggaagcggttcgtggaagtaatacccttggatgtaccggcatcccacggacagcagctggtcgacctgctgtttggtctgtgcgccttcggctatgaccagcagtcgcagctttctggccatgttgaccaccgattcgacgattttcagccctttgctggcattgtcctcattgaggtcgatgaatttcatgtcaagtttgatcacatcgacgttgatgtccttgagcatgttcagcgacgaatacgccgatccgaaatcatccatcagcaccgcgatgttgtccgcatgcagcttgcggatggtgctttccactttggacaggttcctggccacggcgctttcggtgatttccgtttggagcagccgagcgtcgacatcgtattcgttcagcagtccggtgagcgtgtccgccacatccatctggtcgatgtccaccatggagacgttcacggaaatcggcaccagattgcggccctcacgttcccaacgtgccagcatccggaccacggaacgccatacgaacacgtccagtcgggagatttgtccggcctgttccagcatgggaacgaacctgcccggagataccacaccatatttggggtggttccaacgcaccagcgcctcggcaccgacgatggcacccgtagccgcattgcatttgggctgcaggtagaagcagaactcgttgttgtcgaacgcacggtcgatctcgtcgaacgtcagctccggcacaagctcgtcggtggacggcgtcctgcccatttccggtgtgtcagccaaacagattccttcctgtcaccacgtcctatccgtgatattcaccgttgtactgtatcagggtgacgtcctcaacaccctcgatggcacgaatccgctcggcgaacgtcatgtccttgtcgtcgcagaacacttccacggccatctccacatggtcgccacgcatggttttggatttgacgaagaacttcgtgcggccgaacgcgcgcgtgatgtcgtccccgaccgcgtcggaagcgtaatggatcaccgcgatgtacacgcggcccttgtcctgatgcgaatagaacagggcgagcatgccgatcatcaccgcgccggcgaccaccaccagcagatacatgcccgcgccggccgcgatgccggacgtgatggcccagaacaggtacaacaggtccatcggatccttcacggcggtacggtaacgcacgatggacagcgcgcccaccataccaagcgagatcacgatgttcgtgctgatggccaatgtgaccatgcaggtgagcacgcacatgcccaccagcgtcaccgcgaagctgcgcgaatacacgacgcccgtgtagaaccgccggtatacgcagtagatgacgatgcccaccagcagcgccaccagcagggccagcgccattttgggcacgttgtattggctgaaggagttcagcaccgatttcttgatcatgtcgtttacgctcatggtttcgctttctcttttgcgattgttcggttattacgttttctacgattgccgatgttttcagctgcgcgttttcgtccgtctgttttcggtcttccgcgatacgtccgaccggtgcgctcaagtcacacgctcggcacgttccagccttcctgccagtagtcgaaaccccgcagatacgaggctttgtcatagcacagcacgtatttcgaggcggccgttatctcctgcgccttgcctggcagaatgtcacgcacgatctgcggcaggaattcggtgaatttgacctccatcaccagcttgcccggctcaagtaccggcagagtgggcagaccacggtcgaaaacgtcgaatccatccaccgccgcgcgcacgttcatatcgaaggtgatgcgcaccgtgcccgcgtcgaggatccacggctcacgctcgtaatcgacgatcacccgcggccgcagcacattgctcatgtattccacatagaattcccggcacaacggctcttcgctgtgttccaaaaatccgacatcgccggccaatatccgatcgaactgcccatgcgtgagcgacgcgtcctctttgtatatccagctgtcgcgcttgcgcttgcgttccagcttgatcacccggtcgctgtaatcgtaaatacggatacggtatttcttgcgcatcagcacgccgtccaccttctcctggtaggcggtgttccaataatcgtcgaaatacaggctgcgaatcatatagcagccgccacgcgcatggctgtcctgttcaagcaacggagccaaacgcaagttcagatcagctttctgcccgtacgaaatcagatacttgagctcatgccggtaatgttcctcacagcggcgcggaggcatggaaagctcctcgccgacacggcggcggacccgttccagcagtttcgacgccccgccatcaccgcgcattgacatcctccactatcttcccggatttgatgtagaagcatctcgtgccgtacgtcttgccggtgtcggtcatgtagtagtcgaaggcgtcctgcgtcttgccggaggcgttgcgcgcccgcactcgtatgaaatactgtccgtcgcctggcaggtccgtcaccgtctccggcaatgccagatcggttttggagaagatgacgtcctcacacagatagtccttggcgacggtgacgtcgtagctcagatcctcgccacggaaatcgtacgaggtgtcccagctgaatttgagtttgccgtctgcggcctgtggagcgtcgatgaaaaacggcatgggcttgtcgaagctttctttgtagatcctgtagttctgcgcgacctcgtcgtgcagctgccccgccacttcgtcatactgggcgcgcgtcagcggctcgtacatggaatcgggcgtcctccacaaatactgcctggtgatggactcgtagtggtccaccatcgtattgatgcgttttgcgctcatatagcggtattcccgcttcacggccttgtcgagttcgtcgcggaacgatttggtctgcaggcagcgtttgaacagcacgttgccccaatagttgctgactccctgctcccagctggaaccggtggagatattgcggatctggttctccttgcgcatgagcatgccgtcattgtcccagtccagcacatagaaggtgtcggaattcgtagggctgtacaggtacatgttgcggctctgcgtgtcggtgttgccggtcagcagctggaacgccatccagtatgcgagattttccgtatcgaaatatttgccgaggatgctgctcatcggcaccgaataatcgttgagctggttgagcatggcgatgagtttggtatggtcgctgttgcctttgacctccagcttctcctcgaatttcgacagattgtatttgggatcgtcggcgagtctgatcacgtccgcgtcgcgttggaattcgaagtagttgaccttgtacagctggccgttcttgtcgaggccgtgcgcttggagcgcgcttttgttgagctgctccacctgcgtgtacaggccatagtcgtcgaaggagttggaaccggaggtttcgtccttgacgtacaggtgcacgaattgcgtgcgcagtcccatcatctggtcgatgccgcggatcaggtcgtatgccatcttgttgcggaatcgcagcccttcgcccatatgcttgttcaatgcgatggtgcgctgcccgcgccatttgcctttgccgcttttcagctcgattttgtagttcttctgcttattgagactggacgactggccgcgcacctgcacggtggcgttcggcgctttttcaccgtagccgagttcgccggatacaggcccctgttcgtcgccgacctgcagcagaccgttgacttggtaccggttggtgcgcatggccgcgtaatcatccacggaatactggttgatttcgctccaactgtggtcggtgccttccgacttgttgccgcgcgagaccgtcagatacatggtttccacaccgctgtcgtcatacaccttgtacagcgagtcgttgtcacgcagatgcgcgccgtcaagcccctgcgtggcgcttttcttgactttctcatgctttccttgcgattgcgccgccgatttgtctgccgtggaaccactgtccgcagcgtttccgcaggcgacgcaggagaacgtcgtcacgaccgtggcgatgatcgccacgcatttgaatatggcattgcggccgcacggccgattacccatcgtcattcgtccgttcctttccatgctttccacgctttccctcatgattccttccgtccgaaagttccatgcagccgttcgccgaattcgtccaacgcttcgcccagtttcgtaaaccatccgcgcttttcggtcgccacaatcggctgcgcgccgagcacacgatacggcagattgtcggtgaacaccgccaatcgcacgaccgcggccagcaggaacgccgacgcgcccagcaggaagccgaatcccatcagcgtgaccggaacgaactgcgaaatgacagtcaagacagtggccgacccggcgaatatcgcggcgcagcacaccgcgccgaagtaatcagtgaaatacagcagaatcatcagcacggtgttgccgaccgcgtacagggcgtatccgacgcacagcacacggaaataaccatgcatgccatcgttgaaaccgagcggcagcacgcccaacaccatcttttccaacgagatgaccgccgcggtgacgaacagctgcttcaacgcggtgtagtacagctcacggttgagcacggcgagcatctcgcgttcggccaccacgatgtccttcacggtgccgccgtcgttgagcagcgcgtagtaggcacggtatttcggatagaaattgacttccaccgacaccacgaaattcacggtggtgatcagaatcgtcaggaacgccagtaatgcgggcacatcatagtagggggcaccgtagaacagtcccttcacatgcacgccaagcggaccacaccaggtgatcaccaagtgggagaacaagccgagggtggtcagcagtcccgtcagggcgagcggcaggaaccggtccagccatgcgaggaacgtccacgggctttccgagctttgcgggaaataccggtgcagcagcaccacgtcccagaccatcatcacgccgtagccgaacgccactgcggccagcaggctttccacctgcggcaggcccagcgccatcatcgcgcatgcggacaggaacgccacgaccaccgccgcgacgaacgaccacatgatgccttggtaatccttgatggccgtcagatagctcatcgcattccaattgacgatcatttccaggaacagccataggcagagtaacccctgcatgagggtcgcgccggaaaacagcaggaacaccgcgtacagcaccgcacccaccgccagcatgagggtcgtggatccccagaacgatggaagaatggtctcctcatgatgttcgaacagcatgtccgcaaggaaacgcgtcaccggcatggacaggaagctggtcaacaccaatgaggcgagcagcgtgtacgtgatcatgcagaccagcagattctggtccgcgcggggcacgtgccaccaaccgctgaccgccagcacgccgaactgcagcaggatgcccagcagcatcggtccggtgcagatcacaccggcataaccgtaggcgcgcaccatggcgaccaggcccttgcggtggaacagtttcttgagttcgaatccgattcccgccatatcagtgctccaacccgtaatggtcggcggtatcgagatacagcgcacggtattcgtcaagcatgcgctcatgccgatagtaggttttcacgcgttcgcgtcccacttggcccatggcttcgcgcagcttgcggctcgcgcacatgcgttccatggcgcgggcaaggccctcgcggtacatcggaggcacatagaagccggccacgccgaggtcgtcgccttcctcgccttccagcagttcacggcagcagcccacgtcggtggtcacgcaagggcgggccgccgcgaacgattccaacaccgacagaggctggccttcggagatgctggtcagcaccgtgaaatccagtttgcgcatgtattcgaccacattcacgcgtccggtgaattcaaggttcttcacttcaagctgtttcaccagctcatagcattcgtcggcatagtcctggtcgtccacaccaccgaggatgtgcagcctgacattgtccacgcggttcgacagttcgctgaacgcgtggatgagggttttcacgtccttgatgggagccagacgtaccacggcgccgatatccacccaaccgtcctcaggcttgagtggaatgtcgcagaaccgttcgtattggatgccgttgggaatgaccaggcatttgcttgccggagcgcccatgtcgatctgggtctggcgagcgcggccgaacaggctggtcacacgccatgccctacggtagatctcctgtgacagcatggcgaagaaacggatccaccgttgccggaacgcgggcgcaacccattcggcggaaagaatctcctcctcgcgttcgcgcgtgtagatgccatgttcggttagtaatacgggtgcgtggttgatactgccgcccaagcatgccagcaggccgccgtaaccggtggagatggcatggtaaatctgcgctttcggcacttctcccgtcatcaggtacagcaccggcagcagcatggatcgcacggtgtggaacgcatccgcgtaggcgacgtacgggtattcctccatgcagatcttcgtaaacaggtcgataaattcgttgctttgcaggaacgacagcggatgcacgcctttgttgtggaacaggttgaacagtacgtcccagtcgggatcgctcagattcaccagctcacgcagtgccttgacttcctcgtcggtgaagatcactttcgcatgttcaccgctcagacgcaacgcgtcgtcgaggaacacctcatgcacttccaccacgttggatggaaggtcgtacacgaatttgccacggtccttggctttcgcgccgatcacccacagcacgaactcgtgttccttcatggcggtgatgtagctgtgcatccatgtggacacgcctccatgcacgtacgggtagcaaccttccaataccaggcagattctcatgccgcgcctccagccttgcgttcgacgtgcactgtggagtccgtggccttgatgaggtacagattccccgtcatccggatcatgcttccgccttggattctgccgggcgtgccatggttcgcgcggagcagcagccaagcctggtccttgaaattgcccaagtcgaattcccactcattggcggattccctcatcttgacagtcagtccagaaaagcgttgcaccgcggacgcgcattccgtgcctgtctgcatgcggatggacggtgcggacgcttcaagccagtcgagatagttctcaaggccttttctgtagaccgcccagccttctttcgcgccacggtcagggtcgagcatgtcgtccggatgcatgaagtgggtgctgacgaaatgcatgttcagttcggattctgcggcgagccgcatgtaatctcccaccatgccgccggagacgatgcgcggcgcctcgacgatgccgtcatcggccacaccgaattcctgcacgtaaggcagtttgctgtcgcttggcaggtaggtgctggcgatggtgcggatttcgggcacgtctcgtccgattgtctgccgtccttccttggacaggatgttggacggcggcacatataccgacgctgtggccgccggcagcacggacttttggaatgcgatcagctcgcgcagcgaggcgacgacagctttgcgattcggccactgatggtacgcgtattcgtcgccataatcgatgttcggcagtacgagcggctgatggttgtagccatggtagccgatttcgccgttctgtttgagcagcagtccgccgaaatagctgaaatgcgattcgtccttctgccgtacgggagcgtctttcgtatcgtccccgtaattctcgatcatcacgccggtaaaccgaataccgtagcgttccgcgagtttggtcaggtccggccaccagaccttcgaatagaagtcggcgatgctcatgccgtagtcgcgtttgatgtaggtggcgtctccgctggggaccggggatggaaaatcgtccagatagaacgcggcgctgttgatgaccgggtatgccgtggcggaacccagcaggctgaacgcggaggcatagaagccgcgcaccaccttgccatagatgccgatattgcaggtcacggttcgtccggaacgcacatcggcactccagatcagtggcgtatggccgttggcactgaccgcttcgacggtggccttctcattgaggttcagactcaacgacgatttgaacgggccactgaacatgtaggtgtgcccgccacccagcataaagtccctggcaggcttgatgcctttggtcatcacgtagtcgtatgcggaggattcgatgccgatttgaggcccgatcgcgtccagatagcctgttttttcaggcgtcatagcaagcatcatgttgccgccgccttcaacccatctcatgatggacaccagctcatcccccagcgaatcaagttccggcatgacgatcagcacggtgcggtaccgattcaatgaggggatgtcgtcgggatcggttttggccagatccacggtggcggtcggcactttcatgtcgagcagcacctgtttcatcatggcttcggcctcgtccacaccatcctgggaactatccacgagcatcaggttcgtggcgcgctgccccatgatggcgttctgggccggaatggcctcgttacgagccatgtatttcaaagtgaatttcgtcgcgccgtagtggatgcccaaggtttgcgccaacagcaccaaggcgatggccatgaatacggcccacacgcggaccaggtttttccaacggaagcgcttccatatgcgccatgcggaacgtatcatgcgcgcccagcctccttgtagccgagccagaatcgcaggatgtcgtggcctcggccgccaaggtagatgtggtcgtccttgatgtgccggacggtgcgttgcaccgcctcgccatcgtgacgtgcggcttccaatcgcagtttcatcagccagacgtcaccttgacgcggccatgcggacagcgccgcttcgatggtgcgagacgcggcatcgaacgaaccgagatccatctgcgtcttcgccaacgagcatacggtgcggtagtcgttatgccgtttgagccgttcggcgagcaggtcggcgtatcggcgcatctgcaacgttctggcatacccctgttccatggaggatttcaagtagtgttcgagcgcctcacggtaccggtcgagcgcctcgtccgaatcgcggttccgctcgtattcctccatgcgttgctgcaacgcgatgtcttccttcgcgctgatctgcgccatggccgtggccgcgtaatgcacgacttccacgtcctcgttcagacgggcttgggagagcagattggcgtattggccgggattctcgttaagaatggacagcatcagattacgacgctgccgtggattgtccacgatcagcgcctcttccaacggcacggtgttggcgtaatccgtacggtcgtccacaagaatgttgcgttgttcctgatcctcgaccttcagttcctgcagaccggcgggaatccgtcgtcccccacgaagcacggcacgcgaatgcatgagcgccacgctcaacggcccccataggggaatcaacgccatgaacgggagcagcagtccatcgactttcagcactccgacgtggtgcagcagacacagcgtcatgcagaccagcagatgcacggcgatgatgatcaacgcggcgatagtcgtcgaccccatcagctttcacccccatcgtcggcttgcgcgatatgcgattgggcttcggaaagcagggcatcctcttgggtctgcggaacgtaggagcagtgcaagccggaacgggtcagacgtttgaggatgatcggcagttccttctcccccgcctggttcatcagcagatacacgccgtcatccgtcagcatgccggcctcatcggtctggcggatgctttgcatcagcagggagtccacgtcctcaaggtttccctcgcattcgactttgagcagcagatggtcgcccatatggtcgtgtttgaggtcgttggcagccagcaccttcggcaggaacgcttctggcttcagcaggttcgttcccggcaccagcatggaccggcgcgccacgtcctcgtattcgaaggccctgatcatggccgattcgaccagaccgcacatgatgctgaacagattctggaagtacaggttcatctggtccggtttggcctctcccatggtgatgatcacggccagttcgccacggtcacgcacgccgacggcgtacatcgggaatttgtcctttaacgttcggttcacccatatgccgttgtgttccagcgcggtgatgatttcaccgtaatccgagacgcgtacggagcggaagctgccgacgtcgaaccgtgggctcgccgccacaagacgggcgaactgtccgctgttgtccactcggaagatggcgaggctgtcgctatcgaggctttcctgcatgatgcggatcgccgtatggtacagcttctgcggttgcacttcgtccaattctcgggtcacggcgtacagtttgccgaaactgtcgcgtctgccgatgatctggtcgcgcaactgtctgcggtcgtcgagcacatcctgatacagcccgcgcaggaagtccagacgattgcgcaacaacccgttctcgtcgcgcacgaacctcacgctctcctggttgcgcgactgcacatagccgcataccgatccggccacgaaataaatgacgaaggcaagccagttcgatgtgtcgtagaacaacggggcgaaggacgcgccctgcgacgcgtaggacatggccacgccggcgcaggccagtacggctgcgaacacgccggcatgcagcccgtagatggtgccgacgatcaccacgaacagcaatcgcaggtccacggtttccagctggctgttgccttgtgtaaaagcgcggagccattccgtcagcaggaacgcgccgatgatttccagcacggtccaccatttgttgtggctgcgtaggaaatcccataccggatacttgtcggttttgttctcgcggagcttcaaccagccttcgatgacgtgcggaaaatcctcgcgaagcgagtatcgtggcgaaaagccgtaccgcaatcgcaattcgtggtcgtcggcggggtatgcctgcggacggtcctcgccgtatacgaccttcgttcccggaaaatatcccgcgatcagcgttcccaaatcgccgtaagtgaagtcgaacacgttcggaatgtggaacagctcgctgtcggcggtccaggcgtcgaatatgcggtagataagttcggccagatcgtcggcgcataggaagcaggtgcgttgttcggcgcgttcatggaagcgcagttctcccgcttgtgcctgttcgaacaagccgttgaaatatgcggtgacgccattgcgttgcggcgcgtacagataggggcagcgcacgatcttcacttccagatcgtaggtgcgcgcatagtacaggccgagctcttcgccggcacgcgacatcaggcttttgctggtctcgtgcacgtccgtttcctgcggataggcgaattccgattccggcccgctcaccatcagcatctggaccttgcgattgcggacggtgtgcagcagtcggcgcaggtagcccaggtcgccgtcacgttcgctgcggggcgtcagatcttcggagaagtagacgattcgatcgaattcgtagttggagaacacttccgacacggcgtcacggtcgggcatgtcgatgattttgagatcctcgccgctggattcggtccctttgcggagggccaccaccaccttgtcttgggggaacgtgtgctcgatccactgcttcgtcacgaagtcggtgttgccgattaacagtatctccactcgcctcaccccagggatacacccgtttagaggtcaacatcatggaacagtacagccgtcaaccccttgtctacctgcaccatagtttagcaacagaggggacagaacatcccccttcgttgggggtaatgggcgtatgtctttcgccgatatggttcggatggcgcttgtgttggaaaacgagcggaaatcacgcaggtaaatcggaaaagatatgcgagaaaaacaaaaccccagattgctccggggtgtatctggtggctccgagcggcatcgatccgctgacctaacgattttcagtcgttcgctctaccaactgagctacagagccatgaacaacttgcgttgttctagcgaccacggccggacttgaaccggtgacctccgccgtgacagggcggcgctctattcctgctgaacctcatgacggtgatcatgaccacgttctacatttcggcggccggcccgaagctgcgccgcgcggcctgccagtggatggctccctccgcgcagcgccggttcctgttcgtctggaccgtcagccagacgcagatctcatcgttcctgttctcacgtgccatcctcgccgtgctcaacgcgttcttcacctcgatctgcctgatggcgttgcacgtgccgtattggatgccgttggcgttgttctgcggcgtcgtatcgcagttcatcccgatgcttggcacgtacatcggcggcgcgttgccggtgctgttcgcctggggcagctgtggtttgtggcaggcgatcgccgtggtggcgttcatctgcgtctaccagcagatcgaaaacctgatcttcgcgccgaagatctcccgccgcaccatggacgtcaacgatgcggtcgccttccttgccgtcctggccttcggctcgctgttcggcgcgatcggcgcgttcctggcgctgcctatcgtcgcctcgatccagacgatcgcccgcacctacaccaagcggtacgatctggtcgattcgccgctgatggacgatccggttccggacaagaagtcgaagctggtggaaggcgccgaagtcatcagcgagcacctgcacgccgtgccgcgcgccgtgcaggggtcgagcgcgcatgtgccgattcccgacgacgtgcgcttcctgcaggagcaggcgtacaatatcactcggtccgacgagaccggggatgccgacgaatcgcagaccgtcgccattccgaagcacgtgttggacggggtcgatcgcaagccgctgcggggaaccgcggaagcggacggagcgcagacggaagccggaccgcaggtagcggacgggtcgcaatcgcagggaacggatgacaatccgagaagtaggtggcgttaatggtattgctgagcgtacttgatgtcgtgctggtggttttgggcggcgccggcatgctctaccaagcggtctgcatcgtcatctcgctgttcgccaagccgatcaagttccccgaagcgccgatgaacaaacggtacgcggtgctgatttccgcgcgaaacgaagcgaacgtcatcggcaacctcatcgactgcctgcattcgcaaacctatccgagcgagctcatcgacatctggctggtggccgacaactgcaccgacaacaccgctgaagtggcccgaaacatgggatgccacgtcatcgaacgattcaacaaggagcaggtcggcaaaggctacgcgctgacctatctgctcgaccagatgaacgagtcgggcgcatccgacccgtatgacgcctttttcgtgttcgatgccgacaacaaactcgacaagcactacatcgaggaaatgaacaagggcttccaagccggtttcaaaatcctcaccagctaccgcaattccgtgaacctgtccgacaattgggtgtcgtccggttccgcgttgtggttcatccgcgaatcgcgcttcgtttccgcctcccgcatgtggctcggcaacagctgccacgtgggcggcaccggcttcatgttctcccaggagatcatgcgtcgcaacaacggctggaaattccacctactcaccgaggatctggaattcaccatggacagcgtgctgcacggcgaccgcatcggctactgcggcaccgccatcctgtacgacgagcagccggtcaccttcgcgcaaagctggcgtcaacgcctgcgttggagcaagggcttcctgcaggtgttccgctattacggaccggcgttgatcaagcgcgcggtcagggagcgtgatttctccgccgtcgatttcacgctgctgctgtgcccgttcaccgtgctcggcatcgcacgcgtgctgttgggcatgctgttcgccgcctgcggtttcgtgacatggcaaagccagctgaattcgctgaccggctggacatccggcattgtgatatcggtgatcggcatgatgggactcgccgcattgaccatcgtggcggaacgcgatcacgtgggcgccaccaacaaggagctgctcgcctacgtgctggccttcccgatctacatgctgagctatgtgccgatttcgttccaggcggtgttcgccaagtccgaatggaagccgatcgagcataagggctgaggcttgcccgcggcggtgtgaacggtcatgagatgtttcgtggcgatccatatggtgcggatggtgaaaagatgacgaagagagggtgtggtttggctatggatgacgctggcgattaccgctatacgcgacgacgccgagcgatcacggtggcggtttccgtcgtggccaccgtcgcactgtgcgtcggctatgcagtggccgacgtgtgcgatgtcgcaccgggcgtcctcacattgcgccatgtcgaacattcgacggtcgccgctgccggccgttcgatcgaggcggccgacgtgatcgccgacatcgacgcttccaagaccatcgatccggccgctgcgcgcgcgctgaccgacgcgttccgagcctcagccgccggcttcggcggcgaattctccatcgccatcgccgacgcgtcgggcaacgtggtcgcggaaaacaacatcgacgtgccccgcacgccagcatccaccatgaaaacgttgacggcgtatgcggccgccgtcgaactcgacatgggcaagaccctggacacgcagacctatctggaacagtcccaggacggcaccgcgcggctggtgctcaaaggcaacggcgacatgctgttgggagccggagcgtccgacgcgaaccacatcaacggacgtgccggattgggcacgcttgccgggcggaccgcacaggcgttgcggcagcgtggcatcacctccgtgacattggcttatgacgacacactgttcggcaacgaccgctggccgcaaggcatcgccgaactcgacacggaccacctgtactacgccccgacagcttccatggccgtggacggcggcaggaattggaacgggacaggtccggccaatcctgatgtgttctcggcgtatccggcattgagcatgcagccggcgcgtgacgcggcgctggtgttccagcagcggctggccgaacagggcatcacggttcagggatttgtatcgcaaggcacggttgcgggggcatcccatccgcttgcctccgtgcgttcggcgtcgttgaacgagattatggcgttcaccatgcgacattccgacaattcgctcgccgaggaattcggcaggctgctggcgttgcaggtcggcgcggacaattcgccggctggcgcggtgcaggctgtgaaaagcgtgctggagcgcaaaggcatcactacgaccgggcttgacatgcgcaattgttcgggacttacggaggattcgaaactgacggcgcgcaccctgctcgaagtgcaactgcgcaatctggctgcgggatcgggggcggccgcagccgaaggaatgtccgtcatgggcttcgtcggcaccgctgagagccgtctgaacgatgctgacgaagcggggctgatccgtgtgaaaaccggcagtctgggcgacgtgacctccatgaccggcaatgtgtcgcggttgaacggcggagcgttgaccttcgcggtgatcgtcaacaatcccaccgatttcgcggcggcgaaggcggccatcgacacattcgtggccggtctgccgaagctgtgaacggccacgtgtgaatcttcccagcggatattcagcatatagccagaaacacgtcattcgcatgtgccaagatggtgggcatgcgaatcgctgacgtacaagaagacattgatcacgagctgatcagcaaagaagagatctccgacatcatcaaccgtgccgcggcacaagccagtgaagactatcgtggcaagaacccgctgctggtctgcgtgctcaagggggccgtgaacacgcttgcggcgttttcccaggccatgagcattccggtccaaatggatttcatgagcctgtcgagctacggttccggcacggagtcgagcggcaagatcacggttcgtcaggatctgtccacggatgtgcgaggacgccatgtgctgatcgtcgaggacatcatcgattcgggcatcaccctggcttggctggtcgacgagctcaagcgccgtggagcggcttccgtggaaatttttgcgcttctggagaagccggcacgtcgcaaggtcaatgttgatgtgaaatacaagggacgtgagattcccgatgaattcgtggtcggtttcggcttggattacgacgagtactaccgcaacctcgattcgatcgcggtgctgaaaccgtcagtctatgaaggaggtcaggcatgagtttccctggtccgaaccagccgccaagcaatggcggcggcaacaaacccaacgggggcaataacccgttcaccaatccgtttagccgcaacaatgacggcaagaacggtggcagcggggcgaacggcaacaagtccaacggcccccgtccgttctggcagtcgccgtggctgtgggttgtggtcgtggcattgcttgccgtgaccatgttccagcttttcgccggtgcgggctcgcagaccatcgacaccaaggatggcatgcagatcctcaacggcaacaccgtcgagtatgcgacgatcgtggacaacacccagcaggtcaagctcaagctgtcgagcgattactccgccaccgacccggacaccggacgtacgaagaactacggcaagaacgtgcagttctactacacgtatgcgcagtccgcagccgtggtcaaggccgtgcagaaggccgatccggccaagggctggaccgcgtccatgcagcagaccagcatctggacctacctgctcacctcgctgttgccgttcctgatcatcttcggcctgttctggttcctgatgagccgtatgggcggtgccgccggcggcatgttcggcatgggcggcaagaagaacagcggcaaactgctcgacggccagaccccgaccaccaagttctccgacgtggccggcgaagacgctgccgtgcaggaggtcgaggaaatcaaagacttcctcaaggacccgtcccgttacaaggctttgggcgcccgcattccgcgcggcgtgctgctgtacggccctccaggcaccggtaagacgctgctggcgcgcgccatcgcaggcgaggccggcgtgccgttctactccatggccggctccgacttcgtggagatgttcgtgggccttggcgcctcccgtgtgcgcgacctgttcgatgaggccaagaagaacgctccggccatcatcttcatcgatgagattgacgccgtcggccgcaagcgtggcggttccggcatgagcggtggccacgacgaacgcgaacagacgctgaaccagctgctcgtcgagatggacggcttcgacaacgatacgaacctcatcatcatcgctgcgaccaaccgtccggatgtgcttgatccggcattgctgcgcccgggtcgtttcgaccgtcaggtggccgtcgaagcacctgatttggaaggccgcgaggcgattctgaaggtacacgccaagggcaagccgttcgtgccggacgttgacctgcatatgatcgccgtgcgcacgccgggcttcaccggcgccgaccttgccaacgtgttgaacgaagccgcgttgctgtgcgcccgtgccggcgcccagctcatcgacaaccgcgccatcgacgaggccatcgaccgcgtccaggccggtccgaagcgtcgttccaagggcatggctctcgacgagctgcgcaacaccgcatatcacgagggtggccatgcgctggtcgcggccgccatgaacgacaccgatccggtgaccaaggtgacgattctgccgcgcggccgtgcactgggctacaccgcggtcatgccaaccgaggaccgttactccatgtcccgcaaccagctgctcgatcagatggcgtacgccatgggcggccgtaccgccgaagaggtcgtgttccacgacccgaccaccggtgcttccaacgatatcgaaaaggccacgaacatcgcgcgtcagatggtgctcgactacggcttctccgagaagctgggcgccatcaagtggtccgacgacgagcaaagcgatctcggcgcgctcacccacaagtactccgcgcacaccgccgaaatcatcgacgaggaagtgctcaagcttgtggagaccgcgcataccgaagcatggaacgtcattaacgagaaccgcgacatcctcgacgagctggtacgtcagctgctcgtcaaggaaacgctcaacgagaaggagcttgccgccatcttcgccaacatcaagaaggcgccgaagcgcgaggtctggttgagcgacgagaagcgtcccgattccgacattccgccggtcccgattcccgacaagctgaagcaaagcgcaggattgaccaactgatgagcgataccgatttcgataccctcttcgacgacaaggcccgtgccgctcatgcggccgggcctgtcggctatgacgaggaaggcgtgcgccaggccgtgcgcctgttcttgaagtccatcggcgaggatccggaccgtgaaggtctgctggacacgccggaccgtatcgggcgcgcgtgcaaggagctgttcgccggcctcggacacgggccggaggaagtgctgaaaacccgtttcaaggtggacaccgacgaaatggtcctcgtacgcgacatcgaactgttctccgtctgcgagcatcatctgctgccgttccatggcgtggcccacgtcggctacatcccgcagaacggccaagtggcgggcttaagcaaactggcacggttggtggaactgtacgcacgccgtccgcaggtgcaggagcggctcacccagcaggtggccgacgcgttgatggaaggcatcgacgcgcgtggcgtgatcgtggtcaccgaatgcgaccacatgtgcatggccatgcgtggcgtcaagaaggcgcagtcccgtaccgtcacctcggcggtgcgaggatgcatgcgcgacgcggccacgcggaccgaggcgatgagcctgattctgtcgaaccattcgtaagtgcgctttaccgggcggaatcggacagaaccgaacggaagaacggaatgaatgaaggaagaaaaccgatggcgattgatatgaaggcgattcatgatagccggcgcacgttggtgatgggcgtgctcaacatcacggaggattccttctccgacggcggcctctggcttgctccggaggcggccaaagcccatggcgaggcgatgatgaaagccggtgccgacatcatcgacatcggagcggaatccacccgtccgggagccaaacgcgtcagcgaagccgacgagaaggcccgtgtgctgggcgctgtggacgcgctgattcccgaaggggcggtgctgtccatcgacaccacgcgcgcttcggtggcgttggccgcgctcgaacatggcgcgcagatcatcaacgacgtgtccggcggccagttggaccgcgaactgccgcatgtggtggccgaccattccgactgcctgtacatcgtgcagcattggcgtggctggcttgccggcgccgcgggcaatgtgccggacgccgacacctcccgctacgagcatggcgtggtgaatgacgtgtatgacgagctgatgcgtcaggtggatgcggtgcttgaagccggggtgcaggccgaacaggtcatcatcgacccgggcctgggcttctccaagccgggcgtggaacataacctgccgattctggcggcgcttgaccggttcaacgcggctggctatccggtgctgatcggcgcgtcccgcaaacgtttcgtcggctcgctgcttgccggcgccggtgtgaccgagccggacatggcctcaaaagacaacgccaccgcggccatcagcgccctgtgcgcggaacatggcgtatgggccgtgcgcgtgcatgacgtggcgaaaagccgcgacgcggtcgccgtcggcaacgcatggcgcgagtatgcgaacgcgtgaccgtgcgaatcgcagatagtcacaacatcgcaatcgcggaaataataggaatacggaacgtaggaacggcaaaggaaggctggtatggatcagattcgactgacgggaatccgcgcgacgggcaaacatggcgtgctcgacttcgagcatgagcgggcccagaccttcgtggtggacgccacgctgttcctcgacctcgctgccgccggccgttccgacgatctgaacgacactgtcgactatggtgcgatcgccaaaggcatcgtggccatcatcgaaggcgaacacgtcgatttgattgaaaagctggccaatcgtatcgtcggcatgattctcggctttccggccgtgtgccgcacgcaggtcaccgtgcataagccgaatgcgccgatcaccgtgccgttcgacgatgtcagcgtgaccgtggaacgttcccgtgaaacagttgacagtccatcgcgtgagcggtcgtcggaacatgggcaggtgcatcatgccatcatcgccatgggaggcaatcagggcgatgtgaccgccaccttgcgtgacgccgttcggtgcattgatgggcttccctccacgcaggtgacgggggtgtcgccgctctatcggaccgacgcatggggcatgccggaaggtactgcggaattccgcaatgcggtcgtgtccgtggataccaggctttcggccgccgaactgctggccggtttgcagcgcatcgaagcctcgcatggtcgcgtgcgcaccgaccattggacgtcgcgcacgctcgatttggacatcatcgactttgacgggcaggaaagcgccgaccccgacctgacgttgccgcatccgcgcgcatggcagcgggctttcgtattggggccgtggcttgcgcttgaaccggacgcagaactcgggggagcgcacgccggttccgtggcgcaactgctgcacgaaacgtccgaccgcgaccatatcgatgagatcgcggacgattggatggttgccggagctcaggatcccatagttcgcgattccgacattgggacgtctgcagatgacgttgatgcgattgacgatgccgattctgttgaatccattgattccattgaacttccggaaggtacggcggcctccaaagcagccgctgcggccgcggcgaaaccgggaccggcatcccgtcgagcggtcatttccctggatagcgtttcaactgatgcggaacaccagttccgtcaggcgatcgtggccatcgacgcgcttcccggaaaccaggtggaaggtatttcgccgctgtaccatgtcagccaggtcgacgactatccggacaaaatggccgccgtcatgcagatttccacgcgcatggacgcgcgtgagcttatcggtgcgttggaatcggtgtcatcctccatttcggatgacctcgacctcgaccttgtggacatggaaggcgtggtccgcaacgaacctgattgcatggtgccgtggccgtccgcacgtgagcatgcggccgtgctcgccccatggttcgacatggatccggacgcgaaactcggcagggatccggtcgcgttcctgctggcgatggctccggacgccgcgcaagtgggcatgctgaccgacaattggattatcggagacacgctatgagagcacgcagaaccccttggtggtcattcgtccttgcggccgcgcttggcgtgctggccggcatgggattggcgaaatacggcgagatttcaggcctgccgttggttggcgcaccctggatcgtgccggtggtgctggccgtgttgggcggtgtggtgctgtacatggctctgcagattcataaatacacgaccaaagatcccgtcaaacgcgcgcagctcaagccattggacccgcagaaggcgttcggcacgctggtggcctgcaaagcgctcggacttgcgggcgcggcgttggccggctggtacggtgggcagatcatcatgagtctgccgcatggtgaggcggaattctatagccaagccatcatcgaatgcgtggtggcctgcgtggtatgcgtcgccgacatgatcgtcggcatcgtgggggagtggctgtgccgcatcccgcctatcgacgggccggaaagtccggccgtgaaaaaggccgcacagcgcaatcgctatgcgaccgccgccacgaaggcgtctacaaaatcggctacgaatcctgccacgaaatcgaaagtctgaacgtcagaccttctttaactccgtctcagtccttcttcggcacgcggaacatcgcttcctgcgccatgcaggccaccagctcgccatcctgtgtgtagaccttcgcttggcccaagccgcgtccgtgcgccgcggtcggcgtgtcttgcacgtacagatgccactggttgatgtcgatgtcgcggtaccaccacatcgaatggtcgatggacgcatacgaaatgcccggcgtggcgatgcttaagccagcacggcgcagaatcggctccagcatgatctggtcgcagcccatcgccagcatcgcacgatgcatgacctgcggcacgtccaccttgccgtcggccttcatccacaccatctgcttgccggaatcctcgctggcgctcttcttgtcggcgccaagcatgatggtgcgcgtcacatggcgaatatcgaacggcgacttctcagcataatacttggcgaacggcgactgttccgcatacggctccatcagttgcttcgcgctggtcaggctgtcgggatcgggaatgttctcaggcatcgggtcggcgaattcgatgccttcctggtcatgttcctggaagctggcgattgccgtcaaaatcgagccctgcgcctgcgtgacattcacgcgacgggcggagaaggaacgtccgtcacgcagattttccacgtcgaacagcagatcctgacggatatcgccggccgaaatgaaatagccgtggatggaattcggcagacgggatggagcgacggttctcgacgcggccatcagcgactgcgcgatgacctgtccgccgtagactcggccagtggggaagtacaggctttcgccgttgatatacgtatggttgcgatagtttgagggcgtgcccagctggagcacctttgccagtcgctgcagcggcgtcatgtctgtctgcgtcatgatggcctcgattccttccgcgtgtggatagctctttatgctggcatcgagtctatccatacgtagtaaatttcgtcggattgttttgtaacgagtacgtgagaagaaatgaacggttggttagcggcaaacggttgacgtatggcaaagcgccaccgctcgtaatgaagggtggcgctttgctgaaatctgcgcttaacgcgacttgattaaatctgtctgcctttagcgggtcagcttgcggtgcaggcggtgcgggcgggccgcatcctcgccgagacgggcgatgcggttctcctgataggcctggaagttgccttcgaaccagtaccagttggccggattctcgtcggtgccctcccatgcgaggatgtgcgtggccacacggtcgaggaaccaacggtcgtgggagatcaccacggcgcagcccgggaaggcgagcagcgcgttttcgagggattccagggtttcgacgtcaaggtcgttggtcggttcgtcgagcagcagcaggttgccgccctgcttcagggtcagcgccaggttcagacggttgcgttcgccgccggacagcacgcccaccagcttctgctggtcggaacccttgaagccgaaggacgccacgtaggcgcgggtcggcacttccacgccggccacctcgatgaagtcgagtccgtcggacacggcctcccacaggttcttgttcgggtcaaggccggcacggttctggtcgacgtagctgatcttcacggtgtcgccgatcttgagcgaaccggaggtcaacggctccaggccgacgatggtcttgaacagggtggacttgcctacgccgttcgggccgatcacgccgacgatgccgttacgcggcagggtgaagctcaagtcgtcgatgagcacgcggtcgccgaacgccttgtggatatgctcggcttccagcacggtggaacccaaacgcgggccggccggaatctggatttcggagaagtcgagcttcttgttgttgcgtgcctcctgctccatctggtcgtaacgttccagacgggccttgttcttggcctgacgggccttcggcgaggaacgcacccagtcgagctcgctcttcaggcgcttggcgagcttggcgtccttggcgccctggatctccatacgcttggccttggtctccaggtaggtggagtagttgcccttgtatggatacaggtggccgcggtccacttcgcagatccattcggccacattgtccatgaagtaacgatcgtgggtgacggcgatgacggcgcccttgtactggtgcaggaactgctccagccacagaatcgattcggcatccaaatggttggtgggctcgtcgagcagcagcagatccggagcctcgagcagcagcttgcacagtgccacacgacggcgctcgccaccggagcacacgctcaccggcgtatccggatccgggcactgcagagcgtccatggcctgctcgagctgggagtcgagatcccaaccgttggccgcgtcgatatcgttctgcagcttgcccatttcttccatcagcgcgtcgaaatcggcgtccggattggccatttcctcgccaatctggttgaaacgcgccaccttttcggcgatcgggccgaatgccatcttgatgttctcgccgacggtcttggtgtcgtccagcggcggctcctgctgcagaatgccgacggtgaaaccaggggtcaggtaggcttcgccgttggaaacggtgtcgaggccggccatgatcttcagcagcgtggacttacccatgccgttcgggccgacgacgccgatcttcgcgcccggcaggaagctcagggtcacgtcgtcaagaatcacgcggtcgccgtaagccttgcgggccttgatcatctggtaaataaactcagccaatgttgtgttccatccttaagaaacgttggaattccagcgttttgcgtatgtcggtcgacggaaaatcgcacttgttcgccgtgctgcggcgcgttgccggcgcgactggttgcggacgaatcgcaagtctgctgcaactcatcgaagccaagtgttttcggaccgtgtccatacgcaaagtaccatcgccgattatcccatatcccgtctacacagtaggcgtatcgagtgcggtgcaggcgcgtcagataatcacgccgtcgcagtggtcgatctcatgctggatgatctgcgcggtgaaaccggtgaacgcagcgtggcgctcgcgccagcggcggtcgagataggtgacctcgatgcgctggtagcgcagggtgcggcgctctcccctgagcgacaggcagccttcggcggtgtcgtaggctccgtcccgcgcggtgatgtgtggattgaacatgatggtgatgcggtcgcccagttccttgtccacgaacgcgataatgcgtttggatacaccgatcatattggctgccataccgacgcagccgttgcggtgcgcgtcgagcgtatccttcaggttctgagccacggccaaatctgcttcggtgttctcggcttcgacggatggctggctcaaaaatggaatggacgtcatgatttcgcgctgcatgtggttttcctctcgctggttcctttgccggtctgccaatattgtatgcgtcgcacggcggtgaaacggatggtcgactcgtgcccgtccatttgcatggcgcctcatgtcggcttcggaatgtgaagcgcaatcggtgcaatatgcttgggaccatggatgacatgtctcaatatcgggaatacatgaagcaggcgctcgaactggcccgcaagggagccggatgggtgaatccgaatccgctggtcggcgcggtggtgatgcgcgacggcgaagtccttgccgccggataccacgaccgttaccgtggtccgcatgcggagcgcatggcgttcgactatgccgacgcgcatggcatcgatatgtgtggagctacagtcatcgatacgctcgaaccctgctgccacgttggatcgcagccggcatgcactgatctgattctagcccacggcatctcgcgggtggtggtcggctccatcgaccccaatcccgtcgtggccgggaaaggccttcgcatccttgaggaagccggcgtgaaagtggtgcgtgacgtcatgcggtcggaatgcgacgccatcaatcgccatttcttccactacatcaccacgggaatgccgtacattgtggacagcagaagacgtgtgggggaatcggatgccgagtatgcggtccgtcggcgcgaactgtatgccacgtatgcggcggtgcttgccggaactgaatcggatgtttctgacgagtccttcgcgcacttcgacggaccggtccaatccgtcggcgcggacgaagtggtgatcggccgtcacaagccgttgctgttgaagaccagcacgctcgccggcgcggacccggacgagtggttgcacgaactgggcaaacgcaaaatcgacagcctcatcgtggaaagcgacgaagcattcgagcggttgtccacggcctgccaaaaagactgatgtgtcgcgttcgcggttttgaaatgccttatatgtggcagattccgtcgtcgtacgaaagtgattttccctatatgtggcagacaaccaaagaaatcctgagttagagggtataaatcagtgggtttggcggtcattgtctacttaggtctgccacatgtagtggttttaagtttcctggggatgtcaaatttgccacatatagggattgtcagatgagaatccgtctgttcccagtggcaagggacgctatacggatatgtattcttcctgatggcattctttggctgagtctgatggatttgctgagcctctgatttattctgctggccactcgttcggcgaggagccgttcttcgtgttcgctcgccagattctcggcggtcacttggatgtagatccagccctcatcctctagggcttcgcgtcgcttgctgtctgcgagccactgtccggcgtgatgccttccatcatattcaataaccacttttatctctggataagccatgtccagaaaaacgattttcccattggatgagcggaccttgtaattgacttccgggcagggaagcccgtgtcgaatcagcgtgattcggcaacggctctcctgcgaggaatccgtgccttcgcgcataagccgtagggcttgcctcattttgttgattccgcgaatcggccgttgtctgtttgttctcacatattcgttgagattttcgagacggtttacatagtcgatgaattcgtcgagagtgattgttccaaagcgagcgttcctcctcatcatggaatcgccgagcgttaccaattcctcttgcgggatacgattggcgtgcatcgcccaagtggttatcgcgtcagtgtgatgaattttgccataatgcgtggttgtttcgagaacggggccttcccatagtgcgaagtggatgttctgaagatgcgttcgggcgttgttacatggagcgagaacgtgtagggaagattccgtttgctggtttcgtggatatcttggcctttcgatgcctagaaggtccagtgcggtattgagcgcgaacaccaatcgccttccggttcttttctgcgcttcaagacattgttcgatggtccttgccctcagctgcgcgaggttttccgaatattgtgctccattgtccatagcgtcaaagtagaggaaatggcactgcgctgtctaccggcttttgggaaacggtggaaaagtggatgattcacccttccttgaaaaaccggtggataactgcgcctttctcttgcctatgtagataaacgcatttcaatagcgaaaacccaaagtgcacatagccgattgagatgagggtggcaatcgcaagcatcgcaaggatactatggctggcaatgaggtcattttgttgaatcgaggatgtatgggcgaaccgtatgtgattgaaaatgtgtgtttcgtggggtccaatgagcctgtcgacatcacgattgagcaagggcggattgcggatgtacggtcttcggaaaagtcggtagagaaggcttcgaaaacgtgggtcattcccggcttgtgggattgtcatacgcacttcacgcagtggtcgtacacgttgggacgtcttgatttgatcgacgcgcgcagtgccgacgaggcgctcgacatgttgcgtcggcacttggatgaacgtcgtgagaacggcacgctcgacccgaaccaatatgtggtcggcatgcgcttccggcactccctgtgggccgatgacgcccaaccgacgttggccgcaatcgacgcggtatcgggcgatcagccagtggcgctgtcaagcgcagacatgcactgcggatgggtgaattccgccgcggcccgcaagctcggcgtgcatgtgggcgagtcggggctcgtcggcgagctcgaatggttcgatgcctactgcaagctggacaaagggccaggcgcggccgatgaactgactcgtctgctacgcaacgcggagcgggacgccgccggcaaaggtgtggtcggtgtgcgcgactacgagatggcggagaacatcgacacatggatcgagcgattctcgcaaggactcgtcggcctgcgtatcgaggccggcgtataccccgaacggctccagcaggccatcgacgacggctggcgcaccggcgacgaactgcctggaagtcatgggctaggccacgtcggtgcgatgaagatgatctccgacggctcactcaacacccgctccgcttactgttccacgccatactcgggcatcgccccggaaacctacggcacgttgagctacactcctgagcaaatcgaatcgtatatgcggctagccactgaacatggcttcgatatcgcctgccatgccatcggcgacgaagcgaacaccatcgtgctcgactgcgcggaacgtacccatgcgcacggttccattgagcatgctcaaatgctcaaggagtgcgatattccgcgtcttgcacggctgggacttgccgccagcatccagccgcagcacgccatggacgaccgtgacgtcatcacacgattctggggcaatcccgccggaattccctacgcgttcaacagtctgcatcgggctggaatcaaactgcttatgggatcggacgcgccggtcgcgccgttggatccgtggctggccatttccgcagcggtgttcggcacggagagttccgaccgggagcctttccagtctgagcaatgtctggatttcgaaaccgcgcttgcttcatccaccgccctgggacgtacgacgttgcaagctggggatgcggctgatctggtgctgctggattgcgatccgagtgcgcttgagtcccctgaggccatgcgcgccatgcccgaccacgtgcttgccaccatgcttgccggacgctggacatatcaatgcgctgaatgaaaaccgctatgtgtggcagattccgggatgccggaaaagtcaaaaccgctatatgtggcaggtcgatggctcctaagatgaaggaatcgccggatttatgcccccgaacatagggctttgtacctggagctgccacacataggacaaatcatcttcgatgggtacggaaatctgccacatatagcggatttcatgtgctgctggatatccaaggagttggttatccaggggttgaagatgaattcgaataaagatagggcttgtatccctgcaatggcggggatacaagccctatctacaggcttatgaggctcactgcacggcggcgagggcttggtcgaggtcggcgatgatgtcggccgtgttttcgatgccgcagctcaggcgcaccaggtcgatgccgacgccggcttcctcaagctgttcctcggtgagctggcgatgcgtggtgccggccggatacagcgtgcagctgcgcgcatcggccacatgcgtggcgatggacaccatcttcagatggtcgaggaacgcggagaccgtctcgcgcccgcccggcacaccgaaggagatcacgccgcaggtgccgttcggcatgtacttctccgccagcgcatggtacttgtccgtttcgaggcccgggaagctcacccagctgacgcgcggatcggcgtcgagccacttggccacggccagtgcgttcgcgcagtggcgctccatgcgcacgccgagggattccagatgcatgcccatgatccacgaattgattggcgccggagtggagccgaagtcgcgcatgagctgcgcggtggccttggtgatgtatgcggccttgccgaattccttcgcgtaggtgacgccatggtaggagtcgtccggagtggtgaggcccgggaatttctccgcatgggccatccagtcgaaattgccggaatcgacgatcgcgccgcccacgcaggatccgtggccgtccatgtacttggtggtggcgtgcgtgacgatgtccacgccgtactggaacggacggcagttgatcggcgtcgggaaggtgttgtcgacgatcagtggcacgccgtgacgatgcgctgcgttcgcgaacttctcgaagtcgagcacgataagcgccggattggagatggactcgccgaacacggccttggtgttcggctggaacgcggcctcaagttcctcttcggtgcagtccgggctgacgaaggtgcattcgatgcccatcttgcgcatggtcacgttgatgaggttgaacgtgccgccgtagatggcggaggaggcgacgatgtggtcgccgttgttgcagatgttgaacagcgcgaagaagttcgccgcctggccggacgaggtgagcatcgcggccgcgccgccttccagctcgcagatcttcgcggcgacggtgtcgttggtcggattctgcaggcgggtgtagaagtagccggattcggacaggtcgaacagtcggctcatctgttcgctcgactggtatttgaaggtcgtggcctggatgattgggggagtgcgggattctccattgcccggctgatagcctccctgcacgcagatggtgtcgacgttttcgctcatatgttccttctttcgattccgcgcttccgtgcgccgcgcaggtgttgcgccgcgatgcgaacaaacaaacacactgtatcactgcattgataaatggcttgattccaatggaaacgccgtatagtttaacgaattgacaaacttaggtaattcaatttattatgtagaccaagacgggcggaaagcccgctgcgaaataaagctttacgtaagtaaaccaagcaaaggagcattccatgggtctgtgggatatcgataagattccgtacgtcggtcgcgaaaaggggccgcaggagggtcttgctttccattactacgacgccgacaaggttgttgccggcaagaagatgaaggactggctgcgtttcggcgtcgcatggtggcacaccttcgaccagcagctcgtcgatccgttcggcaccggcaccgcccagcgtccgtggtacggcaagtattccgatccggaggacgaggccctggccaaggtcgactacgccttcgagttcttccagaagctcggcgtcgagtacttctgcttccatgatcgcgacatcgctccggaaggcgacaccctgcgcgagaccgacaagaacctggacaaggtcgtcgacaagatcgaagagaacatgaagtccaccggcatcaagctgctgtggaacacctcctccctgttcaccaacccgcgcttcgtctccggcgcctccacctccccgttcgccgacatctacgcgtacgccggcggccagctgaagcactccctggagatcgccaagcgccttggtgccgagaactacgtgttctggggcggccgtgaaggctacgagaacctgtggaacacccagatgaagcgcgagcaggagcacatggccaagttcttccacatgtgccacgagtatgctcaggagatcggtctggacgcccagttcctgatcgagccgaaggccaaggaaccgacgatgcaccagtatgacttcgatgcatccaccgccatcgccttccttaagacctacgacatcgacttcatgaagctgaacctcgaaggcaaccacgccaacctggccggccacacctaccagcacgagatccgcaccgcccgcgaggccggcgtgctcggttccctggacgccaaccagggcgacaagctcatcggctgggatatggatgagttcccgaccgacctgtacgagacctccaccgtcatgtgggaagtcctcgccgaaggccagatcggccctcacggtggtctgaacttcgacgccaagccgcgccgcacctccttcaccgccgaggatctgttccgttcccacatcgcaggtatggatgcattcgcagcaggcctcctggtcgccgccaagatgcacgaggacaaggtcatcgagaacctgcaggccgagcgctacagctccttcgattccggcatcggcgcaaccgtcgagaacggcaccgcctccctggcttccctcgaagagtacgctctggacattccgcaggccaagctcatcgaagccaccaagtccgatcatctcgagtccgtcaaggccacgatcaacaactatatgatcgacgccctggccgaggcgtgagccgaaaacccactagggttttaggtagcctcgggcgaagtccgagacggtagtcgagggcgagcaatgactgggcgcgcgtagcgttcggaaattgcaggaccgaggcatggacgcaataaggagtttccgttaggactcctgattcatcgctggatcaaacagtggggctcgactgtgacagagccggatgtggtgtgccgaagcgtcggtgttccggcacaccactcacttttctttccttcctccttcctcaaatttccttcgcacgcaagtcgtttgccggctagatcgccggtgagcggcttgtttgcgttgttagaccaagcgaaaatttcgattattcgcaatgatgtgatgtatccaaacgttcccgaatgaggcgtacttatgaccacaacgattaccatcgccaatcccattcttcacggaatgcatcctgatccgagttggatttgggatgatgatcttcggcaaatcgtgcttgtgacctccaccttcgaactggttccaggcttgcctatttacgtttccagggatatggcccactggaaacacgtgtcggatgccatagatgaggagttggcaagacgtttgctcattcctttcgtggatgactcgggtggcgtctatgcgccgacgctgcgtaggattcgtggcaaatacgtgattgcctgcaccatcgctcgcatcaatggacgcaaagccatcgcggaaggatgctcccaggccgaattggatgcggcccaggcggcggaaggcaacttcgttcttgagtcggactcgatcgacggaccttggcgtgggccgttctggatcgagggcgccgaaggcatcgatccagacatattcgaggacggggacggcaatgtgtactggacccagacccgtcctgcggtcaatccgcaatgggaaggccagaccgaggtctggacccaacgcattaatccggagacttggacttttgtcgatgacggtcttcctgcgggatcgggcaagacggtaatatggcgcggatacggtatggaatcggtgtgggctgaggcgccgcatctctatcgcgtgggtgattatgtgtatctgatgaccgctgaggggggcaccagtttcgaacatagcgaaatggccatgcgcatctatgcgccgcatggactgcttcgggcgttcgaagcttacgaacgggaagtatccgaattgggtgagtgcattccgcaggttcgtgacggggaacgctgctatcttggcactgcaatccgtgccttccacgcggataagaagaatccgattctcacccaccgacatctgggtttgtcggaaccgctgcaatgcgtgggacatgcggacctgttgcttcatccggaactgggatggtggctggtgtgtctcggcgtgagagagacacggggaaagcatgacggcgaattattgagctacttgggaagggagagctttgtcgctccggtatcctgggaacataatccggccgattggaagctggacggcaacggtgcatcatatacgcatgagggtgaccccggatggccagtgacttgcgctggtcttggccgcttggccgacgagatcacggttactactgaagacgatggcatcaccatcgagcctagggtgaaatcctcgctcgccggtgacgtggaacctgcgctggtggatgtggctgatggctcgacgaacgatgtggtggtgcgcgacgagcgtgatgtcagctaccgcagaatagcgaaactgccgacgctcatgccgattcccatgtccggttctttagtgatccggcagaattccacgcattacgcggtgttttcgatgcatggcacggatgtgcgctacgagacggtgaatggagatgattcgcaagccggttccgttgtcgccctgcgggctgatggcacacgtccggcggtgcttttcgatgacaaccgcttgttggtcatcgtggctgaagggcttgatccggctgattcctcggctttcgtgagtcgagggcaggtattgctcagtattgacgctcgtttccttagcaccgaatgggccggtggattcgtcggttgcatggctggtttcatggcatagaatctgaggagtttgaaaggatggttcgttactggtacttcggaggaccatccttgggacgggtcggaaccggaaggctaggggcgtgtggcgtttcttcctccggttgcacatgcgcggtttgtcttgctggtcacccttcaagttgctgtgtgctgttgcgtaccactagcgatgtcggcatgatgatgtgcggttggatcacgtcgtcggtggacagcgcctcgatcagcatgcgtacggcggcccttgccatgtcttggagcggctgccgtacggtggtcagcgccgggccaaggaatgcggcagtctgcacatcgtcgaatccgaccacggatagatcctccggaatacgtaaccccaattgccttgccgcctcgtagacgcccatggcctgcagatcgctgccggcgaagattgcggtcggacgatttggtcgtttcaacagggagatggactgtgcgtaaccgccggaagtggtgaaatcgccttcggtgataagtccgggatcggtttcgattccatgttctgcaagcgctgatgtatatccgtccagacgtgctttggaacacatcatttcctccggtccggtgatgatgcctatgcgggtatgtccgagtgcgagcagatgcctggtggcgattacgcctccggtccagttgtccgcttgcaccgacagcgtgtctggatctggattaccgaatggatcgaacaagacgaagggaatacctctggaatgcagcttgttccgttcgatacgtgtcagactggagaagacaagaatggcgccatctgtctgccgacgcagcatgttgtcaatccaggatgagtccgggtgctggcgattgccgccttcggtggtgatgacgttcaaatcatgcaacttggcttcgcgaatggcgccacggagtacttcaagggcccaaacattatcgaaatcttggaacacgatttcgataattcgttggcttttcgtgcttgtcgctttacgggaatacccataccgtttcaacaccgcgttgatggtttgccgcgtctcttcggaaacgtcggctctgccgttgagcgccttggatacggtggaaagggaataaccggtctctttagctatgtcagagagtcgtaccgtagctttttttgccgtattgcgcatgagtcactccttcttcattttcatcatatccgaaaatgcgaacgaaagtttcggtttacgtttttcgaaactttcgatatgttggcaatgcttaaaaacgttgtaaaatcaacgaaaaatagttagttttctgattttacaaaaaacttgactttgtgtgatttgtttcggtagtctgtaggtacaacgaaaacggaatggaaattttcgaagggagtcaaaggctgattctctgtctgccagggagctgcggcagcattcgttgcggtcatgcttcccgattcggcccattcgagagaaatcgttcctgtcgttgccatcattttgtcgatgatgatttggtcaataaggagaagacaatgaagttcaaaaccattgcagctgccactcttgcggtggcgaccatgttgggcatgggtgcctgcggctccagcgctggtgccaaagacgataagaccattacgttctggcataacgcaacagctggtgacggcaagcagtattgggaggatatggccaaagcgttcgagaagaagaccggtgtcaaggtccagatccaagccatccaaaacgaggatttcgaaggcaagctgaccaccgctatgcaggatcccgcctccggcccggatgtgtacatgacccttggtggagccaagaccaaggacatgattgacgccggacagggcatggacctcactgataagatcagtgacaccgtcaagaagcagatgtcttctgcgctggagtccatgtcctatgacggcaaggtctatggtgttccagtcactgtgcagcctggtggcatctggtattccaaggatctgttcaagcaggctggcatcgatgccgcgccgaccaccttcagcgagctgaagaccgatgtacagaagcttcgcagcgctggcatcgatccgatcgcactcggcggcaaggatgcttggccggtcggtcactggtactactggttgtccatgcgcgaatgctctccgaaggcctacgccaagggcgtcaatgacaaggacttctccgactcctgctggaccaaggccggagatgatctgaaggatttgttggatgcgaatgcttttaacgaaggattcctcaccacgacggcccagcagggcgccagctcatccgcaggtctgctggccaatcataaggctgcgatggagctcatgggcacatgggagcctggagttctcaaggacctgactccggacaagaagccaatggctgaccttggcttcttcgccttcccgaccgtggacggaggaaaaggcgaggaaggtgctctgatgggcgctgtgaccggtttcgctgtcaatcccgaggctccggacgctgctgttgatttcgtcaatttcatggctgagaaatcaaatcaggagaaatacgccactgcgttcagcaccattccggcttccgccgaagcttacgatgcggttaccgatgaaaatcttaagggcatcatcgaagctatgaaaaagtccgatggcatgcagctgtggatggataccgctctcggcggaaatattggcaacgctcttaattccggagtggtgaatctgctttccggacaggggacttcggctgacatcgtcaaggcgatgaaggacgcagcggccaagggctgacagtgaacatggctggttgacggccaaaggagggtggatagacagatattcatccaccctccttcctattcgagaaacgtatctggtagtggagaaaaccatgtcaagtacaagcaaagacgcggtgacgctgcgcgctaagcggtccaaggaaccgtccgatggcaaaatgcgtcgtaatgttgagattttcgtactgtccgcacctgcgattcttctgttcgtctgctttgtgattctgcctatcgtcttgggtgcttattacggcttctatcagtggaagggctacggacttccctccaagacaggtaaattcgttggtctccagaactacatcacagcgcttaaggatcccgcgttccaggcggcaattctgcataccttcgaggtcgtgatcggctcgttggtcatccaggctccgctcgccatcctgttcgcattgctgctgaaccagaagttcaaggggcgtggtctcatccgcaccctcatcttcgtgccgtatgtcgtttccgaggtcatcgtcggcacaggatggagcctgttgctacagaagaagggcgccatcaatgagattctggccaacttcggcatcaatggtcccgattggctggccgacccgaaaatcgctatttggacgctgctgttgctgatcagctggaaatacgtcggtttcgccgtaattctgatgctcgccggcatgcaatccattcccgaggaactgtatgaagcagccaaggtggatggggcgagtttctggcagatgcagaaaagcatcacgttgccgttgcttgctccgacgttgcggatctgggtgttcctttccatgattggctctctgcagcttttcgatctggtctatatcgtgtggggcaagtatgtgtcgaccaccgctggtgtgtccaccatggccacctacatggtgcgtgaaggtcgtggagccggcaactatggctatggttccgccgttgctctgatcatcttcgtgatctctttgatcatcgcactcgtctatcagaagttcgtgctgaaccgtgacttggacggtgctgttactgaacagaaagaagccgagaagcgtgccaggaagcgcgcaaaagaagtgcagcatcgtgaggttgctgccctggcaagtgaggtgaagtgatgactgccgcaacaatcgcaggacattccaacaaaagcgagtacagcaagaagaatggttaccgtaagtcgtccaagacgccatggggcaacccaatcgtctacttcttctccctggtgcttgtggccatctgcatcactccggtgctgtacattatcttcggcggtttccgtaccaattcgcagatcaccaaccatccgtccgggatgccgaacccatgggtccccgacaactacaagacggtcttcgaaagtgatattttctggacggaactgaagaattctaccatcgtgggtatcgccaccatggtaggcgtcgtggtgcttagcatcatggtgagctttgtcatcgcccgatacaaattccgctatgcgccgcttatgtacgcgttgttctctgctggtctcatgttcccgatgaccgttggcattacacctttgtatctgctgattcgcaatctgggtctggccaactccctgtggggtctgatccttccgcaaattgccttcggacttcctcagaccatcatcatcttggtgccgttcctacagtcgattcctaatgagcttgaggaggcctgtcttctcgatggatgctcccgccttggcttcttctggcgcatggtcattccgctgtccatgcctggcgtggccaccactggaatcctcaccttcgtgggaagctggaatgcctacatgctgccgctgttcgtgctcagtgatgccaacaagtacacattgccacttggcgtacagatgttcagctccgaacactccgttgacaccgcacaggtgttggccttcacctctctggctatgattccggccctgatctgtttcaccatcttccagaagaagatcgtcggcggcctgacaggtgcggtcaagggctgacgaaatgtgacaatccacgcccggaagatgttcctttccgtcttccgggcttcatctcttatgcaagaggtacattatgaagatttccaacccggtgctcaccggttttcatgccgatccttcaatgattcgcgtcggtgacacttattacattgccaattccactttcgaatggttcccaggcgttcgcctgcatgagtccaaggacctggtgcattggaacattcttccaagcccgttgagccggtccagccagcttgatatgagaggaaacccctcttcgggcggcatctgggctcctgacctaagctatgcggataacaaattctggttgatctacactgatgtcaaggtggtcaatggtgcattcaaggattgcactaattatttggtcaccgccgaggacatccacgggccatggagcgagccggttcgcatcaacggggtcggttttgacgccagcctgttccatgacgacgacggccgcaaatacttggtgcagcagacatgggatttccgtgaataccaccaccagttcgacggcatcacgttgacggaattcgacgtcgacaccatgaagctcaagccagaaacggcccgcaccatctgggatggcacctcggtgaagatcaccgaaggtccccacctatacaagaaggatggttggtactacctgtttgccgcagaaggcggcacggtgtatgagcatcaggaatctgtggcgcgttcccgtacccttgacgaatgctccttcgaagttatgccgaatggcccgttcatcggtaacttcgacactcctgacacctatttgcagaagcagggccatggagcgttggtggacaccccgtccggcgagtggtattacgcctccctatgcggtcgtccgtggcgtcatgataccgaaccggcccatggcacccgcggatggtgcacactcggacgcgagacctccatccagaaagtcgaatgggatgaggacggttggccgcgcgtggtcggaggccatggcggacagcgttacgtcgacgctccgaaagacgccatcgagaccgttgccccagcgacgcgcgacgagcgcgacgagttcgaatccgacgaactcggattgaattggaacaccctgcgcgtcccgttcaccgacaccatgggcacggtgggcggtggcaaactggcattgcgtggtcagggctcgctgtgcaacctgtttgacctgtcccttgtggctcgtcgctggcaggcattcgatttcgacgctgagaccaaggtgcgtttcgatccgaagaactacatgcagatggcaggcctgaccaactattacgatgacctgtgctggtcatgggcgttcgtcacttgggatgagaaacgacatgcaagggtcatcgaagtggctcagaacgatttcaaccaatacacgtcgttcctcaaggatgacgccatcgtggtgcccgaagacgccgaagcggtatggctgcgcaccaaggtccgcacggaatactattcctacgaatattccttcgacggtgagcgcttcaccgagattccggtgaagctcgatgcgaagattctgtccgatgactatgtgaaccagcgctatggcggcttcttcaccggcgcgttcgtgggtctcgcctgtgttgatctgtctggctatgacgcgaaagccgaattcgactatttcgattatcgggagcttcccgacaaccggtagtcgatgccgacgggcggcgattcgccgcattcctgccgcccgtcggttatttggtgaaatgaacgcagactcaatggggagaatgctgagatgactttgcgattgccgaaactacttgacgacggctgcgtgctgcaagccggtgtggacatgcatatttggggcaccggcgatcccggacgcatcgtattgacacggcttgctgacgagcggcatatggtgcaggtgaaagacgacggaacttggaacgcgccgtatggtccgatcgaagctggagggccgtacgagctgaccatatgctacgaggacggagcggagcgtatctcacggcagtgctatgcgggagaggtgttcctgtgctccgggcagtcgaatatggaactgcctatggcttgggtgcgcgccgactatccacaggagtgggaccgtgatcccgatccattgctgcggcagtacaaagtgattcccgattacgatttcaaaggtcctcgcgacgatcacgaccgtgcgttctggcagggctgcgatgcggatacgcttgatgatttctcagcgctcgcatattttttcggtcgcaggatccgccagtggctcggtgtgcccgttggtctgttgaacatttcattgggcggctctccgatcgaatcctggatggacattgacacattacgagcgttccccgaagcgctcgccagtcttgaaccgtaccttggcgatggtgtggcgtcgaaaagaagcttcgattccgttgccgagcgggaccggtggtaccaggcgcttggatacgaggctgtggccgatgcccaccatgaatggctgccattgatcgcgtgggactgtccggaatccaagaacatcgagccgcgcgacgtggcatggcatgacatacgcctgcctggatggtacaaggatcgcggacttgccggtttccgcggcgagattaccatgagaaaaaccgtgttcctgcctccgtcggatgcggggaagcccgccctactgcgtctgggcaccatgaatgatgccgaccatacgtgggtcaacggtgtgttggtcggtgggcgaagcaatgtgtatgagccgcgggactatccggtcgcagccggcgtgctgcgcgccggcgcgaacgaaatccgcatgcgtctggtcgttgaacggcccggcggccgtgtgacgcccggcaaacggatgacactgaccatcggagacgatgtcttcgacctgtccggcatttggcagtatgccgtgaccgccgaagccgaccgcgattgcccattcgaggatttcgtcagatggaagccgaccggcctgtacaacgccatgctcgccccgtgttttccatatgcggtgcgggccgtgctgtggtatcagggcgaatcgaataccggcgactacgccatgcgttatggcgatgagctgaaagccatgattgaattgtggcgtggcaagtggcatcagccggatatgccattcctgatcgtccagcttccgaaattcggcatcgacgccatcgaggatggtggttggccgcttattcgagaacaggaatggagagtggcggacgaacttgaacacgtggctgcggtggtgacgcttgatgccggtgaaagcaatgatttgcatcctcatgataagaaaaccatcgcggatcgtgcattcaatgtcgcgatggattttgtgtatggccagcaggctcagcctcagccggttgttgaaaccgcagaggcggacgatggattgttgaggatgcactgcgtgtggcggaattccatgggcgaacagatgcaatcgcagaatcgccatctgatgacgttggatggtgacgttccgcgagaaattgatttcctgtggcacgactgcgccacttcggtgcgggctgaggcatggctggatggttgcgatattgtggcgcgcataccgtcgcgcatgccggacgaggtgcggtatgcgtggagcaacagcccggaatccggtctcatctgcgacggggacggtgttctgcttccgccgtttcatctgccgttgcccatggttgattaggagcagtcatgcgcagacaagtcatgattcgtcaaggatgtgtcgacggattctccgatgcggatcctgtgatcaccgtgtttcggggcattccatatgccaagccgcctgttgatgagttacgctggcgtgagccacaacctgctgaagcgtgggatggcgtgctcgaagccggtgatttcgcgccgatgccgatgcagccgctgcccggctcggatgagttctacggcagggaatggcagattgacgctggcactccgatggctgaggattgtctgtatctgaatatctggacgccggccttgcgtggatgcggcagtggttccgagattcgtacggattcccgttgcgatgggcatgggctgcctgtgatggtatggctttacggtggagcgtttcagactggatctacctgtgagaaggagttcaatggagagcagctggcccgtcagggcgtggtggtggtctccattgcttatcggttgaatgtgtttggttttttcgcgcatgccatgttggaaaaggaagcggttgatggacggccttgtgcgaatttcggatttcttgaccagcggatgggcattcagtgggtaaaggacaatattgccttgtttggtggcgatcctgcgaacattaccgtgttcggccagtccgcaggggccgcaagcgcgttggcgcaaagtgtctcgccgatgaacgatggtctgttccaacgcgtcatcatgcagtctggaggtggaactggtctgttcaatcgccatctgtggtctcttgaggatgcgcagcgaaatggagcgcgttttttgaagtatctggaagttgaatcgattgccgaggcgcgttctgttcctgcgactgatctgctggaggcggcggtgacttttcctgcttgcgattggtctgggcagggtgatgatgtcgtatgggctccgatgactaattggattccctgcgtcgatgggacattccttgtcgagcaataccgtgatgcgcttattgcgggacatcgcgttccgtgtgatttgttggtggggaacacgaccggcgagttcatggttccgggccctgatggcactccgtatccggagggtgaatgcggcaatctggatatgccgggggatgatgccggtgcgtttcattcgtccgatttatggttttcgttcgggacgctccctgcgagctggcggccgtttcgaggctggcattacgatttgtcccatgcgatgaatcgatattgggtgaatttcgcggcgacaggtgatccgaacggttccggattgcctgagtggacggcatgcggacctgatggtcaacgatatatgctgttcggtggatgccacgatacgccgggtaacgtttcatgcgtcatggtcaagtaagtgaatatagtatggtgtgagcgttcactatagtgcggtggaatgtgatgaaggagacggatatgacgcaggagacggaagcgctgatcgcgtccgacgaggatctgaccaaactgttcgccggcaagccgacgcaatatcgcaaatcgaagtcgctgccgaaattcacaggcgaggccatgcgcgcctgcgcgaagatcaaccgcatcttcttcgatgatccggacgaggcgtaccgtttgtttcacgagctggtcccggacgcgggggagggcgtgcagttcacgccgccgttcaatgtcgactacggcatcggattgaccattggccgcggcacgttcctcaacaaggatttcatggtgtgcggcggcggatatgtgacgctcggtgaggattgtctgatcggtccgcgctgcaccatcgccacacccaaccatgccaaggacgctgccacccgcctggcgggctgggagcatgccagtgccgtgaccatcggtgataacgtgtggttcggcgccaatgtgacggtcacgccgggggtgaccgtcgggtcgaattccatcatcggcgccgggtccgtggtgacacgtgacattccggagaacgtcatagccgtgggcaatccagcgcatgtgattcgtgagattcccgaacatgaccctgccttcgccgatgtggaaggtttgctgtagttttgcaaacgtttcatagggtgtgttgacggcaaatcgatttctccagccatgcgatgcaggtgagcgcgtaaagccttatacggaagctgtcgttcatattgtcgtttctatgagtatggttcatgaatcagcatagggccgggaagccccattgttgggaagcttcccggccctatgcctgaattcctgcggtgatggatcagccgcgggccttggcgtaggcttcgtatacggcttcggtcggttcgccggtctccacgccgtcgatggtgagttgccatgccggaggctcggtttcgccggacagcacccaggcggcctggcgggccgcgccgatggccacgtattcgtcggtggcgggtcgggtcacgtccatgcccagaatgcttggtgccagcgtgcggatagcttcggacttcgcgccgccgccgatgagcagaatgcgcgtgatgcttgcgcccagggatcggatgagctccaggcagtcgcgctgggagcacagcagtccttcgacgaaggcgcgggccaggttctcgcgtgtggtgttggccagagtcatgccggagaaggtggcggtggcattcgggcggttcggcgtgcgttcgccgtcgaagtacggcaccagggtgatgccgttggcgccgggcttggaggcgaaggccagcttggccagttcgtcgtaatccacgccgagggcggcgcggccggcgtcgaggatgcgcgaaccgttgatggtgcaggccagcggcaggtagtgcccggtgcagtcggcgaagccggatacggcgccggtcaggtcgtaggttgggttctcggagatggctgcggccacgccggaggtgcccagggaaatggacacgtcgccgacggccatgcccagtcccagcgatgccatggcgttgtcgccgccgccgggggcgagcaggcagccgccttcgacgttcttgccggcgatggccggatcggccttgacgggggcggcgtcgcgcggccccagcacggtgggcagcacgatggcctcggcgtgcgattgcgcggcttcggcgccttccgcggcctcgagcaccatggcgatcaggtcgcggcggtattcgttcgacgcggcatcgtagtagatggtgccggaggcgtcggagcggtcggtgaacagggcttcaagatgggcgtcctcgccttcggcgaccgggccgtaaccggcgatgcgccagctcagccagtcatgaggtaggcagatggcggcgattttcttggcgttttcgggctcgttctcggccacccatgccaccttggtcagcgtgtaggaggcgacgggggaggagcctacggccttgacccaacgctgcttgcctcgggcgattgggtcttccggctcgccgttttgtgcgggcgctgcgccgagcttttcgatcagagccgcagcctggggcgccgaactggtgtcgttccacagcatcgcatcgcggatcacattgccttgcttgtcgaggatcaccatgccgtgctgctggccgccgacggccagcgcggatacgtcgtccaggccgccggcctgctcggcggcctcttggaatgcgctccaccagtatgaggggtcgacggatgtgccgttcgggtgtttggcctgcccgaagcggacgagctcgccggtttcggcgtccgtcacgcgtaccttgcaggactgcgtcgatgtgtcgacgcctgcaaccagagtccttgccatggtttgtgttgcctccttgcatgtgccgttcgccggtggcgcacggttaatagttagatgaataaactatactatagtagtgtagcaccaggaaaggctccggaacatcggttcggggaattcatgctgatgcggcaacacggcaaacagggcagggacgggaacggctatggcatctcttcgcaggatcaatcaggacgatctgcgcaatcacaatctttcggtggtgatcgacacgctactgcgtgcctccgggccgatgagccgagcggatcttgccaaggagaccgggctgaccaaggcgacgatgtcgttgctggtgtcgctgctgatcgatgcgggcgtcgtcaaggagggtgagccgcagaactcggccagctatgggcgcccgtccacgccgttgatgctgggaggcggcaaggtgtgcggcatcggcatgcaggtcaacaccgacggctatggatgcatggctttggacatcaaccacgacatactcaggcacgaatgggtggatgccgacatgagcggcgtcgagccggacgtcgtattcggcaagcttgacgccatggccaaggcgatggctgaggatctggaatcgaaacgatgcatcatcgcgggcgtctcgtgtgcgctgccgggcttggtcacctccgacaagaggctgctcatggcccgcaatctcggttgggagaatgtcgatctgaccacgttcgacgttatgcgagggtatgacgttaccccgtgcaatgaggcgaagctggccgccatcgcgcagattccgggatatgcctgtgcgcgtgcggacgtgttcgatggcgtggattgcgccgactccttcctgtatctgtcgtgcgatatcggcatcggcggcgcgatcgtccgtgacggtgagatcgtgtcgggaagccacggtttcgccggtgagatcggtcacgtgtcggtgtctttggacggtccgctgtgcggatgcggacgacgcggatgtttggaaacgtatgctggccgtcgcgcgctggtcgaggcttccggagtggccgaaaagaatgcggcttcgagcggtgaggcactggagcgtctgttggacgcatggcattcccatgatgtgcggaccgtggaggccgtcggacgggccatcgacgcgctggcctcggccatcggctccgcactgaatctggccgatgtcgataccgtgctgctgggcggttggtggaccgatttcgggccgttcttctacgaaacgctcgaaaaccgtttggaatcgcaggtcttgggggcgtcggacatgcaggtgagcgtgtccatcccgttggtggccgaccatccggcgttgtacggtgccgcggaagtcggcttgcgcaaattcatcgacaatccgctgacgttcatcaccgacaaagcatgattcctgagcgccgccgcaacgtcactcgtgcgcattgacatattgcggattctccactttgcccgttccgccataccgtttgaagccccacagcagaatgagggatttcgcatacgccacccaggcgatgccgaagaggatggcgagaacgcgtatgaacggtacgaaatatgacaggccggccgcgagtacgtcgatgatgacgaggacgagcgagcaggggaaggctcgccaggggaacatcgccgatagcgagaagagcctgccggtggtgttggcgaagcgtgcctgcaacggtgcggcgtattcggcgaacagcgccacgaccacggcggcgatgaccagaagggtcagcggtatgtagggggcgttggtatcccacgccttccagaacgacaggccgaagaggatggcggtggcgaggatggcgacgagcacccaggccgcaagtccctgtttgaactcgcgtttgaagcgggtgagatattccttgacgaggcggatgtcgtcatgctcgtcataggcgaacattgtggaatacaatgccgcgcgtgccgggccgatggtgacgtttgggatcagcgtgatgaggtagaccagattaagcctgacgaaacgcagcagggtgtccatgaaacgccagaagggcgcgttgatgttgaaccgcatgaatcctcctcgatgatgtgttcggctattgccgatagtactgtgccgtattgtgcgacacgccctatttataagattataaatagctctccaagagcacttagtttgttggaataacaatactttagcgccgatgcggcaagggttttgcggccactgccgtcgctgcaggaagccgctgaaatggacggcgccggcacgctgaccgtgttcacccgcatcatcctgccgatgtgcacgccgattctggcgaccgtgggcatcttctcggccgtgaaccagtggaactctttccaggacaccctgatctacatgaccgattcgaagctctactcgctgcagtacctgctgtacacctacatcaaccaggcgtccgcactggcgaatgcggccaaggcgaattcggcgaatgtcgccgctctggcaagcgccgcgacgccgacctcgatccgtatgacggtttccgtcatcgtggtgctgccgatcatgttcacctacccgttcttccagcgcttcttcgtcaagggcatgatgctgggcgcggttaaaggctgattaacaacacaacgattcttttccccataactgaatatcagaagaaggaatacaaggaggtttccgcatagaactgaagaaaatcaccacccgcgcgattgcggctggcgttgcggctgctacgctgctgtcgctcgcggcctgcggcagcggcagcaacagtgccgacaccaaggacgacggttccgaaatgaccgtcgaggtcttcgactcgctggccagcagccagggtctgcaaaagagcggctggttcgccaagatcgtcaaagacaagttcaacatcaagctgaacatcatcgcgccgaacgtgtccggcggcgataccgtgttcgatactcgctccgcttccggcaaccttggcgatctggtgattgtcggtaccggcaacgggcgtctgaacaagctggtcaaggccaagctcatcgaagacatgaccccgtactactccagcatgaagaatgtcaagaagtacgattccgcggtcaagtccatcgccaagcaggccggcaaggatggcgtgtggggtgttcctcagggtgtctcctcccagtctccgaccgacccgagcgaaggcaacgagtcggctgccgcaccgtacatccgctgggatatctacaaggagatcggctacccgcagatcaaggatctcgacggtctgctcaatgtgcttaagcagatgcaggacagggctcgccaggataccggcaaggacgacatctacgccatgtcactgttcaaggatcgggacggcgatgtgatgcagaacgccgcatccatctgcagctggttcggctacaccaaccagggttccgtgttcatctccgccgacggtaaggacgtgcagcccgccaccaaggagggcggcatctaccagcaggccctggagttcctgaacaaggccgaatccatggggctggtcgatcctgattccaccacccaggactgggataccatgcggaccaaggtcaccaacggcaagaccatgctgtccatctggagctggctgggcaagccgcgtatgaactccgacgagaacaaggccaaaggcgtcggcttcatgctggctccgcttgagaacatgaaggtctattccgacggcttccagcctgacggtgatggcgccaccatcgtggccatcggctccaaggccaagaacaaggcccgtctggccaagttcatcgactggatgtattctccggaaggcatctacgcctcttcctccaactccggtggcgccgcctgcccgaaggatctgggctgcttcaccaccgacaaggacggcaagaacccgaccctgaccaagttcggccagcaggccatgaccggcgaccacgccaacctgaaggtctccgccaagcttggcggctccagctacgatgacggctactctaagctgaacttcaaggccgtgtctcagaacgacatcgacccgaacaccggcgaggcctacaacccgctgctgtggaagtccaaccaggatgagaccgagctgttcaaggattggtccgcccacatggagaacgccaccaacgacatcgactatctgcagaaggcaggcaagctctccatcgcagccggtgcgtcctacaccactccacaggaggattccacggtttccgccacccgcagctccgtcaagtccgaaacggtgaacgcctcctggcaggccatcaccgctgcgggcaagttcgagaagacccttgacgaagcccgcaccaagatcgacaacctcggctacaaggaagtcctcaaggtcgaccagcagaacgccaaggacctgatccaggcccgcaaggacatcgtcaagcaggccaagtaattcctggcgttccggctggagcgttttcgcttcggccggaacgcctcgcctaatcacataaccaacaaggggcgtcggactcttcgaaccgggccgacgccccgcaactcttccggttccgcatattccgacggacgtcgtcgtctccttcttgcctgtcggaacttttccgctttttccatgtccactttcctccatgctttcgtgaggagcgcgttcgatgatgaatctccacaccgtcgaatcgcaatgaaacgaaagaaaaacgcatgaccgtaattactgaagccaacaaaaccaaagccagggaactgacggcgcaactcacgctggacgagaaaatcgccattgtgcacgccgcaggcctgttccgcaacggcaacgccgaacgactgggcattccgccgctcaggatggatgatggtccgatgggcgtgcgcgccgaactgcataacgacaattgggcgccgctgtacaacacccgtgactatgtgacctacctgccgtccggctcggcggtcgcctccacatggaaccccgacctggcccgcatgaccggtgaagtattgggggaggaagcccgaggccgaggcaaggacgtgattctcggcccttccatcaacatcaaacgcagtccgttgtgcggacgcaatttcgaatacatgagcgaggatccggtcctgaccgccgcgcaaggtgtggcctacatccaaggcgtgcaggaatccgacgtggccgcctgcgcgaaacattacgcggtcaacagccaggaaaccgaccgattggacgttgacgagaccgtaagcgagcgggcattacgcgaaatctacctgccggccttcgaagcggcggtacaagacggcggcgtgctctccgtcatgggcgcctacaatctcgtcaacggcaccaaatgctgcgaacacaagcagctgctcgacgacatcctgcgcgacgaatacggtttcgacggtttcgtcgtttccgactggagcgcggtgcgcgacaccaaagccagcgccgaagtcggcatggatatcgaactgtccgtcacgccgaatttcgacgattactacttcgccaacccgctgaagaaagccgtggaagacggcgacgtcaaggaaagcgacgtcgacgggaaagtcgaacgcgtgatcgccgtcatggacgcgctgcacatgctcggcgacgcgcacgcaagccgcaaaccaggccgttacgcgacgctcgaccacgcggcgaaggcattggacatcgcccgcgaatccatcgtgctgctgaaaaacgacgcgcacctgctgccgctcgacgaacgcaacatgacccgtctgctggtcatcggtgccaacgccgaccgcatccactccaacggcggcggctcggccgtcatcaaagcgctgcacgaagtatccccgctgctcggcctcaacggcgagctcggcggcaacgtcgaaatcgaatacgcgctcggctacgacgccaaacagatcaaccaggacgaaagctggcaggaggaaagccttgagaattccaagggttccgatgccaaagacgtgaatcgcgcgcgcgaactgcgtgacgaggccgtggcaaaagcccgcgcgtacgcggccgccggagatccggtggtcttcatcggcggactcgaccacgaacatgatctggaaggccgcgaccgcaccgacatgcgcctgccgtagggccaggacgagctcatcgaagcgctcaacaaggcgtggtgcgccaatttctggagccacaccatctacgattggggcgacgtggtgcccgcccgtcggctacggcgacggcatcagcgacgccaaatgcgtggtgtccgggctgcagatggactatcgccgcttccaaagccaggcgcagttggcctgctatacgaacgagcgcgacgcgatccgcgaatacgacgcgaccacgccgatcaccacgaacctcatgggcacgttcaaggatctcgactacttcgagtgggccaaggagatggacgtggtcagctgggacaactatccgggcatggacaccccgccgagcttcaccgccatgtgccacgacctgatgcgcggcatcggcggcaacaagccgttcatgctgatggagcagaccccgaaccagcagaactggttcccgttctgcaaggtcaagcagccgggggaagtgcgtaagctcagctggcaggccgtggcccatggcgccgacaccgtgcggttcttccagatgaagcagtcccttggcggctgcgagcgattccatggcgcggtcatcgcgcatgacggcaccgaggagtcccgcgtgttcaaggagaccgcggccttgggtgaggaactggaccgcatcggcaggcggatcatgggctcgcgcatcgaatcccgtgtagccatcatgttcgactggcagagctactggtcgcttgaaggctgtgtcggcccgaccaccggcttcaactatcccaatgaggttcatcgcttctaccgtgcgttgtggcgtcgcaatgtgccggtggatatgatcgccagcaccacgcctcttgcgcggctcagccagtatgatctggccatcgccccggcgctgatcaccgtgttgcctggtgtggctgaaacgttggaagcctatgtggcggatggtggcaccttcatcaccggctatatggccggcatccatgatgagcatgatctggtggtgccaggcggctacccgggcaagctgcgcaggcttatgggcgtatgggtcgaagagatcgatgcgcttgcgccgggcgaaaccatcgaagtgcatggcggcacggttgatgccaagggcgagatcgtggcgagcattattcatcgcgaaggtgccgagcgtcttgctacgtacggcggcgacgaattctatgctgggcattccgcgctcaccgtcaatgcgtatggcaagggcaaagcctattttgtgggcactccgttggacgagaccggcatgagcgcgttcatggctccgatcatcaaggagctggatctgaagtcgcttgataccccggaggatgtcagcctgtccgtgcgctatggcgatggcggcacccgctacgcgttcctcatcaacaacagcgccgccgacaagcgtctgtgcctcagcgaactcaacggtggcacggagctgctgaccggcaccgtcatcaacgatctgatcgagcttaagccgtatggcgtggatgtgattgcgttgcggtgatcgcaatgctgtagaccacgttagacggagcggaacgactccactcgacgaagccgaatatgaagaaggccgatgcccttgatggacatcggccttcttcgtcaggaaccggtggtatggcgccgttccgcgttcatcgggtggctgcgatcacaccgccggtcatcatcacgcctgcttcttcttcagcagaatcgcggcgcctgcaatcagtgccacagccgcggcgaccgccatgccgagcacggaggagccggtcgaaggggtggacgtgacaccggtcggtgttgtggatggcttcgtgtctgtggcaggctttgccggggtcgttggcgtcgtcggttcaacagcgtccttttcgaacacagcctggatggagacgctgccgtcaggcatctcgaaggcgttgttctcgatggagacgttgcccttcagcacgttccactctttgaagtggtagcccttgttcgcggtggccgtcagcgtgaccttgctgcccttggccgcgcgctcgacatccgcggaggcggagccgccttcggtcgcggagacgttcacggcgtactgcgtattgcgcacgcgccacagctgggtaccgtagaacgggttcgcggtgccgaccaccatgtagtcgtcggtgtcgcagaagatgcgcagaccgtggttgaacgggtcgccgaagccgttgtcggtaacggtgccgacggtcacgccctcattcgcggcggaacggtcggtgatctcgaacaggttgaagccgcgcttggacttggccaggtacggcagggacttggcgtaggccttgaggttggccttgctggtcagcttgaccagcatctcgtacaggcccttgaacttgtcgggaatgatgtcggcgatgctgaagaacgcgtccgtgacttcgccgtagttgttggcgaaatcggcggagcccttgtcggacagctgggagccgaggttgtccagctcgttgttgatgtcgaagagctgcgaggcctcatcggaggagccggaggctgccaggctgcccggaacgatgctgccgtccttgatgccgtcgaccagttccttggtctgggcggcggtcaggctgatcggcttggcggacgagacggacttggcgtcggtggtctgcggctgcgcggcggaggcgtccttgccggcctggatgcgggcccagtcgaccagcgcctccggattgtcggtggacggcatggtctgggtggtcaccttggcgttctgatcgttgctctgcgtggcgatggcggaagccgggtcggtcgggcccatgccccacagcaggcgcaggaacacgcgcaggtagtggacggtgttgttccaatccttctcgttcatgttgagaatgtcaccgttggtgaactgtgcgatcggttccagcaaggtggtggtgttcatggtggacaggtacatcttgccctcgtgaacggtggtctgccaggtgtattggttcatgtggttgtcgtagccgctgcccagaccggtggaaccgcccttcgggaaggtgtcgttcttgtcgcccacgagcatctcgacgttctcgttcttgtccatgcggtataggttgacggactgttcgaggttggtggcttgggttacgaagttgcttttggtgacgaagccctgcagtgcgctggacacgtcgttgtagtcgccgatgtacaagtggtcgccgtagacctgcagggtgcaggcgccggcgctcacacggcttttgtcaagaccgtagtagtacttggcgcccttggcggtgtcgcctacgagcggacgccaggtccaatcggccttgttggtggaatcgcccttgttctcgcccacgtaaatggcgaaggagcgcatggttccggtctcttcgttcagggtgctggtgtcgccggtgcagaccacgacgtacagcttgccgttgaactcctgcacctgatagataccgccgccgccgttgacatcctgtcggtggatggcgggcaggttgtcgaagctcgccatgtcggcgatcactttgtaggagttcggatcggacggggtcttggatgccacaagcagcgccttgcccttgccgtccgcggtcggcttgaggtcgccggcgatcagcgtattgccgaaggagccgatggcacgggtggaggtgaacacgttgcccttgaccagggaacggaagccatccacgtcgacgctgtcatacaccttggtgagcttgtcgttgttggccgggtcgacttcgtagatgcacgggaatccgttttgataggccatggcggtctggatctcctgctgggtgagatccttgttgttggtgtccatgaccatgccctcgaagtacagcttgccgttcatcttgaaggcgctgcggaaggtcgggatcacgcccttgcctccgtcgatgccggtgctcttggacatgaggatcttggtcttgccggtcttcacattgaacttgaacagcatgccgccggcgctcttgccgtcgggttcgccaaggtacatgttgcccgcgtacatggtctggatgagtgcggtggcctgcttggaggtcaggccgaggcttgtcatatcgcggttcagaatggcctgcacgccgaggccgccgtacatggtgccgatgtagacccagtcgccggaggatgctgccgcatagctgtaggactggccgcggtcgccgttgccggtggtgctcaggccggcggtatagggggcgatggtgccgtcgccggtgtaatcgaccacgccatcggcctggctcaggccctgatcggcgtggctgaccttttcgaaggtcatgccgttatcgttctgggaattgtaggtgtattggggagtcaggccggcggagtcgtccgccatggcggtggccgggattccggcgagagccgttgcgcaagcgacgattgcgccaaggcatgcgattgccttgtttctcatctatttctcctgtcttcgcgcgacgtggaaaacgtcattgatgggggcatctagggggctgcccgccgtaagcggcgggagtcataaaagcgtgtattgcaagagcctccaataggcaaccgtatcgataaatattgacaagttgttatggcatatgttgcacaatggcagacgaatatgctatgacgcacttcgattccgccattgcattggtggtacgcaaaggggtgttggctgagcgtatcgggggatggggcggaagcgcttaagtatgggcgggaacgctatactgtaccaaggcaggatttttattaaagatgggttagataacgatatgactgcaaagaagcgcatccttgcgttcgaaatcggaacgttcttcacccgatacgtggtgttcgaggacgggcgcatgggcattccgggtactatcgcgactccggtcgacggcgaggagcccttctaccaggcgctcgcgcatattgtttccaagcagcgtgcccctcttgacggcatcgccataagcgtgcccggcttcatcgacacggagaagcaggtcgccgttaccgccggcgcgctaagcatactgtacggccatgaaatcggcagaaaactgcagggctatcttgacgacccgatccccacatggatggagaacgacgccaactgcgcggcaatggcggagaagctgagcggcaacgccgtcaaactcgacgattttgcgctgatcaccatcgacagcggtgtgggcggtgcgttgttcctggacggcaggatccgccgaggcaaggattggcgtgcaggcgagctgggcatgatgatcccgaactatgagaccggtggattccacaccatgcaggattacctgtcgaccatcgtgctggcggaggagtacgccaaggaattcgacgtgccgacaggctccatcgtgccggccaccctgttccatcgtctcgatgagccgcgtgtgcgcaagatcgtggaccggtggatcgactatcttgccatcggcattttcaacatcgtcgccgtggccgaccccgaatgcgtgctgctgggcggtggcatctgccgtgaacagcaattgctgccgctggtcaatgcggcgctcgacaagatcccgcagtggagcgatttccacacggttgtcaagcgctgccggcacaccaacaacgccggtctgatcggagcctactacgccttcgaaaccgaggtcgaaggcatggagaaggtgccgatccgctagtcgcggatgcttccgatacgaaaatcggcgggtccgcttcccgtgaacggccccgccgatggcgaatatgcacaagagcggtgggcggtcgatatcgatcttccgctgtaatgctctgctgatcttcggggtcagagctactgccgtgccgacaaggtaagcggcagcaggcaggattcgttcttcgggtcgtgctccgaggggtcgcggaagccctgccattcgctatcggggaagatgatgtcggagatgctcatccattgctccagcagattcatcgaattgtcacccagccaacggtactgcagaccgtccatggcgctcatcgccagggtgtacaggtcgtagaaccgttcctcgtccacgtccggcggcagcagccagttcatcgagcaaatcatctcccattggcgcaaatggcggccgatgaagaaatcgtgggccgggtgcgaggggttcagcgcctcgccgttcagcaccgaatacagctgcacgagctcggggcgctgcagattgtacagcacgatgttcaggcaatagcgcgggtagtagtagacgcggtgcccgtcggcgtcgacgatggcggccgtcaccgcgttgtattcgtcggcatcgatggtgtcgtagcattccgacagcaccatgttgagcagatcgtccttcgaggagatgtaatggtacaacgccgcctcggtgatgcccagctcgtcggagatgttctgcaacgacatgccccagaaccccttggtggcgatgattttgacggcggcctgcaggatttgcaggtggcgttcctcctgactcatacgcttgcgtttgacgaaggtcttgtcgcccagcgtgtccctggcggtagtggcccccgtagcgttgccgatgcgtgaggcggccggccagttgctctggtcattcaggaatccatcccatgccgcgacgctcatagccagctccttacacccctgctcatcgtgtccctcataaaaccatccaatactattacgccctctggcctctaggcgaagagtcgccgtagccacgcgttggccaacaccggccattgctggacgcatggctcgatgccattaaccccctgccacgccgtttccgcagtgccaagcgccagaccatgcccgccttgggggaacagatgcgcctcgaccggcacgccggccttcttgcaggcatcgaccaacatcagcgtgttctcgaccggtacgcaatcgtcggtgatggtatgccatacgaatacgggcggcgtcttcgcgtcgatatgccgttcgatggacaccgcgtccaacgccacctgattatcgctgttgtcgccaagcagacagtcgaagctgccacgatgcgcgagcgggcctgaagtgatcaccgggtagccgagcatcaatgcgttcgggcgcaccgcgtcagggtcatagccatgtgcccgcatggtgtcgtcacccgccgtggtcgcaagattggccgcaagatgaccgcctgcggaaaatccgattaccgcgatcttactggggtcgcaatgccagtcgtccgcatgcgcgcgtatgcgctgcactgcttccgcggcttccagcaaagccgtggggaagacggatggcgcgacggaatagcgcagcacaaacgcgttgcatccggccgcgaggaactgcatggcgatcggttcggcctcgcggtcggaggtcatggcatagccgccgcccggaatcaccagaacgctggggcgttgacgtttgggatcgatctcctcgctgttgtcgagaacgtaccggacgaacgtggcctcactgccatcgatgccggtgatgatgtcttcacaatactgcatatcgctaccttagacggattgtgtgtgcgaatccatgcggccttctatgcggcacacggattcgcactgttctgatcggttcctgccttccacaaggttgcaggaaaccgatggaggatcgccggaacaacctatatgcaagatgctccggcaatccatgttcatgttgaggagagtgtaggcccgccccgtttgtgagcacgttctgatgctcacatcagaacgtgacctcgacatcgacggatttggcatcgctcaaagcgggaaccacattaccgccaatcttcgctccgtcgacgctcaccgtgcgctcgccggtgcgcttcatggcgatgcggtaggtcacgccgcggaacacgcgcgtcacggtcagctggtcgaaccgttccggcagatgcggttcgatggccaggccgtcgagcgtcggtcgcacgcccagcagatactgcgacacgtccacgaacgtccacgcggcggtgccggtcagccaggagttcttgccctcgcccggggtcgctgcctcgggaccggccaccatctggcagtagacgtacggttccaccttgcgcacgtcggacttgtcctcgacatacgccgggcagttgcgctggtagacggcgaatgcctcgtcgtcattgccggcgatggcgttggcgatggagatccacgggttgttgtggcagaagatgccgccgttttccttgtatccgcgcggataggaggagatttcgcccaattcgatgcggtaggtggagtaggcgggtgcgaggatggcggtgccccaatcgcaggtcaggcgttccttgacggacttcagcgcctgctgcgccttgccgtcatcgaggccgatgccggccatcacgcacatgccctgcggttcgatgtagatctggccttcggtgtcctcatgcgtgccgaccttgcgcgagtaggcgtcgtaggcgcgcacgaaccattcgccgtcccagccggcggttttgacggccttggaaacctggccgatttcggcgcgcacgctggccgcctcggacgcgatttcggcgtcggacatgccggccagacgtccataatgctcgaggatgtcggcatattggctgccgtacagcacgaacatgccgccgatgaacacggattcggcgacgccggtgtcgttgttctccacggtctggaagctttcgcccggagtatcggagaaacagttgaggttcagacaatcattccagtcggcgcggccgatgagcggaatgccatgggggcccttatgcgtaatggtgaagttcactgaacggcgcaagtgctcaagtagcggctgttcggagccctcgacgttgttgaacggcaccggttcggtcagaatgctcacgtcgccggtttcggcgagatacgcgtacacgccggccacgagccacagcggatcatcattgaagccgccaccgatgtccgcattgcccttcttggtgagcggctggtactggtgccatgcggaaccgtcctccatttgggtggaggcgatgtcgatgatgcgctcgcgtgcgcgttccggaatgagatgcacgaagccaagcaggtcctggttggaatcgcggaagcccatgccgcgtcccatgcccgactcgtagtaggaggcggaacgggacatattgaacgtgaccatgcactggtactggtgccagatgttgaccatacggtcgagcttttcgtcgccggaatcgacgctgtaggtggtcagcagttcggaccagtaggagttgagctccttcaaggcggcttcgacctgttcgacggtggcgaaacggcggaacagctcatgggccggcttcttgtttatgatgccgaccttggccggatcgttcggatcctcccatttctggtccttggccacttcgatatagcccagcatgaacacgagcgatgcggtttcgcccggctggagttccagacgcacgcggttggcggcgatcgggaaccagccgtgcgccacggaatcgtgagccttgccttcggcgatgacctgcggggtgtcccagccgttgaactggccgaggaactcgtcgcggctggtgtcgaaaccgacgacgggcgcgttgacgccgtagaacgcgtaatggttgcggcgctccttgaattcggtcttgtggtacagcagcgtggcatcggtttcgcgttcgatctccacctcgccggtggacaggttgcgctggaagttggacgagtcgtccacggcattccacaggcaccattccacggagccggtcacgtcgatgacggccggctcgtcggtggtgttcgtcacgtcgagccgattgatttccgcattggtgtgcagcggcacgaaggcggtgagcttggattcgatgcctcgcttggaagcttcgaacacggtgtagccgatgccttgacggcacttgtaggaatcaagcggggtcttgcacggaaggaaggtcggcgaccaggtttcgaccggcttggcatcggcggaatcggagtccatcaggctcaggtaatagcagcgggagccgttgtctgccggcacgttgttataccggtagcgggtgatgcggcgtagtttggcgtccttgtagaagctgtagccgccgccggtgttggaaatcagcgagaagaagtcctcgttgccaaggtagttgatccacggcaggggagtcgccggggtttcaatcacgtattcctttgcggtatcatcgaaatgaccgtagcgcatgggtgtcctttcgtcggtgaaatggctgtgacgaggtgtgctgtatgggtatatcgtccattgatttaattaataggttagcacgttatttataaacttataaataacgatttgctggcgtgttgccgtcggtcttccaatggtcatctgtcgacgctgccgcaatcgggcagaggttggggtatacttcctcccgttgccctcgtagctcagttggttagagcagcacccttataaggtgtttgtcctgggttcaagtcccagcgagggcacatgcggacctgccggaagcggcgggtcctctgcatatccgcggattacagtccgtacgccctgcgtgtgacggcgcataccgtgtcccggccatcgcctacactccataaggttatccggttcacgccttgccatcggggcaatgcgacccgggtcccccgaatctctaggagacaaactatgaagcagggtatccatcctgattaccacgcagtgcaggtcacctgctcttgcggcaacaccttcgtcacccgttccacctacaacggcgatcacatgaccgtcgacgtgtgctccaactgccacccgttctacaccggcaagcagaagatcctcgacaccggtggccgcgtggctcgcttcgagaagcgttacggcaagaaggccaagtgagtcttattgcttaggcaatgaaaacgccagtccattcgtgggctggcgtttttcgttaccgacgtgccgtcgcccacctccgacgaccgcacttccgcgccaccttatatgatggacaggtcgagtaaggttcagcgacgagtgattccgctgaagcgcagatacgaagaaaaggcgtacattggcagacgaacaattccccgcggccgtcaccgcgcttgaggaataccacaatatcgaacagcagatggccgagccggaggtcgcatccaatcccgacaagatgcgcaagctgggtcggcgccacgccgaactgggtgccatcgtctccgcctacaccgcatacaagcaggtaaaggacgatctggaggcggcccgcgagatggcgtccgaagatcccgatttcgccgaagaggccaagcggttggaaggcgagctgcccgcagtcgaagagaagctgcgcaccgcgctgattccgcgtgaccccgatgacgcgcgtgacacgatcatggagatcaaggccggcaccggtggtgaggaagcggcgctgttcgccggcgacctgctgcgtatgtacatgcgatacgcggaaaagcgcggctggtcggtcaccgtgcaaagcgagaacaccaccgagctcggtggcgtcaaggacgtgcagctggccatccgcgccaaaggcactccggcgccggaggacggcgtgtgggcttccctcaagtacgaaggcggcgtgcaccgcgtgcagcgcatccccgtcaccgaatcgcagggacgtatccagacttccgccgccggcgtgatcgtcttcccggaagccgacgaggacgacgatgaaatcgaaatcgatccgaaagacctcaaaatcgacatcttcatgagctccggccccggcggacagtccgtgaacaccacgtattccgcggtccgcatgacgcacatccccaccggcatcaccgtgaacatgcaggacgagaagagccagatccagaaccgcgcggcggcactgcgcgttctgaagagccgcctgctggccatgaaacacgagcaggaggccgccgaggccgccgatatgcgccattcccaggtgcgctcgctggaccgttcggaacgtatccgcacgtacaacttcccggaaaaccgcatcgtcgaccatcgcacgaactacaaggcatacaacctcgacgccgtgcttgacggcgatctgcaggccgtgatcgacagcgacatccaggcggacgaagccgatcgtctcgccaaccagaagtaaggcgattgggtggcgacggtattcgaaacggtgcgttccgccgcggacgaactacgcgcggcgggcgtcgacactccgcagcacgacgccaaactgctgctcgccgaagcgttccatacggacctgcagcacgtggacaaagccatgctcatgggcgatggcgtcgaacgtctggccgaaaaagaagacgcggaaccggcgatggaacgtttccagaccatgctggcccgtcgtgtcaaacgcgagccgttgcagcacatcaccggccacgcgccgtttcgctaccttgatttgaaagtcggtccaggcgtgttcattccacgtccggaaaccgaactggtcgtgcaggaaggcgtcgactgggccaccagaaacggcatgtaccgcgccaaagtggtcgatctgtgcgccggcagcggtgcgatcggcctcgccttcgcttcggaagtgccgggcagcgaggtgtgggccgtcgagaaaagcgctacgaccgccgagtggacgcggcgcaacctcgacgagaccgcgaaacggtatcccgcaatcgccggtaattatcatctggacatcgccgacgccacgcaaatgccgacgttaagccaacttgacggcaccatcgacatcgtgctcaccaatccgccgtacgtgccgcttgccgacattcccgaacagccggaagtgcgcgattacgaccccgatctggcgctatacggcggttcggcggacggcacgctcattccggaacgcatcatcgcacgcgcggcgaaactgcttcgcgcggatggacttatggtgatggagcacgacatcacgcagggggagcggcttgccgccttcgcacgaacctgcggcttcgtcgacgttaccgtgcataacgactacaccggacggccacgttatctgacggcggaaaaacagccggcacagtaacttatattcttttgcgccatgctgacggggatataaccagaagttgagtctcactataagaacattttatgcaggccgccgtccgtcaggctataaagaacaatcggaatgcacagagagagaacgggcgtccgtcatgagtggtcgccgtggttccgcgcacgggggttgagatgaacatgattttttccaaggtgcgcgttgaaaggaatgtgcagcgttttcaagaaaagaggaagaacggaatgaacgcgaagttctccgccaagtgcgtcgccctgatcgcggcaggcgcaatgtcgatgtccctcgctgcctgctccggcggcagcatggacgattccagcagctccaacggtagcgcggccaacagcgataccatcacgctgggctccgtcaccaccaactccggcaccgccgccgcatacggcgaggccgaggtcgccggcttcaagctggctgtggatgagatcaacgccaagggcggcatcaacggcaagaaggtcaagctcgagtccatggacgacaagggcgacgccaccgaagcctccaacgccttcaacaagctcgccggcgacaacagcgtgctcggcgtggtcggcccgaccatctcctccaccaccgcggccgtggctccgctggccgaccagtccaagctgccggccatcgcaccggccgccacctccgactccatcgagaccggtggctatatgttccgcacctgcttcaaggactcctaccagggtgagatcgctgccaagttcgcagccgagaccctgaaggtcaagaaggtcgccgtgctgtacggcaccggcgatccgtactcctccggcgtgggcaaggccttcgccgctgccgccaagaaggccggccttgacgtcgtggccgaagagaactcctccagcgccgacgacaccgagtactcctcccagctgcagaagatccaggccgctggcgccgagttcctgtacgctccgtactactactccgtcgctggcccgtacatcatcccgcaggcccgctccgtcggctacaagggctatgtgatgggtcctgacggctacgacggcctgaagatgaccgacgacaagtcgctgtacaacaaggtgctctacaccacccactactctccggacgacacctccaacgccaaggtgcaggacttcatcaagtcctacaagaaggccaacaagaacgccgatccgaacaccttcaccgcactgggctacgactccgtgtacatgatgaagcaggccatcgagaaagccggcaagaacgccacccgcgaaggcgtgcgcaacgccatcgccggcatgagcttcgaaggcgtgaccggcaacttcacgctcgacaagaagggctccccgaagaagtccgtcgtcgtgcttgagctcaaggacggcaagccgcagtacaagaccaccattcagcctgccaagtgagcgtcgcttgcctgaaggcctgaatctgtgaagaggaggggaccgggaaaccggttctctccctttcgcgtatcaagacgaaaataaccatattcagccgctgggcttcttcagcggccaagccggacggttatgtcaaaagtccggcatcatcaacttttgaaaggaggaatgatgggcgatcagatcatcatgttcatcagtcagatcttcaacggtctgaagatcggcagcgtgtactcgctcgtggcactcggctacaccatggtgtacggcatcattcgtttgatcaacttcgcacacggcgatttcatcatggtcggctcctacgtgctgatgcttaccattccggcgatcgtcgcgttcggcctgcccgcatgggtggccgtcatccccgcgatcctcatgtgcgtggcggtgggcgtcatcgtggagagggccgcatacaagccggttcgtgaaaagggcaacagcatgacggccctcatcaccgcaatcgcaatgagccttctgttggagaacggctcccaggccatcttcggcgccgactaccagaccgtgcccaccatcatccagattccgacgctggcgatcggcaagctgaagatcgacggcgcgaccatcatcaccatcgtgctcggcgtgatcatcatggtcgcgctgcagctgttcgtcacctacaccaagcagggcaaggccatgcgcgcggtctccgaagacaaggaggcctcgatcctgatgggcatcaacgtgaactccaccatcacgctcacgttcgccatcggttcgggcctcgccgccgtcgcatcgctgatgtactgcgtttcctatccgcaggtgtccccgatgatgggcgcgatgctgggcctgaaggccttcgtcgcggccgtgctcggcggcatcggctccatcccgggcgccatggtcggcggtctggtgatcggcgtggtcgaaagcctgaccaaggcgtacatcggcaccatcaccggcggcgtgatcacgtccgcgttctccgacgccattgtgttcggcatcctcatcatcgtgctcctggtcaagccgtccggcctgatgggcgaaccggaaaccgagaaggtgtgacctcatgaagaaatcaatgctttccaccaaacagtcctatctgatgtgcgcggtcggcatcgtcgtgctgttcggcattctgatgggtgtatgcgaatccggcatggccagcacctacatcaagggcatcatgatgacaagctgcatcgccatcatcatgaccacctctctgaacctcaccatcggcgtgctcggccagctgacgctgggctgctgcggcttcgaagcgatcggcgcatacagcgcggccctgctgagcaagctgctcgtcgccaacggcgttgcgatggatccgacgctgcgattcctgctgacgacgctcgccggcggcgtggtcgcctgcatcttcggcatcctggtcggcattccggcactgcgtctgcatggcgattacctcgccatcatcacgctgggcttcggcgaaatcatccgcgtgatcatccagaacctgaaggtcgccggcggcatgggcctcgacaagggcgcggccggccaggcgctgatcggcatcgaccgactcgccaacctgtacgtcgtgttctggatcaccgtcgtcaccgtcgtgctgctgttcatgttcgcccgctcccgttacggccgtgccgtcaaggccatccgcgacgacgagatcgcggcaagcgcgtccggcatcaacatcacctacatgaaggtgctcgtgttcgctatctccgcgttcttcgcgggcatcgccggcggcatcttcgcccagtacatcggctcgctgaaccccgcgatggccggatggctgcaatcgatcaactacgtgatcatggtcgtgttcggcggcatgggctcgctgacaggttccatcgtctccgccatcgcgctgacgatcctgccggagctgttgcgcgccttctccacctaccgcatgctcgtgtactcggtggcgctggtgctcatcatgatcttccgcccgcagggcatcttcggcaactgggaattctccctgaccaagaccatcaacaagctgttctacccgatgaaggtcaaggcgcacggcaagtcgaagcaggctgaatccaccgccaaggcagccaaggacaccgccaagacggacgaaaccgtcgagacggccgccgacaccaaggaggcgcaggcatgagcgagcccatcctgaaagccgaacatctcggcatcaccttcggaggcctcaaagccgtatccgacttcaacatgaccatcaactccggcgagctcgtcggcctgatcggcccgaacggcgccggcaaaaccaccgtgttcaacctgctgaccggcgtgtaccagcccacggaaggcgagttcttcctggacggcgaacgcatgaacggcaagaagacgtaccaggtggtgcgcgccggcatcgccagaaccttccagaacatccgcctgttcggccagatgaccgtggaggagaacgtgctggtcgcattcaacgaatcgttcagctaccacatgggcggcgcgattttccgcacgccgaaattctggaagcaggaacgtgagatgcacgccaaagccatcgacctgctcaagatcttcggactagaaggcctggctgaaaccgaagcggcgaacctgccgtacggcgcccagcgcaagctggaaatcgcccgcgccctcgccaccggcatgaaactgctgttgctcgacgagccggcagcaggcatgaacccgacggagaccgaggacctgctcaactgcatcaacaccatccgcgaccgcttcggcatcgccatcctgctgatcgagcatgacatgagcctggtgatgaacgtctgccagcgcatccaggtgctcgactacggacgcaccatcgccgccggcacgccggaggagatcgccaacaacccgcaggtcatctccgcatacctgggttccgacgacgataccgacagcgacgatgccaagcacgaaagcgaggaagcctgatgctggaagtcaagaacctttccgtttcgtacggtgccatcgaagccgtcaaggacatcagcttcaccgtcaacgccggcgagatcgtgtccctgatcggcgcgaacggcgcaggcaagaccaccacgctgcacaccatcaccggtctggtaccggcgaaatccggttccgtgatgtacaacggagtggatctgctgaaaacccacaacaacaagatcgtgaccctcggtatggcgcacattccggaagggcgccacgtcttcacacgcatgagcgtcgaagagaacctggagatgggcgcgttcagcctgaaggaccagtcggacctcaagaaggacctcgacatggtctacggcctgttcccccgtctgaaggaacgccgtaaccagaaggccggcacgttgtccggcggcgagcagcagatgctggcgatgggccgcgcgctgatgagccatccgaagacgatcctcatggacgagccgtccatgggcctgtccccgaagctcgtcaaggagatcttctccatcatccgcaagctgcacgagcagggcatcacgattctgctggtcgagcagaacgccaagatggcgctgtcgatcgccgaccgcgcatacgtgctggaaaccggccgtatcacgatggaaggcgacgccaaggaactgctcaacaacgagcaggtgcgcaaggcgtatctgggcgcctgattcgtgccgtatccgccttgtcggcttggacgcatccaaaccgacagggctttttctatatccgatggaatattcgccggtcgtgttccctccattcgggcgcgccatcgagccatgccttacaataggtaagttgactggctgaaagggaggtgtcatgagcgagatttgcacagtaaacgacgaatcccttgcccgggccgttgaaatcatccatgatggcggattggtggtcatccccactgacacggtgtacggcgtcgcctgcgatccgcgtaacatcgaggcgatccgcaaggtgttcgcagccaaacaacgaccgaaatacaagtcgttgcaggtgttgctgccgtcaatcgaaagcatggagaagctgcatctgaccttgccggtgccgctcaaccgtctggccgccatgttcatgccgggcgctttttcgccgatagcggaagcggaagacgactgttcgcttgccacgttgcgtcatgatccgacaaccggcaaagccacacagggcgtgcgcatccccaattccgcggtcgcgctgcgtattctgcgagccaccgggccgttggccgccaccagcgccaaccgttccggcgaggaaagcgcacaaacggtgcaggaagccgcggacgcgctgggagatgcggtggatctgtatttggacgggggagcgactccgggacatgtgtcgtccacggtggttgcagccgacccgcacgagcgcgacggcatcgcgattcttcgggagggagtgattcgcgagctggtcatccgtaaggctttaacactgaatggcggtgctttgggcgcatgagaatctacctgttcattgccgcggtcgcaggtggcgtcacctatctgctcacgccgctgatccggcacatcgccatcgaaatcggcgcagtcggcgaagtgcgtgcacgcgacgtgcataccgtgccgacgccacgcatgggtggactgggcatgcttatcggcttcaccgtggccatgctgttcgcctctcgcatccctttcatcgaaggcctgttcgcccaatcgcatcaggcatgggtgattctagccggcgccatcatgatcagcctgctgggcatggccgacgatttgtgggaccttgactggatgctcaaactcgccggtcagctgctcatctccgtgtttgtggcctggggcggcctgcagatcatctcgttgcctctcggctcgctcgtcaccgcgtcgccgagcctgtcgatggccatcaccgcgttccttatcgtcgcgtccatcaacgcggtcaacttcgtggacggtcttgacggcctcgcttcgggcatcgtcgcgatcggcggcatcgccttcgccatctattcgtacatcatcgcaagaagctcgccgtcgtacgcatccatggcaacgctgatcgacatcgccatggtcggcacctgcgtcggtttcatcctgcataactggcatcccgcaaaactgttcatgggcgactccggttccatgctgcttggctacctgatcacctgcgcgtcgatcgtcatgaccggccgtctcgaccctgcatccatccacgccagcatctacctgccggtgttcatgccgattctgctgccgatgctcgtgctgttcctgccgattctcgacatgtgccttgccatcgtgcggcgtttgagaaaaggccagtcgccgatgcaccccgaccgcatgcatctgcaccaccgcatgctgcgcatcggacattccgtgcagggcgcggtgctgattctgtggggttgggccgcgttgatctcgttcggttcgatcatgatcctgttcttcaaggcacagtatgtgctgatcggcttcctcatcgcggcggcgctgctgacggtcgccacaatgtacccctatctgaagcaccgcattccggagatccgtgaggagaacgcggccgccgaatcggacgctcagcatgcgtcggtcggacgcgcccgcggcggcaatgcccgcggcgaacgctgaccgttttcaacgcgtcaggcatccgcatcatccgtctaaaatatgatgaaacgctttgccaaacggtataagtagcttttattgcgattgataatttcggctttccgagccgtgtcgcagtaagtcagcacacgttcatatagtgtgtttatggctacaattcctgatatgaatgcagattccacgttcgccccactccctccgattttcgcccagcttggcctcgcctatgacgatgtgctgctgctgccgaacgagacggacgtcattccttccgaggtggacaccaccacgcatctcacccgtaacatcacgatgaaggtcccggcgatctccgccgcgatggacaccgtcaccgaatccgacatggccatcgccatggcccgtaacggcggcatcggcgtgctgcaccgcaatctttccatcgacgaccaggccgcccaggtcgacatcgtcaagcgttccgaatccggcatgatcagcgatccgctcaccgtgagcccggacgtgaccctggccgacctcgacaagctgtgcggccgtttccacatctccggtctgccggtcgtggacaaggacaacaagctcgtcggcatcatcaccaaccgcgacatgcgcttcatcgcatccgaggattacgaccgtttgaaggtctccgaagtgatgacccgcgagaacctcatcaccggtccgtccaacatctccaaggaggacgcgcacgacctgctggccaagcacaaggtcgaaaagctgccgctagtcgacgccgaaggccacctgaccggtctgatcaccgtcaaagacttcgtcaagaccgagcagtacccggacgccaccaaggatgagcagggccgtctgcgcgtcgccgcaggcatcggcttcctgggcgacgcctacaaccgtgcttccgctctgatggaagccggcgtggacgtgctcgtggtcgacaccgccaacggtgaggccaagctggctctcgacatgattcgccgcctgaagtccgattccgcgttcaatggcgtggacatcatcggcggcaacgtcgccacccgccagggcgcgcaggccatgatcgacgccggcgtcgacgccgtcaaggtcggcgtcggcccgggctccatctgcaccacccgcgtggtcgccggtgtcggcgtcccacagctcaccgccgtgtacgaggccgcccaggcctgccgcgccgctggcgtgccgtgcatcgccgacggtggcatccactactccggcgacatcgccaaggccctcgtcgccggcgcatcctccgtgatgctcggcggcaccctcgcgggctgcgaggaagctccgggcgagaaggtgctcctgcacggcaagcagtacaagctgtaccgtggcatgggctccctgggcgccatggctccgcgtggcaagaagtcctactccaaggaccgttacttccaggccgacgtcacctccaacgacaaggtcgttccggaaggcgtcgaaggcgaagtgccgtaccgcggaccgctcaacgccgtgctgtaccagatgatcggcggcctgcaccagtccatgttctacattggcgcgcacaacatctccgaaatgccggaacgtggccgcttcatccgcatcaccgacgctggcctgcgcgaatcccatccgcacgacatcgtcatgaccgccgaggcgccgaactactccggccgtcagtgattggcgaataccgcgcgaaacgcatacgacgcgactaaacgctagataatacgaaacccgtccggtggcaggaatgccgctggacgggtttcgtgcgttttcggcagctattggtctagtgacgtttagttaattgagccatgtcgatggtaccgtatgaacgtcaacttacgcgttccgtggtgccacgcagcaccagcgacgtcggcatgacggtgaacggctcgtcaagcgtctcgccattgagcagcgcaagcgtcttacgtgcagcgatacggccgatttccgccggatcctgatgcatggtggtcagatccaatgcggtggcggtgtcgtcatcatcgaatccgaccagcgacacgtcctgtggcacgcgccatcccatgcgccgcagctccttcagcaggggagcggccacggcgtcgacggagacgcagatggcggtcggctgctttggagcgctgagcagctgcgcgacgatgccggaatagatgtcctgctcgctgcgagcatcgatatgggatagtgacggcatgacgatgatgtcactatccgcgtaaccgcaagcttgtgaggcttcgctgaatcccttcttgcgcagcctgtcggagcagacgaacggcgtggtgttgatgggctgttcgatgtaggcgagcgtcttatgccctaacgatttgaggaaccgtacaatcgtcgccatggaagcctcgtcgtcgatggcgacgccggcgtcgagaccgtgcgtgctcggcgcgttcatgccgaccaccggaatggtcagatcgccaagcacctgcttcttcgcctcgtcgaagtcaaatgacgcctcgatgaccgcgtcgacgttgcggttgcccggaagattttggaaaaacgcatccaaatcgtcctgcgtccacacgatgtaaggaacgatgtcgtatccggccttcgacatcacctcgtaaatgccttcgaaggcgtgggcgttgaaccagctgctgatttcgttcggcagcagcacggcgactcgcatggttttgccggacgccagggacgacgcgcttttcgaaaaggagaaatgcaggcgcttcgcctcctgctcgatgcgttccctggtttcgggactgaccctgtcgagcccgcgaagcgcgcgggacacggtggagacggacactccggctgcctgggctacgtctgcgatggtggttcgtggcatggtcggatggctccttagggtggactatgcgggcggtcggttgcccgcgactgcttcactctatcacgacacgctgcttttgtaaaaacgcttgcatggcttcaggtgttgttattgcttgctttttgaagtgctgccaccttgttctgcctcctgtggtttgcgcttttttgcacaagcgttattattgattatgtcaagcaatgcgataacagcaacgaagctacacaacacaacataaccatcgtaggaaaatcaacgaaaatcgttctacgtacggagttgtgatacgtgcgcacggtgcacaagcgtttgtatgaaaggggacaacatgaccgaagtcaacgatccgtcgctgtggtggaagcaggccgtggtctaccaggtgtatccacgttccttcaaggattcccgcggcgagggcctcggccagatcgccggcgtcaccgagaaaatcgggtatctgaaggaactgggcgtcgacgccatctggctgagcccgttctacccgtcccagctggccgacggcggctatgacgtggacgactaccgcaacgtcgatccgaaactcggcaccatggacgatttcgacgcgctcgccaaagccgcgcatgccgacggcatcaaaatcgtcgtggacatcgtgccgaaccacagctccaacctgcacgaatggttcaaggccgcgttggccgcgaaacccggctcgctggaacgcgaccgctacatcttccgcgacggcaagggaccgaacggcgacgagccgccgaccaactggcagaaccacttcggcggccctgcatggacgcgcgtgcccgacggccaatggtatctgcacatgttcaccaaggaacagccggactggaactggaaaaacgaggacgtgcgcgccgatttcatcaaaaccctgcgtttctggcttgaccacggtgccgacggcttccgcgtggacgtggcgcacggcctggccaaggatctcgaccgcgatgatctggacgattatgtggtctggtgcaccaacgatcagcccgaagacggctcccatccggtgatcgaccgcgacgaagtgcacgacatctaccacgagtggcgcaaggtgttcaacgagtacgatccgccggcgttcgccgtggctgaggcgtgggtccgaccaagccgccagcatctgtacgcctccccggacgatctcggccagatcttcaacttcgagttcgccaagaaggattggatccgcgacgacatgcacctcgccatcgaggaaggtctggaaagcgccgaacggtccggttccaccgccacttgggtgatgagcaaccatgacgtggtccgccatgccacccgctacgcgctgccccaggtgccgaccggcgaataccatcgactgccgctcgactggctgctgcgcgacggcaccacataccgggaggaccgcgcgctcggcaccaagcgcgcccgcgccgcgatcatgatggagatggcgctgcccggctccgcctacgtgtatcaaggcgaggaactcggcctgttcgaagtggccgacattccgtgggatgagctggaggatccgtccgcatggcgcacctcccgttccgccagcaccaaaggccgtgacggctgccgtgtgccgctgccgtgggttgcggccgacgctccgcagctggacgatccgaacgatgagttcggccatggcggctccttcggattctcgccggcagacgcgaaggccgagccgcatctgccgcaacccaagtggtacaaggatttcgcggtcgatgtcgaatcggccgacccggattccatactgaacctgtaccgccgcgtgctggcattgcgacatgagttgcagaccaccgacctgagtctcgaatggcttccggaagaccagcccggcaaggcgcatgacggcgccaacggtttcccgggtggcaccatcgcgtaccgccgtgccaacggctgggcctcgatcaccaacttcggcgaagaaccgatcacgttgccgcaaggcgaagtgctgctgacatcaggaccgcttaccgacgacggcaagctgccgcaagataccagcgcttggctcaaactggccgattgaccgcacgcaggatgccccgatctgagggtgtccgtgccggataccgcactcgtgcgctgaaccatcgaaccggcagcgcgctccagccgtccgcgtccctccatttgggcgcggacggctttcctgtttccaacgaccgttttccaacgatgacggtccgacgtacctaccctgcggtatcttcatatgttcggcctgcgcagagggcgcgaccgcggaccaatcgaaagaggcaacgatggtagatgcacacgatggcgaaacatacacgtccgaaggctcacgtctgatctggatcgactgcgagatgaccggcctggatatcttcggcggcgacgagctcgtcgaggtttccgtggtgccgaccgacttcgacctgaacgtgctcgacgaaggtgtcgactatgtgatcaagcccagtcagaaggctgtcgaccacatgaatgacttcgtgcgcgccatgcacacccgttccggcctgatcaacgaatgggaacacggtctgagcctcgacgaagcgcaagccaaggtcatcgaatacgtcaggaaattcactccggccggcgtcaagccgctgctcgccggcaacaccatcggctccgacaagaagttccttgaccactacatgccggaactcatggagaacctgcactaccgcaccatcgacgtgagcaccttcaaggaactcgcccgccgctggtatccggccgtctacctcaaccgtccgccgaagaacggcggccaccgcgcgctcgccgacatcatcgaatcgctcgacgaactgcgttactaccgcaaggcgttcatggccccggtgcccggtccgagcgaagcggaggcgaaggccatcgcctctgaaatccaggaaaccagcctgctcaacaaggactgacagcacgactccagcgagaggaaccgcatgaccgcagctgattggaccaccatcggccaaccgcaggatatccgccttgtggtcgccgacatggacggcacgttacttgacgaacgaagccgaatccccgacggattctggcccatgctcgcccggctcaaacgccgtggcgtcgaattcgtacccgcgtccggacgccaatacgccacgctgcgcaacatgttcgccgacaaagccgcggagattctcgacgggggagaactgtcctatatcgcggaaaacggcaatgtggtggcgctcgacggcaaagtcgtggaagtgcatggcgtcgatttggacgtcacgcgtcacgtcatcgacctggtcgacgacgccgctgcctccggcgagcataacgtgggactggtggtgtgtggcctcaaatcggcatacgtgcagcgttccgacaagccgttcctcgatgaagtcggcaaatactacgcggcgctgagcatcgtggacgatctgcacgaagtgctcgacttcgcgcaggaaccgtccgcctacacccctgacggcgacgccgaaatcgttctgaaactcgcgatcctcgaccttgacggctccgaacgattcaccaacgaaaagctcacacatctgcgcgcggactaccaggtggtcgtctccggcaaactgtgggtggacatcatgaacatcgaaaccgacaaaaagcagggcgtcgaggcgttgcagcgcgtgctcggcgtcacacccgcgcagacggcggtgttcggcgactacctcaacgatctgctcatgcttgaggcgggcgactggtcgttcgccatgggcaacgcacaccccgatttgaaggccgccgcgcgctacatcgcaccgtcgaacgtcgagcacggtgtgctcaaggttgtggacaggctggttgcctgacgatttcgttgcatggggcgcggtgacgtaaagaaggtggcgtaatgaggcaatccgaggcgcttgcgattctgggttccggcgcaagcgtgttcctgacgggcgcgcccggtgccggcaaaacctacgtgctcaacgaattcatacggcaggcgcgtgccgacggcgcatccgtggccgtcaccgcatccacgggcatcgctgccacgcatatcaacggcaccaccatccattcctggagcggcatcggcttggccacggcattgaccgacaatctggtcaaaaccgttcgcacacgccgcaaacgcaagctgcaggaagccgacatcctcatcatcgacgaggtctccatgctgcacgcgtggctgttcgacatggttgaccggatctgccgcatcatccgccgcgacgaacgtccgttcggcgggctgcaggtggtgttgtccggcgattttttccagctgccgccggtttcggtatcgggacgcaacaacgacctgatcgcgccgtccgccgaatatctggccagtcgcgaacggtacatgcgcgccggactcaatcccgaaggtttcgtcaccgaatcgttggtatggcgcgaattgaaccccgttgtctgctatctgaccgaacagcatcgtcaggatgacggccagctgttgaacgtgctgaccgacattcgcgaaggcgcggtggacgatggcgaccgcaatgtgctgctgacccggttgggggccattccggaacccgggcagcaggcggtgaacctgttccccgtcaacaggcaggccgacgcgcttaatgacctgcgcctgttcgaaatcaaggaggaaccgcacgaatacctcgccgaatccgagggcgcggcgaatctggtggaacggctcaaaaagaacatgctcgctcccgaacgcttgtacctcaaaacgggcgcggccgtgatggcggtgcgcaacgacaccgaccaccagtatgtcaacgggtcgctcggcaccgtgcgtggattcaccacgcaatcgcagggcggctggccgatcgtcgaattcgaaaacggcaacatcgtcaccatgaagccgaattcctggcagatgcaggacggcgataccgtgctcgccacggtcaaacaggtgccgttgcgctgcgcgtgggccatcaccatccacaaatcgcaaggcatgacgctcgatcgtgccgtcatggatttgcgacgcacattcgcgccgggcatgggatacgtggcgctgtcgcgagtggaagggctcgacggcctgtatctgcaaggcgtcaacgagcgcatgttcctggtctcaccggacgcggtccgtcttgatggacaattgcgattggagtcggctcaggccgccgatacgcttgcctccgacggtgtcggagcattccgcgcccgcatgccgcaaccggccggtgaggatgacgaattcgcgcaggacgtgctgttctgacccgctgctaaatatcagcccatcgcctgcagggaacgcgcaagatccgggtcgagctcaacttcgtcctcgacgctttccggatcggggtcccaacagctggcgatcacgcaggccagtccgacgagcaaccaaagcgggttgtgctgcaggaactcaagacctggaatcgcccgcgtgacgatgatccatatcaccatgccggccagcgcaatcgcattgaacggcttcttccatggcagggaaatcaacgtgacgcacaatacggccaggcacaggacgatccattggttgccttcggtcagcacttccggcgctgccgccgcgaagacgaaatagcagatgatgccgatccagccgagtttgttccaaatcgaaatgtgcgcggtgacgtgacgcatgctgcgtcctttccttatgaagcgatatggtgctgattccagtatcatagaaacggctttagacttatttataactctataaataacgtttttcgcgtattggtgtgcgattcgaggacgtgtggcgcatccaagtcggcttacctgagtaatttggaacgtatgaccaaagcacttcgtatgtctaccatgttcctgcgcaccctgcgcgaggaccccgccgatgccgacgtcgtgtcggacaagctgctgcagcgcgcctgctacctgcgcaaggccgctccgggcatctggacctggctgccgctgggcctcaatgtcctgaacaagatcgagaacatcatccgcgaggagatggcgtccatcgacgcccaggaagtccacttctccggactgctgccgcgcgagccgtatgaggccacccaccgctgggaggaatacggcgacaacatcttccgtctgaaggaccgccacgaggccgactacctgctggccccgacccatgaggaaatgttcaccctgctggtcaaggacctgtactcctcctacaaggacctgccggtgaccctctaccagatccagaccaagtaccgcgacgagttccgtccacgcgccggcctgatccgcggccgcgagttcatcatgaaggacgcctactccttcaccctcgacaaggaaggcctcgtcaaggcatacatggacgagcgcggcgcatacgagcgcatcttcaaccgtcttgacctgaagtacgtgccggtgcacgccatggccggcccgatgggcggcttcgaatccgaggagttcctggctccgatggagatcggcgaggacaccttcgcccagtcgccgtccggcaaggcctggaacgtcgaggcgctgaccactccggaaccggaagccatcgactttaccgcaacgccggcagccgaaaagcgcccgaccccggacgcggccaccatcgacaagatggtcgaattcgccaacgccaaccatcctcgttccgacggccgcgattggcaggcctccgacattctgaagaacgtcgtcatcgccgtcatgcatccgcaggacgaagaccacgacgagccgtggcgcgagctcgtggtcgtaggcgttccgggcgaccgtaccgtcgacatgaagcgtcttgaggcgcagttcaccccggccgagatcgaggaagccaccgacgaggatctgaagaagcatccggaactcgtcaagggctacatcggaccgatggcgcttggcccgcaggcacgcgacggaaagaaggccgagaacgcgtccgagaccggtgacgcgctgcgctacctgatcgacgcgcacgtggcacgcggttccgcatggttcaccggcgccgacgagcaggacgtggattactacgatttggtgtacggccgcgatttcgaggccgacggcaccgtcgaagccgtgcaggtacgtcatggcgacatgagcccggacggttccggcccgctgagcttcgagcgcggcgtggaaatcggccaggtgttccagctgggcctcaagtattccaacgcgctcggcctgaaggtgctcgaccagaacggcaagaccgttccggtgtggatgggctcctacggcatcggcgtctcccgtgtgatggcctgcatcgccgaaacccatcacgacgagaagggtctggcgtggccggcagtcatcgcgccggcacaggtgcacgtcgtggccaccggcaaggatgcggccgcgttcgaagccgcagaacagctgatcggtgagcttgaggccaagggcatcgaagtcatcttcgacgaccgcaagaaggtgtctccgggcgtcaagttcaaggacgccgaactcatcggcgtgccgatcatcgccgtcgccggccgcgacaccgtcaacaacggcaccatcgaagtgcgcgaccgcaacggtgagaacgccgaagcggtgccggtcgcggacgccgcgcaggcgatcgcggaccgcgtcgctgcactgctcaagtgacatacggcaatccgtagcgcgtcggtttgatccgacgaacgacatacggcagcggaagaccatcaagcaggtggtcttccgttttttgtttttcatggggaataccgtgcgcatctcacgcacatgaggattgtggatgtcggtggataagtcgaaattatccaccgacaatccacgactcgcccgacgatctcaagttatccacattctccggttgggcttgcagacggatggaacgttcggcgatagtggtcttaccgcggaaacgtgaagatgcgggaagggcatgcagtttaccctctctcaccataaatccacctcactgcctgtcgcttccgtgccgtcaacggcgctttccgcggtccatcattcgtcaaacagaaaggaccgaacatggcgcagcagcagggtctcctcaccatcacgggatatgtgggcggccagcccacgcaattcaatcgggaaggcatgccgcatgccagctcattccggctggccagcaccagacattatttcgatggccgaacgcaacagtggaaggacctgcccaccacatggatcacggtgaaggcatatcgaggcctttccgaaagcatctgccaatcgttcaaaaaaggcgaaccggtcatcgtgaccggcgtgctggcggcggaaagctgggtggaccagaacggcaagcaacagtcgaaactcgtcatggaagcgaatgcggcggggcatgatttgagctacggtgtctccaccttccgcaaactcgccaagaaaaacgattccggccagcaagacgcgcagcctggacaggctttaggacgtgatccatatgtgcaagccgcccaacagcggggcgaaacttcagtcaatgcgatggacgggcagagttccggcgttgacgagcaaggcggctcgcaggccggtgcggatagcaacgccgccgaacccctacgtgaggaattcggcggcgatggcttctgacgattgcctgacgcttatgcgatcgctggcatggcctgttaccagatgcgcacgcgttgctccggtgcgagccacatgccgtcgccgggctgcacgccaaacgccttgtggaacaggtccacattacgggcgatgccgttcgtacggcattcggcgggggagtgcgggtcgatctgcagatactgctccgccaactcgtcgcgattcttagtgcgccaaatcgaagcgtagctcaggaagaaacgctgcaggccggtgaagccgtcgatttcaggagcatcggcaagcgcggcttcgatggcttccgtggaaccatccttgccgcggacggccgcttcatcgagagcgaacgcataggccttgagagcgatgttcacgccactcaaatcgccgatgttctcgccgatggtcaacgcgccgttcacatgaggggccttcgacgggtcatccgaatacttttcggcgagctgcgtcggcacgaactcgttgtactggtcgataagcttctgggtgagcgccttgaaattggccttgtcctcttcggtccaccagtcgttgagtttgccgtcgccgtcgtattgcgagccctggtcgtcgaaaccgtggccgatctcatggccgatcaccgcgccgatgccaccgtagttcgcggcatcctcggcatccgggttgaagaacggcggctgcaaaatggcggccgggaacacgatcacgttcatggacggctcatagtaggcgttcaccgtctgcggattcatcagccattcgtccttgtcgacggccttgcccaccttggccagctggtagccggtctcatacaggttcgcggcacgcatgttctgggcgaagccggcgtcctcgcgcacatccagcgcggaatagtcacgccaatggttcgtgtagccgatcttcggcacgaacttggacagcttctccaatgccttggccttggtctcgtcgccaagccaagtggaattggagatggacacacggtaggcgtcgatgagattgccgaccagctgctccatacgctgcttggaggtttcggggaagtgacgcttcacgtattcgcggccgacatcctcgccgcagatgccgttgaccagcgagacgccacgcttccaacgcacacgctgctccttctgcccggacagcgtcttgccgtagaagtcgaaattcgtttcgtcgaattcgtggggaagctccaatgtggagccgatcaccacatgcacgcgggcccacagcttgagatcatccagcgacgcttccttccagaacgcgttgagtccggtgaggaagcttggctcatgcacgatcgtgtggctgaaacagccgcggaaatccaacggctgcacggcagccgcggtggtcgcgtcgtaagcgttctgccaggcgtcgatccaagcgtccaggtcaacatcggcgagcatggcgcacaggtcggcgtaatccgtcgggttataggtcttcaccgaatcgcgcgtggacacgttgtcccaatggttcgccgcgatgcgcgtctccacgtcaaggaaacgcttggcctgcgcatgggcatcctcgtcatcggccgcaagatgcgcgttcttcagctgcttggcgaccatctcgacatacgcctcacggattggcgcgtaatggtcttccctgtagtaggcctcgtccggcagatccaaaccgtcctgttcgatgtgcacgacattggtctccggcgctcccggatctccgtaaacggcgatgccgatcaggtctggaccgccggtcgggttcatggcgccaagcgcgcgggtgagtgcggccttgtcttcggcctcgtcgatggaagccaactggtcttcgatggcggcgagtccggccgcgtcgatggcatcgacgtcaaggaaactatggtacaaagcgcgcgacttgacggctgggcaatcatcctcttcaaggatgtcgcggatctggttttccgcatcctcggcgagcttgtcgaaggaaccataccgggaacggtcgtcgggaagacggtacatgtcgacccacgggccgttgacgaagcggaacaagtcctgagacgggccggtcacggcggagaacgatgccggatcgatacccgaaaccaaagaattcgaagtgttgttcatggcttcacactatccatctttggtgacaacatcgtgtattcgaatcgaatattcgggtggaacgcaaggtggaatacagaaaggagaacatcgttcgccggtgtatggcccgcgaagtagggttgaaggcatgatcgaactgaaaacccctaaagagattgaagcgatgaagcccgcaggccgcttcgtcggcggcatcctacgcgacctgaaggaattcaccaaggtcggcaccaatctgttggaaatcgacgaattcgtccacaagcgcatcgtggaccgcaagggcgcctcgtcctgctacgtcgactatgcgcctgatttcggcaccggtccgttcgcgcactacatctgcacgtccgtgaacgacgccgtgctgcacggcgttccgtacgactacaacctgaaggacggcgatctggtcagcctcgatctggcgatcaacgtcgacggatgggtcgcggattccgccatcagcttctgcgtcggcacgcagcatcccgacgacctgcgcctgatcaagtgcaccgaagaggctttggcggccggcatcgaagccgctcagccgggcaatcgtctgggcgacgtctcctgcgccgtcggcgacgtggcacgcgaatacggctatccgatcaacctggagttcggcggacacggcgtcggccatatcatgcacggcgatccgcacgtgccgaacgacggcaaggcgcatcacggctacaagctgcgtccgggcctggtcatcgccatcgaaccgtggttcctcaagaccaccgacgagatctaccaggatccgaaggacggctggacgctgaagagcgaggacggctcccgtggcgcacacagcgagcacaccatcgccatcaccgaaaacggtccggtgatcctcaccgtccgcgactagtccaaaaccttatgaaaacgggcttgtgcgattacgcacagcccgttttttcatgcccgttttgagacggaacccacatatcgaaacgcgcatgccatatagtgggcggtactttttgaactggtaaggagcgaacgagtatggccacagccaatctgagtgtggaatccaaggacttcaccctgccggtggtcgaagccacggcgggcgcggacggcatcgtggtgtccacgctgcgcaatgatggctgggtcacactcgaccccggtttcctcaccaccgcgcaatgcgaatcgaaaatcacgtacatcgacggcaagaactcgattctgcgctatcgtggctatccgatcgagcagctgtgcgagcagtccgacttccttgaagtcgcttggctgctgcgtcacggcgaactgccgaacaaggaccagtacgaccgtttcatctccgacatcaaccaccgcacgatggtgggggaggacttccgtacgttcatgggctccttcccgcgcaccgcgcatccgatgagtgtgatggcatccgcggtcaacgcgctcgccacgttctacccggacaccacggacatcaatgattccgaccagctggacgaagcggcgaccatcatcatggccaaggcgcgcaccatcgtcagctacatcttccgccgccgtcgcgatgagccgatgctgtacccggactactcgcgcggctatgttgacgatttcctgcgcatgtgcttcgccgtgccgtatgagccgttcgaatccgatcctctgtacgtgcacgcgcttggccgtctgctcatcatccatgccgaccacgagcagaactgctccacgtccgtggtgcgcatcgccggttcggcgcacgccaacctgtattccgcggtcgcggccggcatcaacgcgctgtccggcccgctgcacggcggcgccaacgaggcggtgctccgccagctcaaggccatccgagactccggcaaaaccgtcaaggaattcgtggaggacgcgaaggccaacgggcatcgcatctccggcctcggccaccgcgtgtacaagtcgtacgatccgcgcgcggcgatcgccaagacctatctgcagaagatcatggaacgcgccgacacgctgaagctgccggcggacgagcgcgcgctgttcgacgtggccaccgaactggagcagatcgcattgagcgacgattacttcgtgtctcgtcatctgtatccgaacgtcgacttctacacgggactgatctaccgtgcgatcggcttcgatccgtccatgttcaccacgctgttcgcgttgggccgcatccccggctggatcgcgcaataccgtgagatgctcgccgatccgaacacgaagatcggccgtccgcgccaggtgtacaccggctacacggaacgcgattacgtgccgatggaccagcgccactgaacgatattgacacgcggctccggtttcggacgtgcgcatgcgcctgccatggcttgccgctacagtgtttcaaggaacgaaagaacctaacgaatcgctggaaccggtctacggctccggcatggtcaaaggagcgtacacatgactgaacagcgcaccgcatggggttggggtctggcaagcatcgatgcggccggcaacacccttgacgtgtggtatccggaactcacgttgggcgaggctccggctgaaacctcgcgtccgaatcacaacttcggcgccatcgcgcatgacgaggccgacgcgcgtggcgtgcgccgcatgcccgtgttcaccgtgtccaagctggacgagccgatcgaggacgccgccgacgcctatctgcgtctgcacctgctgagcatgcgtctggccaagccgaacacgttgaatctcgacggcatcttcgccaagctcaacaacgtggtgtggaccaactacggtccgttcgccgtcgacgatttcgctttgcgcaagcttgacgtgatggccgccacccgacagtccggagccgtgttggcgccgcacgtcgatgtgaacgtgctgtcgattgacaagttcccccgcatggtcgactacgtcgtgccgaccggcgtgcgcatcggcgacgccgaccgcgtgcgactgggcgcgcacctgtccgaaggcaccaccgtcatgcacgccggcttcgtgaacttcaatgcgggcaccctcggcgtctccatggtcgaaggccgcgtctcgcaaggcgtcgtggtcggcaacggctccgacatcggcggcggcgcgtccatcatgggcaccctgtccggcggcggcaagctcaagaactccatcggcgagcattccctgctcggcgcgaacgccggcatcggcatctccctgggagacaactgcgtggtcgaagcgggcctgtacgtcaccgccggcaccaaggtcaccatctacgacaaggccaaggtcgccgccggcgaaccgctcgaaaccgtcaagggcgccgaactgtccggcaaggacaacatcctgttcatccgcaactccgtgtccggccgcatcgaggcgcgctaccgcaagaccggcatcgagctcaacgagaaactccacaagaactgaaaacggaatggcggagagcgtcatccgcgctctccgcaagaggaaactcgtgaaaatcacactgatcaccgtcggcaaggtcaaagagaagtatctgcgcgacgccatcgcggaatattcgaaacgactgggccggtattgcaagctcgacatcgtcgaagtggccgacgagaagacaccggagcacgccagcgacggactcgaacggcagatcaaggccaaagagggcgaacgcatcgccaaacatattcgtgacgatgcgttcgtcatcgccctcgccatcgaaggcaagcagctcaccagcgaacagctcgccgcgaaaatcaacgacctcggactccacggcaccagccatatccaactcatcatcggcggctcattgggactcgaccccgcgatcctcaaacgagccgactacctgctgagcttttccaaaatgacgttcccgcaccagctgatgcgggtgattctgctggagcagatctatcgcgcatacaaaatcaacgccggagaaccttaccacaagtgattttcgaggcgtttcgcaagaaacgctaagtaggggcgagccggtatagtggcgcgtatgagtgactacagggacgaacgcgagcagcgagaacgccgtcgccgcaccatggtgcgcacggtgtgcatcgtcatcgccgcggcgatgctgctgagtctggtcattcctgcgatctacgcggggctttgacgccttcgggcccgtatgatccgaaacgggccccggtttcccgtatgcgtgcggacaggttcgcggtccgtccatgtgggaaatggatgtgggcacgtggaaaaaccttatggattgtgcgggagccgtggacggctccatgtcagaatagtcaggaacgtaatagaaatgtatggtgtaaacgatggcagaatttgattactccgaggcgatcagcgaagcgcgcgccaaatacgagtccatttccaaggccctcgacgtcgatcgactgaccgccgaggccaaggaccttgaagtgaaagcggccgaacccggattgtgggacgatccggaaaacgcacagaaagtgaccagcaagctgtccgcggtgcagtcgcagctcaagcgtctggcatccgccgaccagcgcatcgaggacgtggagaccctggtcgagcttggccaggaggaagaggacgccgacacgttggccgaggcgaaggccgaagtcgaaagcatccagaaggatctcgacgatatggagatccagacgctgcttgacggcgaatacgacgaacgttccgccgtggtgacgatccgttccggcgccggcggcgtggatgcggccgatttcgcgcagatgctgctgcgcatgtacctgcgttgggcggaacgcaacggatacaaggccaaggtcatggacacctcctacgcggaagaagccggcatcaagtcggccacgttccaggtggacgccccgtacgcatacgggcgactgagcgtggagggtggcacccaccgtctggtgcgtatctccccgttcgacaaccagggccgccgtcagaccagcttcgccgccgtggaagtggtgccgctggtcgaagcgaccgatcacatcgacgtgccggattccgaaattcgcgtcgacacctactgctcgtccggtcctggcggacagggcgtgaacaccacgtattccgcggtgcgcatcacccacatcccgaccggcatcgtggtgaccatgcaggacgaacgctctcagattcagaaccgcgccgccgccatggccgtgctgcagtcccgactgctggtgctgcgccacgaggaggaagccaagaagaagaaggagctcgccggagacatcaaggccagctggggcgaccagatgcgctcgtatgtgctacatccgtaccagatggtcaaggacctgcgcacggggtatgagacctcgcagacccaggctgtcttcgacggcgacatcgacgagttcatcgaagccggcatccgctggcgtcacgaacagcgtcgcgcggcagccgaggaacaagaagcctaagcgataggcggagggaaaacacgatggcgctgatctcgcttgaacatgtgagcaaagtctatccaaagggcacgcgtcccgcattggatgacatcaatcttgacatcgatcgaggtgatttcgtctttcttgtgggcgcgtccggttccggcaagaccaccttgctgagcctgctgcttcgcgaggaggaagccacggatggcgagatccgcgtcgccggcaacgatctgcgacgcctgtccgcacggcaggtgccgcattatcgccggcagatcggctttatcttccaggattacaagctgctcaacaacaagacggtatgggagaacgtcgccttcgcacttgaagtgatcggcacaagccgttccaccatcaaatcgctggtgcccaaagtactgcagacggtggggctcacaggcaaggaaaacaactacccccatgagctgtccggcggcgaagcgcaacgcgtcgccatcgcaagggcgtatgtgaaccatcctcagatcctgctcgccgacgagcctacgggcaacctcgacccgaccacgtcgctgggcatcatggaagtgttggacgccatcaaccgtaccggcaccaccatcgtcatggccacgcacaacgaggaaatcgtcaactccatgcgcaaacgtgtggtcgaattgcacaccggcaagatcgtgcgcgacgagcagcagggatcctacgattccgcgctgtatttcccggacgccgaagtcgagtcgaaatcgcaccaggcattgggcacttccgatccgaacgcgaaataccgtcgacggaacgccatcgattcaacgaacgctcctgacgacaccgtcgacgtggaaggcgcgacgcgcgccgaaaccgtggtgaacgccgtggatgtggtcgccgctgccgtccatgacggacaggggaacgacggcatcgcccgtcttgccaaatccgtgcattccggacgcaccggccgttacggcgaggccttcgcgtcagtggagaccaccttgacctggggcaagggactgagcctcgaacagatggccgaccaggaacaggccgagcaaaccgaacggaacgaacaggccaagacctccgctgaaaatgatgcctccgagactggtgccgacgaagcatcggcgctgtccgctccgcctgcaccgcccgttccaccgacccaaaccgagcctccgacaccgcccgaaccgcccgtcccgccggcaccgtccgatgaaaaccctgaggacaccaaggagcacgactgatgcgttttcgtttcatcctttccgaaacatggaacagcctcaagcgcaatgtttcaatgattatctccgtcatgctggtcacattcatctccttcctgttcatcggcgtatccggcctgatgcaggcacagatcaccgccgcgaagggcgaatggtacgacaaggtcgaagtggtcgtatggctgtgcccggacggtgccagccaggcggcgtcctgctcgtcgggcaaggcgccttccaatcaggagatcgtcgatctggagaacgtgatcaacgaggaagccggcaacatcgtctccaaaatcacatatgtgagccgtgaggacttctacaagaacaccttcctcaagcagtatccgaacggcgaataccaaggacgcgtgctcaccgccgccgacatgcaggggtcgctgcgtctgaaactgaaggacccgaccaaataccaagtggtatccgaagtgttgagcggccgcaccggtgtcgaggaagtgcaggatcaacgcaagatcttcgacccggtcttctcggtgctgaaccgtgcgacggcggtcaccgtggcgctcgccggcgtgatgatcctggtggccatcatgctgaccggcacgacgattcgcatgagtgccgcctcgcgtaagaacgagaccgagatcatgcgactggtgggagcctcgaactggaccatccgcctgccgttcgtgttggaaggcgtgttcgcgtcgctgattggttcgctgctcgcctgcggaacgttgagcgccatggtgaagctgttcatcacggattggctgtcgaagagcgtgcagtggatgcctctgatcaaccagaagacggtatggctgcttgcaccggcccttgtggtgggagccgtcgtgctgtcgatcgtcgcgtccagcatctcgctgaggaagtacctgaaggcgtaaaccggcggagtgctgaacgagatgttcagcatatttgaagtttgctggatacaatgtcgaaataggtggatttcgggaagggaatacatgtctaggaaaatgacgagacaggtgcggcccatcgttggactgatgcttgcttcggctatgttctgcgccggcggcgtcgcggtcgtcgccgcgccggctccgcaggcgcatgccgtgagcatgtcggaataccaggcgaaggtgtcgaaccacgccaagctgaagtcgcagcttgtcggcgtgagcagcgatctcgccgacacgattctgcagttggccgatttgaacgacaaccagattcctgcggcggtcgaggccgcggaatctgcccagcaggcggcagaacaggcgcagagcctggcggaagcgaccacgcagcggttgcaagcggcccagcaggacaaggcgaaccttgaggagcagatcaaacagaccggctccgactatgatgacgccaaggccgccgtcgcgcagctcgcccgcgaaagcttccacggctccagtacgtcggatgtgctggattttgtcaccgattcgacgaccgccgacgatttcgtcaacaagatgcagtcgcaggccgcggtcacgcgaagcgaatccaacgcggcaaccgacgcggcgaacgagctgaacacgtcgatgaaccgcaaggaccgtctgggcgccatcgaacagaagatcacccagctcaaggagcaggccgaccagcaggcggcaagcgcccagcaggcggcaagcgaggccagcgccaagcagaccgccctgcagaagctgcgtgacgagggcacggcgaaacgtgagaagctcgaatcgcagaagagccagctgacaacgcagagcgccaaggaagcggcggacatcgtcgccatgaaatcgcagatcgattcatggaacaaccagtacaacaattccaacaacgccgctgtcaaccccaataacaaccagcagcagtcgcgtccgaacaacaacacgaactacaatcccgctcccgctcccgcgcctgcacctgcgccggctccgacgcccaataacaacaattccggcggcgccagcggcatgaactatgcggtgcccggcaattgcccggccggttccggatactgctacggacacaacaccggcaacacggtcggcggtgccgcgtatccgtcccgccagtgcacgctgtgggcatacctgaggcgttcccagctgagccttccggtcggctcctacatgggcaacggcgccgattgggccaataccgctcgtggactcggatacctggtgaacaacaccccgcatgtcggcgcggcgatggtgttcgcgcgcggccaaagcgtaggcggacattggaccgccgactggcagtacggccacgtggccgtcgtggaacgcgtgaacgccgacggttcggtcctgatctccgaaggcggcaccggcttcgcgacgttcccggcttgggagacgatctccaacgccggagcctaccagtacgtccactactgacggttccgttccagacatgaaaccacggcaagcgcgccgtccgcatcgtcgggcgacgcgctttcgtgatatggtcgacggagtcgcgttgcatacactgatcgaaagaaccgggaaggaggtccgacatggccaaggaacagggaaccaaaccgatcgcgcagaacaagaaggcgcgtcacgactacgccatcgaagacaagtatgaggccggtctcgtgttgaccggcaccgaagtgaagtcgcttcgtgaaggacgggcgtcgctggccgaatcgttcatcaccatcgaccgtcgtggggagatgtggcttgagggagccaacattcccgaatatctcaacggcacgtggaacaaccacgcacccaaacgcaagcgcaagctgctgctgcatgcggcgcagatcgacaagctggcccgccaaacccaggccaagggattcaccatcattccgctgagcctgtatttcaaagacggccgtgtcaaggtcgagatcgcgctcgcccgaggcaagaaggaattcgacaagcgccagtcgcttcgcgaggagcaggacaagcgtgaggcgctgcgagccatgcgatacgccaacaagcaggtgcgataaatcggaaaaattccggtttcacatagtgaaagaacgccgattcaggaaaatttttgtaacacaccctctttacgctaggatacggttcggctgaacaggccgatatgaatccataggagagggaacatgcaagcaggaaaagccctgaaaaccgccgccgcgttcatgttgagcgtggccatgctcgccaccggcgcggcatgcggcaccagcgacgacagcgacgcctcggcgtcgaaatccagttcgaagtccagcgaactgaccggttacgatgtttccggcgtgaagaaggacgacgcgatcgccaaaatgctgccggattatgtgaccaaggacggcaagctcaccatcggcatggatacgtcgtacgcgccggccgaattcctggccgcggacggcaagacgccggtcggcttcgacgtggacatcgccaaggcgctggccggagtgttcggtcttgaggccgatccggaaaccgcgaacttcgattcgattattccggccgtcggcgccaagtacgacatcggcatctcgtcgttcaccgtcaccaaggaacgcctcgaggcggtcgacttcgtcagccacttcaacgccggctccgcatgggccgtgaagaagggcaacccgaacaaggtcgacacgtccgatctgtgcggcaagaaggtggccgtgcagaccgccaccatgcaggagaccgccgccaacaagatggccaagcaatgcaaggccgacggcaaggcggagatggacgtcatctccagcaagttgcagaccgatgtgaccaccaacgtcgtcaccggcaaggccgacgtgttctacgcccccggacgtatcgccatgctcgaaagcgaactgcaggaactgatcggaagagcgcaatcgcagtgcattccggtgccgaccaacgtgcaggaagccatccacgtgctcgccgacgccggactgccggtatggccgaacacgccggtcgcgcccctgatgcaccaagcggcccgcgtctgcgtggacaaaggcatgttcgtgcccgcacgcaccctgtcggtggccgcgatgcgcatggattacgaagaccatgacggtgccgacgtggtgcaggtgcagttcctgcgctctctgaacaactaacaaaacggtcgaacatttgtgcgataatcggtgctggcgtggacatccgcgcggcatggcggaaatgatgggaaagcggtgacaatgacgaatcgtgatgattccgaacagttggcatgggatttcgacgcgccggagagcgacggtagttccgcggccgtcgtggccgatgaggggctggcttcgctgactccgggcagcgaacgttggattgccgcgttgcagccgaccgatgccgacgccatgcgcctcgacaaggttgatgtggcttcgatgagcgccgaagccgcggccaggctgtgggcgcgcgtggccgcatgggtggaatcagaccagatcgcatactatatcgacgatgcccccgtctcatccgacgcggcatatgacgcaagattgcgctgcctgcaatcgcttgaggcgcagttcccatcacttgactcaccgcagtcaccgacccatcgcgtgggcggcacgttctccaacgacttcgcttccgtacgtcatccatcgcgcatgatgagcctcgatgacgtgttctccatcgaggagctgcgcgaatggtacgacggcgtgctcaggggattggattggcccgaatcgaagccactgcccatgacctgcgaggtgaaaatcgacggtcttgcgctgaacctcatctaccgcaacggcgtgcttgaacagggtctgaccagaggcgatggcgtgaccggcgaggacatcactctcaacgtgcgcaccatctccaccattccgcagaaccttgccggaccggaggaagacattcccgaattcgtggagatccgcggcgaagtgttcatgcgatgggacgatttcaacaagctgaacgccgagaacgaggacgccggtcgtgcgccattcgccaatccccgcaacgcggccgcaggtagtctgagacagaaggatccgcgtatcaccgcaacccgtcgcctgagcttctacgcgcacggcatcggatcgctgcgttggggtgcggggcacgccggcaacggccatgatgtggtcaacgaccaatccgaagcctacgaattgtataagaaatggggtgtgcccgtctctccgcacaaccgtgaggtcacgtcgttcaaggaaatcctcgacatgatcgactattacggcgaacaccgaggcgacatcgaacacgcgcttgacggcatcgtcgtgaaggtcgacgatttgggattgcagcgttcccttggcgccacatcgcgtgcgccgcgctgggccatcgcctacaaatatccaccggaagaagtcaataccgagctgcttgacatcactgtgcaggtggggcgcaccggacgtgtgactccggtggcggtgttgaaacccgtgtacgtggccggttccacagtatcccgtaccacgctgcacaacccctttgaagtggaacgcaaaggcgtgctcatcggcgacaccgtggtggtgcgcaaggcgggagacgtgattcccgagctcgtcggtccggtgctggagcgacgcaagggacgcgagggcgagctccgccggttcgtgatgcccacgcgttgcccgagctgcggcgcggaactcgctcccgccaaagagggagacaaagatatacgctgcccgaacgtggaatcctgcccggcgcagctgaccgagcggatcatcaatctggcgtcccgcaaggcgttcgatatcgaacatctgggcgaccaatcagccattgcgctgacgaatcccgaagaggacaggcccgattccatcgacacgtatgcgccgaacatcaccgaaatcgtggtgaaacccggtgaggagcctgaaccgtacgagccggtggcgggactggaactgccgcccatgcagacacctgtgctgtccagcgaggccgggctgttctcgttgacgtccgcagacctcaaggatgtgcgcgtctggcgcgaggccccaatcatcgaaatccacgagaccgtcgggtcaaacggcaagatcaagaaagtgcgcaaacgcgtgggcggatccggattatggcatcaggtgcccgcattctggaccgcgcctaccgccgcccgcaaacgcaaggatgccgacatcgacgagaccgcggaatatccgcaatacgtggtgccggatgacgccgtggtgatccgcgaggaaatcaaggtatcccgtggaggcgcgtccagcgtgcagccggtgtacattcgtccggcggaaaacacccgcaagatgctcgacgaaatggacaaagcccgccatgccgacctgtggcgcgttctggtggccctgtccatccgcaggctcggaccgcccaccgcacgcaccatcgccagcgcgttcggtacgttggatgccatcgaacatgccagcgtggacgaattgtcccaaatcgacggtattggtccggaaattgcggaatccgtagtcacatggttcaccgcggcccgtgagccgggcaattggcgcggtgccgtgcttgacgcatggaaggccgccggcgtaggagtcggacaagcccaagccagcggactaccacagacattggcaggcaaaacggtcgtggtcaccggctcgttggaaggattctcccgcgattccgccaaagaggccatcgttctgcgcggaggcaaagccgcaggatccgtcagcaagaaaaccgattgggtcgtcgtaggcgagaatgccggctcaaaagccgcaaaagccgaggaactgggcatccccatgctcaacgaagaccaattcaaacagctgctcgacacaggaacagttgaataatcgccacaccatctggcaagccgtgccgcgaaccgctactgtggtacgcggcataaggaggaagcatgagcgacgagcgcaccatcgaagcgcgcatctacgaacggctaagcaaagtgattgaccccgaactgggcaggtccgtcaccgacttgggcatgatcgcagccattgacgccacgccagtggcaggcgaaaccaacacgtacgacgtacgggtgcgggtcgaactgaccgtggaaggctgtccgctgtcgcagaccatcaccaaccagatcaacggcgcggtcgcctcctatcccgatgccacgttgattcccagcatcgaagtcggctccatgagccaagacaaactcacccagctggtggccggcctcaaagcggaacgtaaacagaacccgttcaacaaacccggcatcaaaacccgcatcttcgccatcgcctccggcaaaggcggcgtgggcaaatcgtctgtcaccgccaatctggcagccacattcgcggcgctcggctacgataccgccgccatcgacgccgacatctacggtttctcgctgcccaggctattcggcgtgcaatcacagcccacgaacctcaacggcatgctcatgcccgtcaccgcatggggtgtgaaactgatctccatcggcatgttcgccggcgcggacagagccatcctatggcgtggtccaagactgcaacgctccttggaacaattcctatccgacgtatggtggggcgagccggacgtattgctgctcgacctggcgcccggcaccggcgacatggcgatttccgtggcacaggcactgccgaacgccgaactggtggtggtcaccacaccgcagccatccgcctccgacatcgcggtacgatccggcctggtggcattgcaggtgccgatgaaagttcgcggcgtcgtggagaacatgagctactacgagcacaaaggcgagaagctacgtatcttcggcgaaggtggcggcgcacgcgtatccgaacagctgacccacagcctcggctatgaagtgccactgctcgcacaactcccattggagcctgaactgcgcgaaaccggcgaagcaggccggcccgcagtcctaaccaaagagggcgcgttgcggtcggacggtatcggagaaacattcaagaatcttgccgaatcgctgatgagactgcctcaataaaatcaccatacggttggagcgttcctccaaaacaacacatcggaatgcgactcagccacggaatacggaatccgttatgagacaaaaccgacgtaaatcgtgggtcctgtgtaatatcaggcgcagacacgggggccgaatggctgagaggaagcaaccgcttcaaccgtatgaacgtataccgggtaatgccggcgcacggacgtctctctatttcccgtgccttgacgaaaagagaaaggcacatatcccatgactgaagaaaaccagtcttccgcagttcgcaaacacaacaacaagtggcgcgtggtcgatatcgtcgtcgcagccatcatcgccgtcgcatccggcgtgatcttctggggctgggacatcgtctgcaccgcgccgctggccctcttcgaggcggtgactccaggcttcgaaggcctgcttaacgctttctggctgttcgcaggccctctggccgccatcatcgtgcgcaagcctggagccgcactgttcgcggaaaccctcgcggccgcgctcgaactcaccatgggcaaccagtggggcgtcggcggctcgctgatcgtcggcatcgtgcagggcctcggcgccgaaatcggtcttgccatcttcgcctataagaagtgggacctgctgtccaccacgatctccggcgcacttgcaggcgtcggctgcggcctgtactactggcttaccaatccggcttggagcgcgctacgcgtcagcatctatctgatcgcctccgccatttccggcgcggtgctcgccggcgcggtgatgtacctcctgcaggtggccatcgccaagaccggcgtgctcgaccgcttcgaatccggtcgtacgcaggaactggtctgattgtccgatgcaagcaaatcccgcatcacatcaaggtggtgcgggattttcttgtgatggcgcatcgcatgacaacggcatacgaaacaacagcatgacaatcagaagaaagaacgacgaatgaccactgacgttcagaacacaacagcggccggcgtgaccgcacatgattggggatggagacacgcctcacgtaaggatttcgcgctacgacacgtcgacttcgacatcaaaccgggggagcgggtactgttgcttggcgcttccggcgcaggcaaatcaaccctgatgtccggtttggctggcgtgctcggtggagatgacgaaggcgagcaggaaggcgagctgctcatcgacggcgtcgacgccagacaagcgcgcggacgttgcgggctggtgcttcaggacccggactcgcagacgattctcgaacgtgccggagacgacaccgcattcggctgcgagaacctgaacctgccgaaagatgaaatctggaaccgggcacgagccgcccttgacatcgtcgggctcgactacatggcgttcgaccgctccacacgaggactttccggcgggcaacgtcagcgcctcgccttggcgggcgtgctggccatgcaccctggcctgctgctgcttgacgaaccgaccgccaaccttgacccggacggtgtcaaggaagtgcacgacgctgtccgccacgtcctcgaacaaacccatgagacgctggttgtggtggaacatcatatcgacgtgtggctcgacctggtcgaccgcgtcatcgtgctgggcaaacccgaagccgattcgaacgtcggcggcgtaatcgccgacggcactccagacgaagtgttcggccacatgggtcaggtgcttgccgacggcggtgcgtgggtgccgggccgcaccatcgaaagccacgcgcccaaaccggaacaaatccggcaaccgcaggatgtcgtgctttacacgcgggatctgagcttcggctatgatttcccgctcggcgagcatatcgacctcgaattccattccggtgaggtgaccgcgttgaccggcagaaacggcgtgggcaaatccacacttggactcactctcgcaggactgctcaaaccgatggcaggacgtgtatgcatggcggacgatctggtacctccccatcgcgaaaacaatgtgatcacatggaaaagccgcgacttgctgggacgtatcggcatggtgttccaagagccggaacaccagttcgccgcatccaccgtgcgagacgaggtggccatcggccccaaatccatgggcaaaaccgacgaggaggcgtattccatcgccgacaggctgttggaacgcctgaatctttcccgcttcgccaaagcgaatccattcaccctatcgggcggtgagaaaagaagactgtccgtggcgtccatgctggctgccgcgccaaaagtgctggtcatggacgagccgacattcggacaggatttcaccacgtggaccagcatggtccaattgatcgccggtgcgcgcgaccaaggttgcgcggtcatcatgattacgcacgatgagccgctcatcgaagcgctgggcgcacgccgtattttggtcagagagggggagtgacatgctcgaaaccaacaaaaacagtgggcgcgacggcaatgaaaagctcgaaaccattaccgtggtgccacacaaggaacgtcgtaacgaaacgaagccggcgtcaccgtcatggttcgtggcgaaaatcaacccggtaagccgtttcatcggtgcgttgatcctgtgcattccgatgttcttcaccctcgatgtcgtttcggcatccgtggcgtttggtttggaaatgctattgttatggatcggcggagtggctccctggacggtcttgcgcaagacatggccggtatggatagcggccacaggcagcttcgtttccgtggcgttgtacggcaagacatccggcacggtgctggccaatctgggcggcatcatcgtcatctcccaaggatcgctctatctggcgttggccacattcctacgtgtcgccgcaatcgccgtgccgggtgtgattctggctttgggactcgacccgaccgatctggccgacggactcgtgcagattctgcgcctgccgcaacgtttcgtatacggcggccttgccggcatgcgcatgttcacgctgctgcaggacgattggcgtgcactcggccagtcacgccgctcgcgtggcctcggcgacggcagcaccatcaaacgcgtcttctcgcaagcattcagcctgctcgtcgtatccatccgacgtggaacgaagctcgccaccgccatggaagcgcgcggattcggatccgacgcgccacgaagccaagcgcgcgaatcgaaactgcatgcggtcgactggctgttctacgccatctgcatcgcggtgccggcaatcgcgttggccaccgcatactacaccggctactggcattgggcgttcagtaacgtgtccaactaatggatgatgattccccaatcggcagctaaatgataaagctctctgtcatacgttccaatcggaatcgtatgacagagagctttattctatttcggcaagccttacacggcttcttacttggcgagcttatccagcagcaacgcttcggtgatgacgttgttcttcaacgccggcaggctgatggactcgttcgggctatgcgcgttggccttcggatcctccggaccggtgaccagcacctgcgccttcgggaagatgcgctgcaattccggaatgaacgggatggaaccaccctcgcccttgttgaccggagccacaccgaacgcttcctccatggcgtccatggcgtccttggtggcctcagcgttcggatccatggcccagcccatgccgttgtcgagcttgtcgacccacacttcggcaccgaacggcgcatgctccaccatgaacttggccaacgcctcctgggcctcttccgggcgctggttcggcgcggtgcgcaagctcagacggaacgtggtttcaggagagatgacgttgaaggatccttccaccggatgcgcgtcgaacccgatgacggtgacgctgggcttcgtccacagacgcgcggcgagcgaaccggtgccggcaagacgatacgattcgacgatgcccgcgtcggcgcgcacagtcgcctcgtccatatcacgctgcaggccgccaaccggttcctcggacgcaacgcccggcacggccaaatcgccattggcgtcgtacatggaggaaatcaacatcgcagccagcgtgttcgcgtcaagaatcgggccgccatactggccggaatgcaccggatgttccaacgccttgacatgcacatcaatatcggtgttgccacgcagcgacgtggtcagcgacggaatctcagcggaccagttgcccgaatcggccacaatgatcgcatcggaagcgaactcgtcccggtgctcttcgatgaacggaatgaagctcggagaacccatctcctcctcaccttcgatgaacaccttgatgttcaccttcaaatcatcgcccaacgccttcagcgcgccggaatggatggcgattccgccaccatcatccgcggctccgcgaccatacagacgcgtgccgatttcagtgccgacgaacgggtcggtgttccacacgttcggatccggaaccggctgcacatcgtgatgcgcatacagcagcaccgtcggcgcgtcctcgctgacattcttggaaccgatgacctcccaagcgcccggcgtgccgtcgggattgtgcgactgcactaccttcgtatcgacaccaacctcgcgcagcagatcagccacgaattgcgcggaacgcttcatatggtccgcggtgatgcccttcgcggaaatcgactgcaaggcgatcttctggttcaacacgtcgacgatgcggctgaaatcagattcgacgcgcgtgcgaatctcttcggctcctaaagctgtcataatccttgatgctccctatatatgcgcgtgtattacgcggattgaatatcgtgtgacgaatgtccattgtatccgttctttgcagaccgtccgaccgcagcttgaatcgcagcttgaaccgcaacgcagacggcaccgcgggcggcatcgagcgtcgatacgtcaccttacgctctatagacatgagtttgtttaccaagaaggaagagccggcgcaggagaacgtcgagagcaaggctgcacagccgacctccggcaagggccgtccgaccccgaagcgcaaggacgcccaggcgcagaatctccgtccgctggtccccaaggatcgcgacgccagccgtaaggcggccaaggcccgcatccgcgaacgtgagaacgccgaatacgatgccatgcagagaggcgacatcaaccacatgccgaagtcggaacgtctgccgtggcgcatctacatccgtgactacgtcgatgcccgcttcaatctgggcgagttcttcatcccggtcgcgttcataatcctgatcggatccatggtcgtcacctacaagtggcctgcattggcgttgccgctcatgctgatcatgtatgtctacttgttcgccgtgattatcgacgtggcggtcatgtggcacaagctcaagaagaagctcatcgaaaaattcggtgagcagtccgtggccaagggcatgcgttccggttcctatgcgtggagccgtgccatccaaattcgccgttggaggcttccgaagcctcgttacccgaagcgtggacactggccggagtgatcggtatcgagaaccgccggtgatttttcaagccgtcagcgaacaactgacggtttttccattaccatggaaaacgattgctcgcatcgaacaaaagctcacttcacgtgcgtgcaaacgaatcaatgaggaacgaattgggattcaatatggttcaacagcatttcgacatcgctatcatcggagccggccccggcggttactctacggcactgcgtgctgcggagctcggcaaatcggtggcgttgatcgaacgtgacggtacgctcggtggcacatgcctcaaccgcggatgcatcccatcgaaggcattgttgaccgccgtgcatagcgtcgaaaccatccataacgccgaacgcatgggcatcaacgccacgctgcagagcatcgatttcggcagattacgtgatttccgcgtctccaccgtggaaacgatgacgaaagggctgacgggcctgctggcgcatcgcggcgtcaccgtattccgcggttgcgcggcattgcagaacgcgcatacagtacgtgtcacgccggctgagggggagacgcaggtatcgcggtccgtggaagccggcgtgttcgaaccggttgaaacggaacttgcgatcgatgccgacgacgtcgtgctggcaaccggatcgcgtccgcttgcgttgcctggaaatccgttcgccggcgcgctgatcgattccacccaggcgttggagctgaataccttgccctccagcgcggtgattatcggtgcgggtgcggtggcattggaattcgcgtcgctgtggaatgccgccggttgcgaagtgacactgctgattcgtaaggaccgcgtgctgtccacatgggaacgccgtgcttcgatgacgctgacacgtgagctgaaacgcaggggagtgaacgtgatcgcacgcaccgcggtggaccgtgtcgacactggcgcgaacctaggggccactgtgcactatcggcagggcgattccgatgaggatcgcaccgcttacggcgaagtggtgcttgccgccatcggacgtgtgcccaataccgacgccgactggttccgctccagcggcctgaagctcgacgaacgaggatacgtgaccgtcgacggatacggacggacgaaccttgatggcgtgtgggcgctgggagacatcactccaggtcatgcgctggcccaccgcgcttttgaacaaggcatcaccatcgctgagaaaatcgccggagccgatccaaaacccgtgcttgacgacaccgtgccacaggtggtgttctctttccccgaagcagcaagcgtcggattgacgctcgaccaggcaaaagcgcgcgaagacgtggtcgagccgaaggagacggcatacccgatgctgtccaacgcgcgtatgctgatgagcggtgaaggcggatcgatgaccgtcgtcagcggtgcgtttgcgaacaatcctgatatgcaggtggtgttgggcgtgcacatcgtcagcccaatcgccagtgatttgatagcggaagccgaacagttggtcggcaaccgtgtcccgcttgccgatgcggcacggctcatccacccgcatcccacgttcagcgagacgctcggtgaggcgttgctgaaagcggacggacgcccgctgcatacgagataggcggagtagaatagcgcagtcgcaccataaatggcatggttcctgatagactatcgtcccagtgtgtgtaaccgaaccgtcaagcgaggaagtcgatggcagataaagcagagaaaaagaagcagaagaagcaaggcaccatcagccagatcatccagatcttcaaatacacccaagctgaggataaggcgcttccgtggctgtgcggtggcgtgttcgtggcaccgattatcgtgttcgtcgtactgggcgtcatattcaagtggcatgtgttcagctggatcctgttcatgattcttgccgtcatgctgggcgtgctgttcgccaccatgatgctcaccaagcgtgccgacaaggtcggctacgccaagatcgaaggtcgtcccggtgccgcagtaagcgtgctcggcaacatcagcaaggccggcttcaacttcccccaggaaccggtgtggattgacccgaagaccaaggacgccatctggcgcggtaccggttacaacggcatctatctgctgggcgaaggcgattacaatcgcgtcaagcgagccatggatcgtcaggagcagcgcatcaagggcgtgaccgccggctccgaaatcccggtctaccgtatgtacgtcggcaccggcgcaaaccagacccgtctcaaggacgtgcgcaagacgctgctcaagttcaagagctaccagccgacccatcacaagaacaagctgatggccgccatccatccgaggactcgtttcgtgctcaccaagaccgagctcacggtgctcaacgagcgtctgcgtaccctgcagctgaagaacggcatgagcgtgccgaagggcgtcgacccgatgcatccgcagcgcgtgagccgtcgcgccatgcgcggccgctgacggtggaatcgcattattccgttgaaaaagctccaatcgcgtcgtgcgattggagcttttcctatattcgaagccatacgtgtccattaattgacacgccgctgaagggcgtgacgcgaccgttcgtaacacttgaatccccatttttcgcgaaatcgcacttcgaatatgtcattacgaaacattctcgtaacccaaatggcgagtgagcgaaactcgcgaccatagactaatagcctgtaagtaacttattcgaaaggagcggtcccgtgactgcacttgaaaccaaggctgatgctgaggcccttatcaacaaggaaggcattgagtatgtctccgttcgcttcaccgatctgatcggtgttcagcagcacttcaccgtgccggcaagcgaattcctgaaggacgccttcaccgacggcatgccgttcgatggctcctccgtggaaggcttccaggccatcaacgagtccgatatgaagctggtgccggacgtttccaccgcattcatcgatccgttccgcaagcacaagaccctcgacgtggcattctccatcgtcgacccgctgaccgacgagccgtactcccgcgacccgcgtcaggttgccggcaaggccgaggcttacctgaagtccaccggcatcgccgataccgcttccttcgctccggaagccgagttcttcatcttcgacaaggtgcgtttcgagaacagcatgcagcgctccttctacgaggtggactccatcgaggctccgtggaactccggtatcgacaccgaagatgacggcaccccgaacatcgccttcaagaaccgcgtcaagaagggctacttcccggttccgccgattgaccacacccaggacctgcgcgacgacatggtcgccaacctgcagaaggtcggcctgattctcgagcgttcccaccacgaggtggcaggcgctggccagcaggagatcaactaccgcttcaactccctgcagcatgcaggcgatgacctgatgaagtacaagtacgtcgtccacgagaccgctgccctcgctggcaaggccgctaccttcatgccgaagccgattgcaggcgacaacggtaccggcatgcactgccatcagtccctgtggaaggacggcaagccgctgttctacgatgagaagaactacggcggtctgtccgatctcgcccgctggtacatcggcggtctgatcaagcactcttcctctgtgctcgccttcaccaacccgtctctgaactcctaccaccgtctggttccgggcttcgaggctccggtcaacctggtgtactccgctcgtaaccgctccgccgccatccgtattccgctggccggcacctccccggctgcgaagcgtatcgagttccgcgctccggatccgtcctgcaacccgttcctcgccttctccgcacagctgatggcaggcctggacggcatcctgaaccacatcgaacctccggcaccggtcgacaaggacctgtacgaactgccgccggaagagcacgctggcatcaagcaggttccgagctccctggctgaggccatggacgcacttgaggaagatcacgacttcctcaccgcaggcgacgtcttcaccgacgacctgattgacacctggatcagcatcaagcgtggcgagattgaccaggctcgtctggccccgaccccgctggagtacgagctgtacttccacatctgacgggcataacccctgagccctactggcgactgggtttttaccctgtcagtatagctcaggtctagttatggtctagttgtattccgaaaacacgacccccgcacgactcgcaagagccatgcgggggtcgtgtcttttccgtttaccgcggccgttcggacaggccggcgatccagtcgtccaggtcgcgccgccggatacgctcggtcgacgaatgcaccgggcgatgaggttgtcgtgcttgatggccgtacgcactgctttcccgggtgatccggcgttgtcattttcttccttacggatgacgctttttcgcgcatggtcagggacatgacccctgacaaagtagcgtcgttctttcttcggcaacggtcacattgtgtctgctgatcccgcaatgcgtcgtttacgctcctatactcggccgtatgttgttccaagccggatctttgctactcgtcatcatcagcgtctacctgctcaaacgcatccatatcttctccgacaaatcctataaagtggttcagggactggtattcaacctcactctgccatgcgccatcatcatgagcttcgccacgaacaagcatccgatgaacctgctgtggcttgtcgtattcggcttatttgcctgcctgattccgttgttcgtcgtgtatttcggatcgcgcggcgacgaaccacgctaccgtgcttatcagatgctcaacgcgtcgggactgaacatcggcgcgttttgcctgccggtggtgcagaccttcatggggccaagcgccggcctgccggtcatcatgcttgatatcggcaacgccatcatcgccaccgctgcatccctgaccatcacccgttcgttgctgcacttggggagccccgccaagaatctgccgttgagccttaagatcaagaacatcgcgcacgatttctactcgtccatctcgtttgactgctacatgcttatgctggtattcatgtttgccgggtggagcgtcccacattggatcgtcacgcttatcacgccgttcgccaatgccaacgcgttcgctgcaatggccatgatcggcctgatgatggagattcccgacaatcacaaggaccgttcggaactgggcaaggtcatcgcatggcgtttcctgttcagcgtcctcatcgcgctggctgcatggttcctgctgccgttggatgaacgtgtccgcgaaatcgtggtcttggccgcattcgccccggtgacgattttctctacgaaattcaccgactcgctgacgggcaatgccaagcttgccggcttctcattgaccgttaccgcggtcatcggattgacgattatgacgattctgcacgccgttctgccggtcgcctgacttagacttgcgggcgtgcatgccgtccgttaggcctgatgtgtggcgatgatgtgttcgatttcggtcagattcgacgcgaaatagatgccgtgctgacgttcggacgtggagaagcccacgttgatcatccgctgcagaaacgctttcatatcgtcgtagaatccgttgagattgtagaagatgcacggctgggacagttggtccaggcagatcttcgacaccacttcgctgacttcctccaacgttcccgtaccgccggggaaggcgatgaacacgtcgcccagctcgatcatgcgcgtgcggcgttctgtgatattcggcacgatggccagttcggtcaggcctttatgcgccacgccttggtcggcgaacatctgcgcctcgatgccggtcacctcaccgccgtgcgccagcaccgtatcggctatcacagccatcaggccctcatccgagccgccatacacgagacggttgccattgccggcgatccatgcgcccaattcctcgacggccttcctgtacgacgggtcgttgccctcatgggctcccagatatacggtgatgttcatttatcgcctttccaacgtgattgccttgttcgatccgttgactgtcgtgccgacgattcggtaatgcctggtttcggggatcttctcgccgccacggacaagataggtcactctttcggtgtccaggtcatcgatatgacgtatttgcgcgggactgccgtgcagcggcgcgtaaccgccgcgcgtgctcacctcgccgtccttcagaaaatggtagttgccgcatgagcggaaatagtatagggattcaatatagtcgaattcgctggatgccaccaccgcgttatccgcgtcgcaggccacggtgtgtgccgtccgcgcggtttgcggcgtggtctgctgttcgtagatgtagtttccttggaacgcgaagccgatggaaccgcctgcgagcaccgcgatcgacagcagccatgcgctccaacgacgcaggaagcgggtggctttgccgcaaaagtccccggcaccggtctcccgcgtgccaaggacgatgcgcgagcacagcaatcccaggaacatatagctgaacggggcgaatgggcacacgtagcggatggtgaagaatccataaggtgcggtaaaacggttcgcggactgccgcgaaaaccagcagcagcgacaatgggacgaacgcgaaaaacgccagatgccgtgccgcgcgtccgctgtcggcgcgatcttcggcggccgccactgacccggcagctgacggttccatgccggaccggaccgtggacccggccgtatcgcgcaaacgcgacgatcctgcgatcaacaccgccaacattgccagaagcgccacagtcatccccgaagtcaagcgtttggcatcgaagccggtcgtgagaatggaaaacaccgaagtgagttcactcagattcatggtctccttcaacgggggcaaagtcgaggaggcgaactggccgaccgcggaaggaatccatggaatgtacagcgccacggcgagcgcgtagggaatcagcatgcgtgggaaacgacgcgcatggccatgacggcgtaacgcgacgtacagccataacacgtgtgtcatccacacgaatgccatcatgtattgcgagtacatgcccaacgccaccactatggcgtaggcgatccaccatcgtcgatcggcaatcctgcgaagggccgtcgaacctcgtcccgaccgacgccgatccggacgcatcccatcctcgcgcatcgcgcgcagcagcagatacgtgcccagcacggacaggaacgggatcaacgaatacatgcgaatctcatacccgtaccgaagcatcagcggcgcgaacaccacaaacggcgaagccaacagggcatggcgctcgccggccatgaaacggagcagaaccatcgacatcagaacagtcaacccgcagaacacgcagctcatcgcacgcaatgccatgacatccgagccgaacaccgaaatccacatgcgcagcagcagataatagagcggcggatgcacgtcaaccttcagcagatccatcattcgggcgaatggctggctctccacaatgagcgtatacccctcgtcgaaccagatggaacggccgatgcccagcgcgaacgacccgcaggcggcggcgatcgcgcataccgccgtgacacaggcaaaacgatgcttcgaaacggattgtcctatcgacatggtgtggtttcccttttcattgtccaaacatatggtggaacgtcggtccttgagaatgccatggccatggtcggaatcggcgtatcccatcattcccatgccgcatggcgtatgcggcatgtcagcgcatcaccagaccgccgtcgacatgcagggtctgtcccgtgatgaacgcggcatcgtctcccgcgagcatggccacggcgccggcgatgtcctcggcggtggcgagccttccaagcggcgtggaggcgatgatgcgctcgcgcatgtcctcggtggtggcccgactcgaatcggtgcccacggtcagtccggccgcgatggcgttcacggtcacgccccaagcgcccgcctcctgcgccaaggaccgggtgaagcccaccaacgcgcctttggccgcggtgtaatcgtgataaggcacgatgggggagtcgacgaggttgctggatatgttgatgatgcgtccgccggcctgacgtcgcatctgcggcagcacggcctcgcaggtgttgtacgcgcctttgagacagccttcgagctgcgccgcgtaatcggaccatccgatcgagccgaaggttttgcggttgcgcggatcgaacgagtaatgcgcgaacgcgttgttgacgagaatgtcgagaccgccgaacgtggtgaccgtggtggacaccatgccgcgcacctgctcggcgtcggtgacatccgccttgcatgtgatcacgcgaccggccgcatcgcaatcgtccatgatccgttgcgcgcactgccgggcacgctcgtcgttgctgacataatcgatgaccacgcacgctcccgcacgcgtcagacggcgtgcgatcgccgctccgatgccacggcttgcgccagtgaccaccgccacacgtccggcaagcggcgcgttttcagactgctgcataatgaggatttcctttcgattcggaaaaacgtttcgtaagaattcgcgcgatcattcgacgtccatgtcgaagccgtcgcaatacgtgtcggtattgcgttcgatatcgacggcatgcaccagatcaagcagattgaagccgccgtcgtgatgccagccggatttcgcgcgattcatctcgcctaccgggcagatgcggtcgatgccggtctcgccgacgcgttgcgccacgtcgaacagccggtccggagcgagcgccacaccgcaggtctgcaaccattgcgcgtaagggcgcagcgtgggcagcgcgtcctcgacatggtccaccgccacgatgttgacggtgcggttcagtggtgtggacagcgagtcggccatgccgatggacggatagtacagcaccgtccagtcggtgcccgaacgcgactgcaccacgaacgggtcgtcggacggcgcatcatccgcgttgccggccgcggcggccatcgggccggcgcccagcatcagcgctttcatctgcgcggtggaacgcaaccgctgaatcgccatggactcctcttcggacggtgtggaacggggatatttgcgctgctgcccgtccaattcgctggcaagcagttcggcgacctgcgccggagacatcgcgccgccacgttccacgaacatggtttgcggcgccagacagctttgctggtcgtatgtggccacgtcgatcgccatacgatgcacggtgccggcatacagatcggcgcgaagcgcctcgcggccgatcagcgagaagccgattttcgcgccgtagctgaggaaaggctttccggcacgcacgcgcgggcgaatcgcctcggtggtgtgcgacgaaccgtacgcgaccaccgcatccgcctcgccaatcgcggcatcctccaaatccacggtgccgccacgccaaggcacaatcgccaaagcgtccgccatatcggggtcgacgcttgccagggaacgggcgaacagcaccggcatcagcggctcgtcgaacgacgatttgccgagaatcgcgcttttcgtcagcagacccatcgtcatgctccacactggaatgcccggcacattgctggaaaacacgtggaacgacaattccggaccgtacagccgcgtgtatccgcccgaacggttcgggcgatactcgtcaagcatctgcgggcaattcaactcgtcatccacgaaacgcagcagctcacgccgacggaacatgcgcatgtaccgcttcaattcgatacgcaccatggacgcgtcatagccggtgaccgcgggaatgagccgctccgcaagccgacgttccggatattccggatccgtccacaattctacggcgcgcgcgatcacgtcgacgatcccgtccgtggaataccgcgccagtttctcggcgcgatgccgccgcaccgacgccgccagcgcatgcacggcatcggcgtcgagacgggggaaacgcaacgtcgccgtgccgccatcggacgccgtgacgttgcgtgtgtcgaaatcatggaactcgaaatcccgcggcgcgtggaaaatgtcgacgtcgctcatgcgttggccgccatcacctcgtcgacggtgatcgaacagccacgcgcctcggcgcccttcgcacgaccgttcagcacatagccatgttcggtgcgcacacccagatcctccgtcagaatagccaggcacgaattccaattcgccagatcgtaatgcgcgatcacaccctgctcgccatcggcgaccggcgtaagcgaagccggatcgaggaacaccgaacgcacccacgacggcgtggctttgagataattcgacgaaccatccgtgtaataggacaggatgttctgatcgtagatctgcgaactcaactccgtcatgccatacatgttcacgcaatgcgagcgcttcacgccgaacactcgttcgaacgccgcatacaggtcgtcgaccgtcatgtcggtgcgcgtgcttttgaaaccgcccgtatcgaacacgcgggaatcggcggccagagcgtaggtcttgccctgcttgtccagataatccagcagatacaggtaggcggaggaggcgcccataagcatcaccggttcgccgtcggccgcggcctcgtcgaggaagcactcgacgcccgtgaaatcaaggccatcctcatggaagaagaagccgctgccttcggcgccgcactgctccacggcgcgggtcagatatcgggacagcgacgaatgctcgttcatgtcccatgcgggggagaggaccgcgatgcggatgcgctcgcggtcgggcatgatgaaatgcctgaacggcacgatcatcgactcgtcccacacctgcaggtcggggtggaagttgcgcccgcgttgaccgggatgcgtggtaccgctggtggtgaacaccgcttcgcaatcctgttcgggcacggaggtgagcgtcagcattttgaagccgtccaccggcatggggggaatctgcatccagttggcgagcgtctgcggcgtcacgcgtttggacatgcagtaggcgcggtatgggaggttgcgctcgaattgaaaggcgaagatatgcttcgccagcgtgtcaaacgcctcatcgggcgccttgccgcagccgtattgtgcgatgaagtcgagcacctcccgtttgatggtttccttcgtctcgtcgatgttcgtggattcctgcgattgccccatgctcatgccatgtcctttccgtcgtatggttgtcggattattcggatgctttcgattattccgcttgtttcgtccgctcgtctgcgtgtcgtgcgataaagttcggcaggtcgatgatgagggccttgagaatcacgacgctgaacgcgccgaccagaatcgaattcgagaagaacacgtgcgctcctccttcaagaccgctcaacgcgttcggcagggcgatgccaagcagcagggaaaggccgatcaccacttgggtgcggtcgtcgctttccaccttgcgcagcgtgttgaagccggtgctgatgaggcttgcggcggccggcaggaagatgccgccgatcacgggggatgggatgagcgacagcactgcgcccgccttcggaatgaaaccaagcaccacgaacaccacgccggcaatgatcaccggcacgcgggtgcgggtcttgccttcgtcggtgactttgagcagcgccacgttctgcggatacgcggtggtggtgaaaccgccgatcagcgaggagatcgccgaaccggcggcctctccggcaagaccgtaacgcacctggcggtcctggagcttcgtgccttggatctccgtggccgcctgatacacgccgagggcttccatgatggccaccagataggcgatgaagaacggtacgaaaatcgccgcgttgaaatcgaaaccgccatatggcatgaacttgggcaggccgagccacggcttggaggccaccgcggagaagtcggccatgccgaacgccagagacagcgcggtgcccacgaccagtgcgatcagatacgacagcgccttcaccatgcccttgccgaactgggaaagcaccaccaccagcacgcaggtgatgatggagacggccagcgtcttcggatcggcgaagcccttgtctcccggcgcgccgccaaggaactcgctcaatgtgaatcccgacagggagacgccgacgaggaagatgatcacgcccgatacgatcggggcgaacaggaaccgcagcttctcgatcacacgcgtcaggcacagcaccaggaaaatcagcgagctgatgaagatggacgtgccggccgcggcaagtgatccggcggtgccggcggcgatcatcagcgcgtcgaacgccgcggaaggaccctgaacgatgggcaggcgcaccagtttcgtggcctggataagcgtgaccaggccggagacgatgaaaatggcgttcaccatgttcgacgacaatgccaacggcagaccgatggcgcccgccacgaacaccggatcaagccacacgtttgatacgagcacatgctgcaatcccagcagggcgttcttcggcgtgaccttcttttcggctgacgaaccggcttccgccacgctcgtttcggttttctttctggttgcggcatcgccgtgcggctgcgtctgcgtcgatggcttttcgttggccatggtgtcccttctcgacttccattgggtatgtgtgcacaagccgaaatacaacggagatcgtctctacgggacgcgacgcgttttgccggtactgttcctacgcaagcattaccttgatcaggtcaagggtccgggcggtcgcccgtctcagccgtattcggcaccccctgtacttcgacgcgcccaatcataacgccaccgtccaaccgaaacaggaaaaaatacggcatgcgtgtccgttgcatggggacgcatgccgtatttcttttcgagaagctgccgacgcttatctgcgacgcctggtgggagccagctcgaacacctcgtcggacgtcttcgccacttccggactgtgcgtgacgatgatgacgcaacgatgcccatcatgcgccaacgttcggaaaatacccatgatgtcgtcctgggtggccaggtcgagattgccggtcggctcgtccgcgacgatgatggaaggaccatagcttaacgcgcgggcgatcgccacacgctgctgttcgccgccggacaggtgcagaatccgctcgttcgcgtattccttcggcaaatgcacctgttcgagcagttcctcgacgatcgtcctcttcgacttgtcgaacgttttgccggacacgtccatcgacaggatgatgttctccgccaccgtaaggttcggcagcaggttgaagctttggaagatcacgccgatgtcatggctgcgaaaacggtatcggtctcgttccgacaggtcggcgccatcgaccagcaccatcccttccgtgggattcgccagtcccgagatgagcgacagcagcgtggtcttgcccgctccggacggtccggtgatggcatgcactttttgccggcttggaaatcgtggctgatgttcttcagtacacgcttgccgcctttggcgtaggcgtagctgacattgtccaggcgcaatgtgggcggattggtccgctgcgattgtgcgccgttgacttcgacggtttcttttgcgattgccgtatcggcggtatccgcggaattcgttgtcatgggaggtcctttccaggaaaaacgtgcgattggattgtcaggaacggtcggcgagcgatttggagatgatggcatcgccatcactgctcgcgtcatagccgaacaccttgcccttcaccatcgtgaagctgccattggaggcgttggcgacggcctcgtcgctggagaagccgattagggagaaatcgccgttgaccatgcccgcgccgtctttgctgcccgcgacgtcgcccatttgtccgtcggggacgtcgggctgttcatcctgacggttgccgttatccgtaccggcggtatcagacgaatccttcatattggatgagccggacgagctggaggaatccgaaccggacgaatcggtgaccggctggaaatcgtcagtcgccgccaaccccgtggtctccatataatatgtggatttcaccgcggatggagccttcgcgtacttctgatagtcggcaagcgaaaactgcttgtcggccaaagcggaacgcatggcgtcgaagtcaggtttggcggaagcatcggacgaatcggaatccgacttggactgctcgcgcgattcggaaatgagtttgccgcgatcaaggctgatctgcgcggtgacggtggtgttatctaatccgctgcttcttgcggtggcggccgcctgccggatggataggccgattgtggcggcggcggcgatgatggtcacgatgacgatgatgagcatattgcgtcccttgttgcgggtgacgcttttccatgcgtttttgacgacgaacatggctgtttccttatgtgtttcgatagatatgagcgattgatggttccgcgccgctcgcgatcggcgtttatgctgatggtaaaagttgtatctggcatacaacagaaagacgctttgttcgcgctgggatgtggctggatgttttctggacgcttcgaaacatgacatggccgcgtcgccaaccgcttcgaaggtgttaggctaacgcgtatgcctatgaaatccgaagtcattgcaaacccaagggccgaacgcgtccgcagggtctccgaacttgccgacaggaaaggccgcaagcggtccggcaggttcatggtggaaggaccgcagtcggtacgtgaactgctctcctggcatcccgacatcgtcgaggatctgtatgtggaggtcgtctccgccgaaccggacgcggctttcatcacgcctaccgtggcgcagatggccggcaaggccatgcagaccggtgcttacgtgcataaggtgacgcatgccgtcatgcagcacatgagctccgacgcgcagggagtgcttgccgtcgccgacatgcgcgctttcctcgattccgccgtcattgatggcgattccgacgaacgcacgatggtcgccgcgttctggcaggtgcgcgatccgggcaacgccggcaccgtgattcgttccgcggatgcggccggttgcgcgggtgtggtgctggtggacgactgcgtggacatcttcaacccgaaggtgattcgttccactgccggctcgctgttccatctgccggtcgtctccatgggcacggacgagtatttcgattggtgtgcggaacgtggactcgccgtgtacgccgccgacgtgtatggtaccgacgcacggccgccggaaccgcttacggacgtgcttgccgtaccgcaatcacttgcgcaagccaagacggtgctgttcggcaacgaggcgcgcgggctgacccaggatgtgttggaacgcgtcgacagaatcgtgtcgattcccatctacggcaaggcggaatcgctcaatctcggcaccagcgcggcggtgatgctgctgagcttggctatgtcgagtcatgttgaaagaatgtgaagtcgtaaaaacgttggaattgcgcgttttatgcgtaaaacaaacggttgataagaaaggtatctcgtggcagagggtgcggtattcgacgcccaagcggtaaccgatgcggttgccgagggcatcgcgaaaatcgaaaacgcctccacaatggaggaattgaaagccatcaagacgcagtacgccggagcggaatccgcgatgacgcaggccagcaaggccatcggcgcgttgccgaaggaccagaagaaagacgccggtaagctcatgggcaagcttcgcgccgacttcggtcgtgcgttcgacaccaaggaaaagcaagtcaaggccgaagaagaggcccgcgagcttgctgccgaaaccgtggatatgaccttgccggtcaaccgcaagccgcttggcgcccgccatccgctgccgaagctgatggaggatgtcgaggacttctttatctccatgggctggcagatttccgacggtccggaagtggaaaccgaatggtatgacttcgacgcgctgaacttcggtccggaccatccggcccgccagatgcaggacaccttctacgtcaagggcaatcaggccaaggacgccgcgggcttcgtcggctccaacatggtgctgcgcacccagacttcgtccgatcaggtccgtggactcatcacccgtggcgtgccgctgtacatcgcctgcccgggccgtgtgttccgtaccgacgaacttgacgccacccacaccccggtgttccatcaggtggaggccctcgccgtggacaagcatctgaccatggccgatttgaagggcgtgctcgacaagcttgccgtggccatgttcggcccggaagccaaaacccgtctgcgtccgagctacttcccgttcaccgagccgagcgccgagctcgacctgtggttccccgataagaagggcggcgccggttggcttgaatggggcggctgcggcatggtcaacccgaacgtgctgaagtctgcgggcctcgatcctgaggtctacaccggcttcgccttcggcgtcggcgtggaacgtaccctgctgctgcgccacgacatcaacgacatgcacgacctggtggaaggcgacgtgcgattcagcgaacagtttgtgatgggggagtgattgacccatgccaatggttgacattgattggctcaaggaccatgtcgaggttccggaaggccttacgtatgaacagcttgccaaggatctggtgaaggtcggcctcgaagaggaagagatccacacctcccaggtcaccggcccgattgtcgtcggctatgtggtcgacgccactccggaaccgcagaagaacggcaagatcatcaactggtgccatgtggacgtcggcgacgaatacaacgagaccgatgaaaacggcaacaaggtgccacgcggcatcatctgcggagctccgaacatggcagccggcgagaaggttgtcgtgaccctgccgggcgccgtgctgccaggcgatttcaagatcgaaccgcgcaagacctacggccacatctccaacggcatgtgcgcctccgagcgcgagcttggtctgggtgataaccacgacggcatcatcctgctacgcaagtacggcttcaccccggaggaatacgaaaagctccagccgggcgatgacgccatgcatctgctgcacctggaccagccgctgctggaaatcaacatcaccccggatcgcggctacgcgttctcctaccgtggcgtggcccgcgaataccaccattccactggcgccgtctacactgatccggcaaccgccctcggcaagaaggcgcccgtcactcagggtctgccggaaggtgtcaagagcgacatcgaagtgatcgtcgacgacaagaatccgattcacggtgtggtcggctgcgatcgctactacgcgcgcgccgtgcgtggtttcgacccggcaagccacacgccgaactggatgcgccgccgcctaatccgcgcaggcatgcgctccatctctttggcggtggacgtcaccaattacgtgatgcttgatcttggccagccgatgcacgcctacgatctggacaagattgaaggaccgatcgtcgtgcgccgcgccaacgaaggtgagaagctcaccacattggacggcaaggatcatgacctgagcgtcgaagacctgctgatcaccgactcgccgaacggcgagcgtggctcccgtgtgcttggcatcgccggcgtgatgggcggcctgtatggcgaggtcactgctgaaactaagaacatcctgctggaatccgctcatttcgaccaagtatcgatcgcgcgttctgcacgtcgtcacaagattccgtccgaagcgtcccgtcgtttcgagcgtggcgtggatgatcagctgcagccggctgccgcccagatggccgccgagcttctggtcaagtatggcaacggcgagccgagcgagcacccgactgattacaacaccgtctgcaatcgtcgtccgattctgttcaaggcgtccgaagtggcccgcgtggcgggactggacactgacgtgaacaccatcagcgacattctcaccgatatcggctgcactgtggccggcggtggcaacggtgagttttccgtgactccgccgagctggcgtccggacctcaacgaaccgtgcgatctggtggaggaagtggcccgtctggtcggctacgatgagattccggtcaccgtgccgccggcaccggtcgaaggcaaggtcggactgaccgccgagcagctgcgcaagcgccaggtggccgacgaactcgccgaatacggcatggtggagaccctgagctatccgttcgtgggcgacgaagactacaagaacttcacacttgacgccgacgccaccaagaaggtcagcgtcgaaatcgccaacccactggccggcgatcgcccgttcctgcgtcgcgacatcatcccgaccctcgcgcagaccgtgcagcgtaacctgcgccgtggcgtggaaaacgtgtcgctgtacgaaatcggacacgtctacctgtgggatccgaacgctccggccattccggcattgccgggtgccgtcaagccaaccgacgagcagttggccgcgcttgacgcaggcctgccggaccagccgatgcacgtcgccggcattctgaccggcaacgccgtcgactccggctggatggacgatcgccgtgccgtggactggtccgacgcagttgaagccgtgcagcgtatttccgaccgcatcggcgcaaagctcacgttggaccagccgaaggctgaggacgtacccgcgcagtggcatccgggccgtgcggcacgtgtgatggcaggtgacacgttcgtcggcatggtcggcgagcttcacccgcatgtcaacgaggcgttgggcttcccggcccattccgccgcgttcgaactgaacctgaccgcgctgtttgccaccttgagcggcaagccggtgcaggccaagccgatttccaccttcccgccggtcaagcaggatctggccttcaccgtgtcgacggacgtcaccgccgccgaactcgagaagaccatcgtcgaagccgccggcaacagcttggaaagcatcgacctgttcgacgtgtacaccggcgaccagctgggtgagggattgaagtccctcgcatacgccgtcacgttccgcgctgaggacaagacgctgacctccgaggacagcgaagccattcgcaagcgcatcgtggatgcggccgcgaagctgggcgcgcaactgcgtgcctgacacgtcaagtccatcgaagtaaccaaaaagataaagaggacgacatgaacgaaccggagcagaaccagccgattaaccccgacgaagggcaggaggcggccggggctgctccggtttcgtcgtcttcgccgtcggaccagtcggcacagccggaattcggacagtacaaccagcctgaatatggcgcgatgtccaaccagtatccggcgaactacaatccatacatgtatggggctcccgaacagcccaagccggaggacgatgcacaacaaacggcgcagcggccgcagacgaatccgtatatgcagaacgggtatccggcgaatccatatgatgcatcgggacggcagcaatcaggccagcccaatggctatcagtatggaccaaatcaatacgggccaaaccagtatgggccgaatccataccaacagcccggcatatatcccatcaacccgaatgatcccagccagaaccccctgtacggccattgggatagctatgcgatcatctcgttcgtgttcgcactattcctgccggtaccggtcatccctgcggtgatgggcgccatcgccatgtggcgtaccaaaaaactgcatatgaaaggctacgcgcttggcgtggcagcgctgattatcaacgtgctgtacaccattgcggtgatttggatgacggttcacggcatttccacagccgatttgtataaccagatgatgcagtacatgttcggtggcagtggccaaagtggtgattccagctcgatttccgcctgaaaccaatctttttatgttcgtctgaacggtcccgttatgggcggtgaccactatccgacacgattgaactgcataattatgcaatgtagtgcataaagtgtatgctgaatgtgtttcaacgagtcaaggaaaagagacgtgacatggccaaatacacggtagccgtggccggcgcgactggatacgcgggtggtgaggcgttgcgcatactcgcggcacacccgaatttcgaagtgacctgcgtcgccggacattcttcggtgggggacaagcttggcaagcatatgccgcacattccgcagttggcggacctcgtggtcgaggacaccacgccggaagtgctcaacggccatgacgtgatcatcctggcattgcctcatggcgcttccggagcattggcctcccagcttgacccgaatgccgtggtggtggatttgggcgcagaccaccgtcttgaggaaaagagcgcgtgggacgcgttctacggcggtgacttctaccagcattggacctacggcatgccggaactcatcaccggcgtcgcggctgacggctcctacagccgtcagcgtgaagcgcttcccggcaccaagcgcattgcgggaccgggctgcaacgtcactgcgaccacgctggctttgcaaccgggcattgcgcagggtcttgtcgaatcgaaagacatcgtggctgatttggtggtcggttattccggcgccggcaagaacctcaagcgcaccaatctgcttgcggctgaggcgtttggttccgcactgccgtattcggtaggcggtacgcaccgccacattccggagatcctgcagaacttcgcgcacgcggccggcaagagtgctgcggaggcagacgattacaccctcgccttcacgccgattctcgcgccgatggcgcgcggcattctcgccaccgtttccgccaaactcaccgacaaagcgcttggcatgacggatgccgagatccgccaggtctggctggatgcatacgaaggccaggatttcatggtggtgctgcctgaaggcgtaatgccggccaccgccaacatcatcggttctaacgcggcccacattcaagtggtcgtcgaccatcatgccggccgcctgctggcattcgcggccatcgacaacctcaaccgaggcaccgccgggcaggccgtgcagtcgctgaatgtggcattgggacttcctgaggatgcaggattgacgaagattggagtggcaccgtgagcgtaacgttcgcacaaggtttttccgcagctggcgtggcagctggcatttccgcggtcgaaggcaagaaggatctggctctcgtggtcaacaatggaccgcttgacgccgctgccggcgtgttcacctcgaaccgtttctgcgcggcccctgtgcagtggtcgaggaacatcgtatccgacggccatgtgaaggccgtgattctgaactccggcggcgccaacgcatgcaccggcaagccaggatacgagcagtccaaggccaccgctgaaaaggtcgccagcctcatcggcgccaaagccgaagacgtggccgtatgttccactggtctcatcggcgaattgctgccgctcgacaacgtgctgtccggcgcggacaaggcatttgaaacccttgccgataccgccgaagccggagccgatgcgtcgcacgccatcatgaccaccgacaccaagccgaaaaccgtcgagctggaaggttccaacggcttccgtatcggtggcatggtcaagggttccggcatgatcgccccgcagctggccaccatgctgtgcgtcatcaccaccgatgccgtcgtgaccgccggacagcttcaagccgccttgaacgccggagtcgaaatgtcgttcaaccgcatcgacgtggacggctgcatgtccaccaacgacaccgtgttgctgctggcttccggcgcgtccggcatcgaaccggacccggacgagttcaacgagcttgtggccaaggccaccgcctcgctcgcccgccagatcatcggcgacggcgaaggcgcaagccatgacatccgtgtcaaagttaccggcgcgaccaccgaagaagccgctctggcatgcggtcgcgcggtcgcagcgtccaatctgctcaaatgcgccatctccggcaacgatccgaactggggccgcatcgtcagctccctcggcaccgtgccgcccgacgtcgcaccatacgattccgaaaaggtcacggtggacgtcaacggcgtacgcatctgcgaaaacggcggagccggacgcgaccgctccgaagtggacatgaccccacgcgaggtgcacatcgacatcgacctgaacgccggagaagcggaagcgaccgtctggaccgacgatctgacccacgaatacgtacacatcaacgctgactacgaaagctgatcgaataggaatggccaaagaactcaaaggacctggattccacttcgacgtgcacaccgacctgcgcgccgaccagaaggcggaagtgcttatcgaagcgctgccgtggctggaggaattcgccggacaacgcatcgtcatcaaatatggcggcaacgcgatgatcgacgatcatctgaaagcctgcttcgccgaagacatggtgttcctgcgccaggtgggactgcacccggtcgtggtgcacggtggcggtccgcagatatcccaaatgcttaaggccctgggtatcaagtccgaattcaagggcggattgcgtgtcaccactccggaagccatggatgtggtccgcatggtgctgaccggcaaggtgtcccgtgaactcgttggcctgatcaacgcgcacggtccattcgcggtcggcctgtccggcgaggacggcgccctgttctcggccatgcagcgcaaaccggtcattgacggcaagcccaccgatatcggcttggtcggcgacgtggtgagcgtcgacgcgtccgccgtggaggatctaatcaacgccggacgtattccggtggtttcctccgtggctccgaatgaagacgatgccactgaagtgctcaacgtgaacgccgactccgccgcggccgcccttgccgcggcccttggagccagcaagctggtcgtgttgaccgacgtcgacggtctgtatgccgattggccggaccgtgactccctgattggccgcatcggcgtggagaatctgcgcgatatgctccccgacctggaaagcggcatgcgtccgaagatggaagcctgcgtgcgcgccatcgacggaggcgttccgcgggcccatatcatcgacggtcgcaaaccgcattccatcctgaacgagatcttcaccaccgacggcatcggcaccatggtcgtgcccgaggacggtattgaaatgaggagttcctatggcaactgaacaactggaaacactcggcactgaagatgccaagtggctgggagagtactcccaggtgcatatgaacgtgtttggcacgcccctgcgcgtgatggaccacggtgagggcgcccacatctgggatgtcgacggcaatgaatatctcgatttccttgcaggcatcgccgtcaacgcgctcggatacgcccatccgaagtgggtgaaggccgtcagcgaacaggccgccaaggccgcgcatgtgagcaactacttcgccaccgaaccgcagatcaagctcgccgccaaactcgtcaagctcgcgggcgctccggaaggttcccgcgtctacttcggcaattccggcgcggaaggtaacgaggcggcgctgaagctcgccaagctctacgggcgcaccctgccgggcgcgttgcctgagatcggcggcaaaccggcacgcatcatctccatgacccacggcttccacggccgcaccatgggcgcgctgtccgcaacgtggaagcccgccatccgtgagaaattcgagccgctggtaccgaacatcgaattcgtcgaagccggcaacgtcgaagccttgcacgacgctttcgccgaaaccggccaaggcaagtacggcaaagggccggtcgcggccgtcatcatggagcttatccagggcgaggccggtgtgatgccgctcggagcggactatgtgaaggccgcccgcaaactatgcgacgaacataaggcgctcctcatcatcgacgaagtgcagaccggcatcggacgcaccggagcatggttcgccttccagcgtgaggatctttccggcggtgtgaccccggacatcgtcactttcgccaagggcgttggcggtggtttcccgatgggcggcatgatttccttcggcgccgaactgtccgcgctgttcaccccgggttcccacggctccactttcgcaggcaatccattgggcgcttcggcggcattggcaacgctgggagtcatcgaagaggacaacctcgtggacaacgccgaagaacgcggcaagcagctgcgcgacggtatcgcctcctgcggtaatccgctgttcgtctccgtgcgtggccgtggcctgctcgacgccatcgaacttgcccacccctgctcgcatgcggccatgaactgggctttggaacacggtctcatcgtcaatgcggtggctccgaatgcgttgcgtctcgccccgccgctggtcatcactgctcaggacgtcgatcaagcggtgtccatcctcgccaagattccgtccgacctgcctaacgactgatctcggacgaacccgaagaatttgaaaggagcctctataccaatggcaacccctgaactgcgccatatgctgcgcgatgacgatctgaaccacgaagaacagaagcaggtgctggaactggccatcaagttccacaagaaccgtttctatcaccagccgttcgctggcccgcagggcatcgccgtgattttcgacaagcccagtacccgtacccgctccagcttctccattggcgtggccgaactcggtggctatccgctggtcattgacaagtccggctcccagctgggccgtggcgaaccggtggccgacacggctcgcgtgcttgaccgtatggcctacggcgtggtgtggcgcacctttggtcaggaccgtgttgaggaaatggccaagtactccacccatccggtggtgaacgcactgaccgacgaattccatccgtgccagattcttgctgacttccagaccatctcggaacatcgcggcggtgtagacaacctcaagaaccagaccatcgcctatcttggcgacgcggccaacaacatgtccaactcctacctgctcggcggcgctgtggcgggcatgaacgtgcgtgtggcaggaccgtacggatacctgccggatccgcagatcgttgccgatgccgaagcgattgcctctgagaccggcggctccatcctcgtcactactgatccgaatgaggctgttgccggagccgattgcgtcttcaccgacacgtgggtctccatgggcgaggaagcggaatacgctgtccgttccaagccgttctgggattatcaggtgaacgccgaactcatggccaaggccaaggacgacgccatcttccagcactgcctgcctgcatatcgcggcaaggaggtcaccgccgaggttatcgatggtcctcagtccgtggtttgggatgaggcaggcaaccgtctgcacgcccagaaggcgttgctgacctggttggccggcaaggcccgtggcgatgaaagcctgctggtctgatgactgaccacactcccgcgttgcagcgtcctgccacacgaaccgctcgactgagcgccattgagcaggcgctgctgacgcgcatcgtcacctcgcaatcgcaactgtcgcagattctcgccgaccagggcatcgaggtgacgcaggccacgctgagccgtgatctcgatgagattcacgccacgaagacccgtcttgccgacggaaccgtggcctacgcggtcggcaaacagaacattgatgaacatccggtttctaacccggacgccaaaaccgagcagcagattagccgggtactgtccggactggtcacatccgtggccgcggcacgtaatctcgtggtcgtgcacacgccatccggcgccgcgcaatatgtggccagcgtcatcgataagcagcccatcgaaggcgtgcttggcaccatcgccggagatgacacggtcatggttatctgctccgaggatgatgtcgccaaacggcgtgcgcaatggctgcttgatgtcgcttccaaagcgtgaatagccatatagtggacacgacgcaccaaatatgcataaatatacagagctgtgcatatactgatgaataacgttggatgttagaaagggaaaccatgagcgatcagaatcgtctcgtcctggcgtactccggtggtcttgacacctccgtcgccatttcgtatctgaaggaacgcaccggcaaggatgttgtggccgtgtccctcgacgtcggccagggcggcgaaagcctcgaaaccatcaagcagcgcgcgctggcatgcggtgcggtcgaagcctacgtggtcgatgcccgtgatgaattcgccaacgaatactgcatgaaggccctgaaggccaacgccatgtacgaaggcgtgtacccgctggtctccgccatctcccgtccgctgatttccaagcatctcgtccgtgccgcccaccagttcggcgctgacaccatttcccacggctgcaccggcaagggcaacgaccaggttcgtttcgaggtctccatcgcctccatcgacccgacgctgaaggccatcagcccgattcgcgacctgtccctgacccgcgacgtcgagatcgccttcgccaaggaacacaagctgccgatcgtgcagaccgagaagagcccgttctccatcgaccagaacgtgtggggccgtgccatcgagaccggtttcctcgaggatccgtggaacggtccgaccaaggactgctattcctacaccgacgatccggcgttcccaccggtcgaggatgaggtcgtcatcgaattcaagcagggcgtcccggtcaagatcgacggtcatgacgtcactccgctgcaggccatcgaagagatgaaccgtcgtgcaggcgcgcagggcatcggccgtatcgatttgattgaggatcgtctggtcggcatcaagtcccgcgagctgtacgaggctccgggtgccgtggcactgatcacagcccaccaggagctcgagaactgctgcctcgaacgcgagcagcaccgcatcaagcgcgacatcgacaagcgttgggcggaactggtctacgatgcgcagtggttctccccggcaacccagtccctgaacgccttcatcgaagacacccagaagtacgtctccggcgagattcgcatggttctgcacggtggccgcgccgtcgtgaccggccgtcgctccgacagctcgctgtacgactacaacctggccacctacgattccggcgacagcttcgaccagaagtcctccaacggcttcatcgacatctatggtctgccgagccgcgtggccgcagcccgcgacgtcaagttcggcaacggcatcgaggttccggagaacagcgtcgagtaagcatcatccggattcacgttgtgaatcgtcttgataatgggggagagcgtaccgtcgggaccatcctgactggtaagctctccctcagtcatatctgcaaggagatttggaaaaacaatgaccgagagcactactaatggtgagcatcttgccctgtggggcggccgtttcaagtctggtccgtcgccggaactcgcacggctgagcaagtccacccaattcgactggcgactcgccgatgacgatatcgccggttcgcgcgcccatgcccgtgcactgggccgcgccggactgctgaccgccgatgagctgcagcgcatggaagacgcccttgacgagctgcagcgccgcgtggattccggagcattcgctccgatcgaggatgacgaggacgaggccactgcactcgaacgcggcctgcttcaaatcgcaggtgacggcctcggcggcaagctccgcgccggccgttcccgcaacgatcagatcgccgcgctcatccgcatgtggctgcgccgccacagccgcatcatcgccaaaatgctgctcggtctcgccgcaacactgatcgagcagtccgaaaaagccggtcgcaccgtcatgccgggacgtacgcatatgcagcacgcccagccagttctgcttgcccaccagctcatggcccacgtgtggccgctgctgcgtgacgtggaacgtctcgccgattgggataagcgcatcgacgccagcccgtacggctccggtgccctcgccggcaacacccttggcctcgaaccggtggctgtggcccgtgagctgggcttctccaaggtgaccgccaactccatcgacggcaccgccagccgtgatctggtcgccgaattcgccttcatcgccgccatggccggtgtcgatctgagccgcctgtccgaagagatcatcatctggaacacccaggaattcgcgttcgtgtgtcttgatgacgcctactccaccggctcgtccatcatgccgcagaagaagaatccggacatcgccgaactcactcgcggcaagtccggacgactcatcggcgacctgactggcctgctcgccaccttgaaaggcctgccgacagcctacgcgcgcgacctgcaggaagacaaggaagccgtattcgaccaagtggacacgcttgaagtgctgctgccggcattcaccggcatggtcgccaccatggtcttcgacaaggaacgcctcgaagccgaagccccgaccggtttcgccctcgccaccgacatcgccgaatggctcgtcaagaacggtgtgccgttccgtcacgcgcacgagctttccggcgcctgcgtcaaaatcgccgaagaccgcggccaggagctgtgggatttgaccgacgaggaattcatcaacgtgttcaaggacttcctgccggcggacaaggccccgcaggtgcgtgaagtgctgtccaccgaaggctccgtctccgcccgcaacggcaagggaggcacctccccgctgcgcgtgcgcgaacagatcgtttccgccaagaccaccatcgagcagctacgcgccttcgccaactccgtgtccgacggttccgcatacaagtcgcccgaatccctgctcaagtaatccctattaagcaaggagcaaaaagcggtgctgttgacgcgcacgcagatacgacggctggtctacgcgcacggccgggagattctggaacatgaccacatggccatcgaaagggtctgctaccagcatggcgtggtcaccacattcgcccattccattcgtgtggcttgtctgtccgtctggctggcagacagactgcacctgtggaatagggttgatctacgttcgttgattcgcgccgctttgctccatgattacttcctttacgattggcatgactgggacaacggcacccatcggctacacggattcacacatggtgaaacggccatgcgcaacgccatacgggatttcaaactcaaccagatcgaacgggacagcatcgaacatcacatgttcccattgactccctatccgccgaagtacatcgaaggataccttgtcaccgcggccgacaaaatcagcgccacgaaggaaacgctctctttcgatcgtttcgacaaacccgcatccggacaaccgacggacaggagctgatggctgtggcgctcacactcgaatatttgttcctttggttcctgttatacgctttcatcggatgggtgtacgagtcggttctcgtgtccgtttcggaacgtcgatgggtcaaccgtggtttcctcaacgggccgttgtgtccaatttacggatgcggcgcggtgcttgcgatcgtgctgttgcatgacttcacgaatcccatcgagattttccttatctcctcattcggcgcgagcatactcgaatacatcacctcttggggcatggaaaagctgttccacgccagatggtgggattacagccattaccgattcaacatccaaggccgcatctgtctgctcggcgcaatcgtattcggattcggcggagtattgatcatcgatgtggtccagccgcaggtcgaacggctcaccgccatgattccgctgcttgccgtgcacgtgatatgcgcggtcgccgccatcgtcgttatcatcgacaccatcgtcaccgtggtgggcatcgtcggcctgtccgagcgtctcgccaaattcagcgaagcggtgcaggagcgtgcggagaaggccggagactcctggcagtggggcaaagaggaattcctcgagaagatgcatgatttgtcggaatcgtcgcaggaacgtgttgccaatatgcgtcagcttgtctcttccgcgttgaattggcagcaacgtcgtatgatccgctccttcccacgcatgcgttccacggactccaccaaatacagcaagatcatggaaaccgtgcgtgagatgctgcgccgaaagtaagtttccaccggccacacgtgtcgtatagcatgtgtccaaaaacgatttgccccgccaacctgcgttgcgcacgctgacggggcaaaatccctttatgcatcacatcggataggggctacgacacttgcgatgtggccgaccccttgtaatcggtgatgccggcaccaatgttcggatgctgcgccgaatacgcctggtccacacagtagaacgccagaagcacgacggccacaacggtgagctttcttgtatcgatacgactcagcaagttgtccaatgcaggagccagcagatacacgatcgccaaaccgcccaaaccaaacgtcagcagaccctcggcacagatacgaccattgagattgagaaaataaccggtgtaatcccaccagcgttgtcctccgtgggtcttctccagataccaggacgagaagtactccaacccgccacacaagaccatggcggccaggaactcgaacaagggcttcttcctcaacttcttcagcagaataaggataatcactccgccggtgccatagatcggcagccatggcccatgcagcgtgccacgattcacgaacgttccttcggaaatgaaggcgaggctcacctcccatacccatcccacgaaacagaagatgaagaacatcatgaccagattgaccaacgaatagctgcgatcggagctgacggtgcgggattcgcggaaccggaacgccatcggcgccggagccagacgaccaggatagatagcgccgtccagaatctccctgccggtatcgatctggtgcagttgctcgcgatactcctcatacttggtcaccgaccgcgcatgcaggatacgcacgcccaaccattcggacaggaacccgacgaaaccgttcggcttgtccaccggaacaagattgctggacaactgctccaccgtttcggcaacatcaccataagcggcatgcaatgtctcagcggaggccttgctgtacaggtattcgtcgctgagcagctcgcttccctccaatcccgaatccttggacaatccgcgcacatgcacgtaatattcgacgaaaaaacgccgcgttatagccgttggaatagaagatgccgctcaagccgagcgtgaacagattgagcagccaccagccaaggaacgacaggtcggccacgaaacactcccacttgtgacccttcatcatgcgcctggacaggctgatggcctcccgtgccccgatattcggattttcggcgacgatgtagggcaccatacggtaggaatacggtttgatgaacgcgccgatgatggtgaacgtccacaggaacaggaacacgttctcgagcagcatcaccttcgccatcgacaaccatttgcgcgtggtgatcgggtagaggaaacggctcacgggaagtttgtcgtaggtccgcccctcaagcagcatgcgcatcatgaccacccggtatgtctgctggacgaacagccatacgaaaaggtaaacggccagggacacgacgatcggtacggccacggcgacgccgtcattatgcacgatggaattggccgcatcggccatcgacagaatgaccgaacccgatgagaacgagttgagcagagacgcgaacacgccgcgtttacgccccatcatggcattggtgtcgttttgcacgatctgctcctgattgtgctccacttgcctgcgtgcctggctttcatcgccgacaagcaggttctccaacactttcgacacgttgtcggattgcgctgtgccatcctcctgcacggttgcggacggggaactggcgttcaccgaccatgtcgacgaactgtaggcgacaccgaacaccgaagcgaacaggcagatgacgactatcatccaatagtgtctcttataggctttccttgcattggccttcatgcctttgcgatccatgcaggcctcccttcttctcgtcaatgagattccgttttcgattttaaccggcatgttccgtgatcgctttgataaaaacatggaaaacggcacacgcggctgtctgcgtcttctgcgaaactgtagggtgcgtaaaacgcggtaatgtccacaattcgatagggagaaagcacagttatggctcacgtcatcgatttcaaggaggccggtttcgattccgtcctcgatgaactggaatggcgcgggttgatttcccagtccactgacagggatcgactcgccgaagcgttgaacggagagcccatcacctattattgcggcttcgatccgaccgccgcctccctgcacatcggcaacctcgttcagctcatcaacatgcgccacctgcaggccgcaggacaccatccgatcgcgttggtcggcggcgccaccggcctgatcggagatccgcgccagtcgggcgaacgcacgctcaacccgaaggacgtcgtggccggctgggccgatcgtctgaagaagcagatcggcggcatcctcgagaccgaaggcagcaatccggtgcgtttcgtgtccaactacgattggaccgcttcgatgaacgtcatcgacttcctgcgtgacgtcggcaagaatttccgtatgggcaccatgctcgccaaggacaccgtggcccgtcgcctcaactccgaggaaggcatctccttcaccgagttcagctaccaagtgcttcagggcaacgacttcctgcacctgttcgacgaataccattgcgtgctggagatcggcggctccgaccagtggggcaacctcacctccggtctggatctgatccacaaggtgcgcggcgtggacgtgaacgtgttcaccagcccgatcatcaccgacgcgcagggcaagaagttcggcaagtccgaaggcaacgccgtctggttggatggcacgatgctcagcccctacaagttctaccagttctggttcaaccgtcccgacagcgagatggagaacctgctcaaggcgttcaccttcctgccaaaggccgaaatcgaacggcttatcgaggaaagcaagaccaatccgggcgcgcgtgaggcgcagcgcaccctcgcatgggaggtcaccagcttcgtgcatggcgaggaagccactcgccaggccatcgaagctgccggcgcgttgttcggacgtggcggcgatctggcggacatcgacgagtccactcttgaggccgctatcgacggcatgaaggtcgatggggaattcgccaaggtcgcagccggcgaccgtgtggccgaggctggtatgaaggcaggcctgttcaagtcgatttccgaggcgcgcaagaccatcaagtccggtggcgtgtacctcaacaacacgcgcgtggaggatgaggaacagacgttgcaggacggtgacttcctgcatggtcgtttcgtgctcatccgccgcggcaagaaggcgctcggcgtcgtcgaacaggcgtgagacgcataggcaatcgtaagtaaataatcgcaagtatctcaagaccaataaggaacagcatggcagaagaacagcgcggatcgcgcggcaaatcctacggcaaccacaagtcctacggctcgggcaggccgggtaaccgcggtggcaagggattcaagccgcgcggcaacggcggcaagtcctacggacacaagtccggcggcttccacaacgatgaccgtaagggcggatatcgcaagggcaatggcggcggataccgtcgtggcgaccgcgatttccatcgcgacggcgaaagcgaaggccaggagcgtcgtttccacaacggtccgcgcaagttcaaccgcgatggcgagcgtcgtgacgaccgtcgcggcggctatcgcggcaatcgcggcgacaatccgcgctaccagcgtgatggcgagcgttccggtttccgccatgatgaccgtcacgatggcgagcgtcgcaatttccgtcatgacggtgaccgtcgtgacttccgccgtgacgatggtgagcgtcgtggcggccgcaacttccacaaggacggcgatcgcagagacttccgccgcgatgaccgccgcggggagcgccgtgatggcgagcgtcgtaatttccgtcgtgatgaccgtcgtgacggcggccgcagggatttccgccgtgacaaccagcgtcgtgacttccacaaggaccgcgaccagcgtccggaaggcgaggagcgccgcgaattcacccgtgaagagaagatggagtaccgcgaggcgaagcgtggtgaatacctgtcgaagccgcgtcgcaattccgacggcacgatgagcttcccgtcgcaaaacccgtacacgcatcgtcgcccgggcgagccgaagatgccgaagggcatcgagtggagcatgctgtccaccgatgaccgtgagcgtctgcgtggcctgtccaaggaacatgcggagaacatcggcctgcacatcctcgccgcctacacgcttgaggaaagggatccggagctggcgctcgaacacgccaagtgggtggcgcatcaggcttcccgtattgatttcgcgcgtgagacccttgcgttcgtggcctaccgtcagggcgattacaaactggccctgcgtgagttccgcaccgcgttccgcatgaacggtttccttgactatctgccgttcatcgccgactgcgagcgtggcatgggcgagccgaagaaggccatcgaaaccgccatgagcgatgacgcgaagtatctgcgcggcgaatccaaggccgagatgttcctcgtgtacgcgggcgcgctgggcgacctcgagctgtggaataaggccattgagatcgtgcatacgttgggccgttccaagggcttggccggcgaataccgcatgcgtgcggtgcaggccgaacagtacttcctcgagcaggccggacgctccgatgaggccgtggctctcgaccagctgcttgacaagcttgagctgcagtacgccgatgccgaagaggacgagacctccgacgatctggtcattgaatacgacatgcaggaattgaacgacgagcttatggacaagctcggcatttccgaagatgacgcccagtatgcgccggaagacgaggatgaggacgattccgaggccgtcgacgagaacggcgagaccaacgatgagacccagcttgatgccgaagcggccaaggaaggcgccgagtccgacgacgagcctgccggtgacggcgaaaacgcgggcggctccgaagacgaccagactgaggatgaggtcgaatccgcagccgattccgacaacgagtgaggtgcggcaaaacaatgctgaaatccacaacccgtccgctgagcgaagcctaccagctggcgctgcttgatcttgacggcgtggtctaccgtggcaagaatccggtggaacatgctgcagagagcatccgcaaggccgaaggcctcggcatgacggtggaatacaccaccaacaattcctcccgactgcaatccgtggtggccgaccagcttaaaggcttcgaccttgacgtcgaaccatggcaggtcatcacctcgtccgtggtggctgcccgtatggtggcccgtgcggtgccgcaaggtgcgaaagtgtttgtgctcggagcacagcatctgcgtgaggaagtcgccaagcagggtcttgaagtggttgattccgccgaagacaagccggtcgcggccatccaaggctggtacccggacatgtcttggaaccagatggcgcaaatcgcctacgccgtagaacagggcgccacgtatttcgtgaccaaccgcgacctgaccattccgcgtgagctgggcatcgcccccggttgcggttccatgatcatggccgtcatcaacgccactggtgtggaaccggtttcgtccgcaggcaagccggaatccgccatgtatgacgaagcccgactgcttgccgcgcatgatggtgccgaaccagtggccaaggaagcatgcctcgccatcggtgaccgtctcgataccgatatcgaagccggcaatcgtggcggctatgattccctggccgtgctgaccggcgtcaccaatccgcatgagctgatgttcgctccggagcatctgcgtccgacctacatcgccaaggacctgaccggacttaacgagccggcccccgaagtcgtgcatgaggctggcgcttggagctgccgcgacgtgcaggcgtgcgtcgacggcgatcgtctttacgtcaccgacatcaccagcgtcgacggtcttcgtgcggcctgcgccgccatgtgggatgcggcggatcgcggacacagcgtcgacggcatgatcgtgccggaattccgaatcgcctgattgccgcacgtgcgtatgcgcaacatgaatgatgattccggtgccgtcgtccgactcgacatcgcgctggtggagcgtggcgtcacggacagccgctccaaagcacaacggctgatcgaatccggcaaggtccgggtgaacggcatcgtcgcatccaaagcgtcgctcaaagtcacggccgccgacacgcttgatgccgatctgggagacgattacgtctcccgtggagcctacaagttggtcggcgcgttcgacatgttctcccagacgggcctgcgttccgcggaaggattcgattgcctcgacatcggcgcgtccaccggcggtttctgcgacgtgcttctgcgacgcggtgccgcgcatgtgatcgcgctcgacgtggggcacggccagcttgacccgcgcatcgcaggcaacgagcgcatcatcgaaatgagcggcgtcaacatccgcgacgtcgaagcggatgatctgccgtaccggccaagcatgatcgtatccgacgtgtcattcatctcgttgacatacgtgattcccgtcatcgcgcgcatcgccgcgcccggcgcacacgtcgtgctgctggtcaaaccgcagttcgaagtcggcaaaggcaacctcggcaaaaacggcatcgtggaaagcgaaaccttacgcaaacaggcgctcgacaccgtcaccgcctgcgcgaaagccaacggactggatgtacgcgccacggcggtctcaccgatcgaaggcacgcacggcaacatcgagtatctgctgtatgcagtggcgtaaaccgttctccgccaatcgatagcgtaaaaatgaaaggccggcggcccatatgaaaaatcccatatggaccgccggccttttgcatgttccgtgggcctagcccctcaaaaacttgtcgatctgatcctgcttgcccatgatgatgagctcgtcgttacggtgcataatcagctctttcgaaccgtattcgaattccttgcccggcgatttgacaccgaccacggtgatgccgaaccgttcatgtacgcgcgcatcctcgatggagtaaccgacgacatgcgggggagtgtggatcttcaccacgctgtacgcgccttcaagctcgatgtagtccagatagttgccggacaccaagtgccctacgcgtttgccggcatcggtctccgcgttgatgatgtggcgtgccccgatacgctgcaggatgcgggcgtgttccttggacactgacttggcccagatgtcggagatgccggcatcaagcagattaccggcggtgatgacggacgcttcgacgctgtcgccgatggctacgaccgccgtgtcgaaatcggacgcgttgatctgctccaacgccatcacgtcggtcatatcggcctgcacggtggggatctgcgaggaccagcggttcaccagttcgccgtccttgtcgacggcgagcacatcctgtcccatcgtatccaatgtggtggctacggaactgccgaaacggccgagtcctaccacaagaacgcttctggtgttgttagccatgattgttcgtgtacctttcgatgttctttccggatgtcaagtataggaagtcgtatcgctggtcctgttcagccaaccacgatctgctcggtggggtagcgaaccggctccacattgcgcggtctggagatcgcataggcaatggtaagcggcccaagcctgccgatgaacatggtggcggcgagaatatacagcaccgtcggattggacgcactcgccacgccgaccgaatagcctcccagaccgaacgccgagcaggtgtcgaacagcgcgttgctcagcgagcatccggtgatggccatcaatgtcatggacactatggtgacgagtgccagacatgaggtggtgacggccacggccgtcatgacggcttgcgaatggatgcgacgatggaatgcgttgacgtcatggcgtccggtgaacgcggcgcggcaggtcaacagaatcacggcgaatgtggtgacgcggatgccgcctgcggtcgaagtgctgccgccgccgatgaacatgacgatggacaggaacaccttcgtcgcgtcgctcacgcccggcatccatgacaggtcgaagccggagctgcggggcatgacggccgccaccatcgcatgccacaaccgcggttccacgccttcggtggcgaacagcagtttgttgttccattccatgaggaggaaccaggtgaacgaggcgagcacgatgcagaacgtggtggtcagcgtgagcttggtatgcaggctccaacgcttcggcggacgatggttgcgccatgagcgcatgaggttaagcaggacgggaaagccgagcgtgccgcagaacgcgctgacgaggataggcaggccaacagcccaattgttgacatgcaggccggcgccgtcaggggtgaagccggcgttgttgtatgccatgaccgcgaagaacaacgattcccacagcgtgtgccgcacattgccatgattgactttgtacaggccggggaacagcgccacgaacgtgatgccttcgatggtgaacgcggtggcgatgaccacggtgagcacgcccttgatctcgccgagtttcgtggtgcccagctcgttggccgtcagcagcttttgcgtggccttgagatggtggttcacggccaaggcgatgagtgaagcgaacgtcatgacacccaagccgcccatctgcacggagaagatgagcacggcctggccgaaagcggaccaatgcgtcgtcgaattgacgatggagatgccacacgtcgaaatcgcggagatcgcggtgaagaacgcggtggtgaatgtcgtttgctcgcctttcggcgtggcggtgggcgtgagcaggagcagcgtggacaatgcgcccaacatcatgaagtacaggatggtcagacgtccgggatgtgtggtgagtctgtgcattaggctgcgcttgcgcggcttgcgctcctccgccatggccttctcgaacgtgtccccggagaaccaccaggcatagccatgtgaggcctcgcgattggaggaggactcgtcgaagacgaggttggacatgctgttcctcgctccttgtctgtataaacggtcttcgtttccttgagctattgtagacggtagtgtgacgaacggtgcagagacataccattcggcctgttcggcggattcgtgggaaaacgacgaacaggttttgcgggtgggatgtacgtggctcgtgaacgaacggaaacgtctgcggcgtgtccggacacccgctaccgccattcgttcatttgttcgattacaatggtaggtatcggcgtccgtcgaggacgtggtatgtacgagagttctcggaaagggcttgcgatgcacggtacccggcatgcggtggtagtgacgcatacacgtctgcgtgaaagcggcacggtggtcgaagaagccgtcgaacagctgcggcgcgccgatttcgaagtgacgatcatcgacaatatcgaagcgcccgatttcggcagcaagacgccagtagtgccgaaaaacacggaaatcgtggtcgtgcttggcggggacggtaccattctgcgcgcggccgaactggttcattgcactgaagtgcccatcctcggcgtgaacctagggcatgtcggctttcttgccgaatttgaaagcttccagatgagcgaggcgatccgtcggatcgccgaccacgactattccatcgacgaacgtatgatcgcccacgtcgacgtatggctgccgggcgcgacggaacccatcgaggactgggcgttgaacgacatcactttggaacgcgccgaccgtggcaaaatggtggaactgtccatccgtgtcgacgacgtggagatgagctcattcggttgcgatggcgtgatcgtatccacgccgaccggttctaccgcctacgcgttttccgcgggcgggccgatcatgtggccgaatgtgaaagccttgcaattggtgccgttggcggcgcatgcgttgttcgcacgtccgctcatcatcggctccggctccacgttcgccatcgacattcttgacgattccacgtcggacggctggatctgctgcgacggccgccgccagcgcgccctgccgaaaggcacacgcatcgaagtgcgcgaatcgaaatgcactttgcgattggctcgtttgtctggcgtgccgttcacgaaccggctcgtcaccaaatttgatttgcctgtcgtcggctggcgcgagcaggcgcgcaaaaccggtggcatacatcatgggcaatcgttccctagaaccggcaaaccggaaagcgggaagtgaccgggcatgctggaagagcttgagattcacaatctcggtccgattcgttccgctctgatcgccccggcaggtggtatgacggcgatcaccggtgagacgggagccggcaaatcgatgctgctcagtgcgatccgactgatttccggcggtccgtccgatggaggccgcgtttcggtgggcgctcaggaggcgtgggcgcagggtgtattcgaagtcgcctcgtcgccggccgcggtggccgcggcacgggaagccggcttcgaaccggaggatggcgagctgtttctgtcgcgtaaagtgcccgcttccgggcgatcccgcagcatgctgtcgggacgtagcgtgccgcgttccgtactcgcctccgtcgccgccgaactggtgacgattcacggacaggccgaccaattgcgcatagcgactacctcacgtcagcgcgaattccttgaccgctatgcgggagacgaagtggcgttggccgcctacggcaagacgtggaacgcgctgcgcgcaatggacgagcgtttggaaaggctcaacagccaggaatcgtccatgcgccagcaggcggattacctgcgcgaatcaatcgaacgcatcaaccgggtcgacccgcagccgggggagatggacgaattgcgcgcacggcgggaccgcatcgaaaacgccgccgaaatcgccgaaggcgtgacccgcgcattgggtgcgttggacgcctcgcaagtggcggatgacgttgaatcggccagcgccgccgatttgatcgaccgtgcctcgcaggcattgcgcgccattcacgtggaaggcgtgttctccgaactcgccgaccggctcgactccatcagcaccgacctgtccgacgtggtgttcagcctgtccggcgaagtggacaatgaggcgagcgtggaggatctggatgccatcaacgggcgcatccacgagctggacgagctgacccgccgatgggggccggaattgtccgacgtgatcacgtggagggacaaggccgtatacgatttggaggatttggacgcctcgccggaaaaggtcgaacagctggaagccgaacgcgcccaactgcttgaggctgcgaaaaaagccgcgcaggctgtgagcaaacggcgtagagccgcggcgaaggaactcgcgtccaaagtcaccgcggaacttgattcgctggccatgggcacttcgaaactggagatccgcgtggccgaacgcgaacagttggacgccaccggagcggacgacatcgaattcctcttcaccccgttccccggctccccgcaactgccgatgggcaaaagcgcatccggcggcgaattgagccgtctgatgctcgcgcttgaactggtcgccgccgaaaagcatgtcgtggccggaggaaccgtgccgccgatgacgttcatcttcgatgaggtcgacgccggcgtgggaggcaaggccgctgtggagctgggtgcccgcttggccaaactcgcccaatccgcgcaggttctggtcgtcacgcacctaccacaggtcgcatcctgggcggacgaacaatatgtggtcgccaaaggcgaaaccaaggatggttccatcgccaccaccatcagccaggtgcgcggggatgagcgcgtgcatgaaatcgcccgcatgctttccggcagcgaaagcgaaacatctctggaacatgccgaggaactgctcaaatcgtcggtgcttgactgacggcggattcaatcgtaaaaagtaatcgcaaatcgtaaaagcggtaattgcaaaacaaaggagccgatatgacacagaaaaccaaggcgaaccaaggcaaaggcgccatcttcgaccttgacggcacgctactcgactccatgggcgtgtgggatcaggtggacgtcgacttccttgccaaacgcggcatcgaggtgccggacgactacatgcagaaggtcgccgccatgcaatttcgccagatcgccgaatacacaatcgcacgcttcagcctgtcggacactcccgaagcgttgatggaggagtgggaccatatggcacgtgtcatgtacgccacggtggttgaagccaaaccgtatgcgcgcgaatatctggaatcgttgaaggcgagcggggcgaaactggctgtggccacgtcattgccgccgatgctgcgcgaaccggccatgaagcacgtcggcattttcgactatttcgatgacgtggtcagcgtcgacgacgcgggcgacgtcggcaaaactgagccggacgtatatctgctggccgcgtcgaggctcggcatcaaaccaagcgactgcaccgtattcgaggatctgctcgtcggcatgcgctcggccaagtcggtcggcatgcatgtgtgggccatgcacgacgattcctccgacgccgactggcctgagatctgcgatctggccgacggcgtcatgttcgacttccacgacgcgcctgccgcattgtaggaaccgttgtcgtacgggatatatgcatttggggctttccgttgattcggaagaccccaaatccgttctccataagagtctaccggttggctcggttcagatgtccttgctaccgtaaatatgcagtgatatcttgctggagaacgctaaggcgagtacgtcgatgatcaagaatgccgctaatgcaatggcttggtgccggctgatcgcctggccagctgttcgacggtcttttcgaattccggcaatgccttgcgcagtccgatgaccgtgcccacgatcacgccgatgctcagaataatggcggccatggcacgataaggggagaaccggtacaggaacggctgcacgatggtgttgagtagcacgagggtcagcacggtcatcgcggcgaaaccgatcgcatccgtcactttaactggctcgtgcatggtgatgccggcgccgttcggaccgaccagacccatgatgtagccggacggcaggtcgaaggtcacgtcatccaatgtgaagccggaatcataatgcttcgtcaatccggttacgctcaaggccaaggttggccgtgtcccttggggagcgaggaatcgttcatgattgttccctgtatgctttctcgaacatgccaagcagatcaagcaggctgatgtcggcggctttggcctcgatggaaacttcacggagcttgtccatgatgcgttcgcgagcacgttccttcatgagttcgttgcctcgttccatcacgaacgtgcctttgccctgcacgttctccacgagcccctcgtcagccagttcgttatacgctctggtcacggtgagcacgctgacgcgcagttccttggcgagcttgcgcagtgagggaagcgcctcgcctgccataagctcacccgacatgatcgcggacctgatttggttcttgatctgttcgtaaatcggttctccggacacggatgagatgattagcttcaatctgtgcctctttttctgtatgtttcgtaggtgatatatctcccagccgaacagttagatgcaagctgtttagctgttatatataacagtaacacagaaaacccgtactgttattgcgtgtcgcataacagtacgggttctgttggaatataaggaaatccgccgctccatgaacgcctcttgcggtcggcgattgacggaatcgacatttacttgcgttcgcggattcccgtatggacggttatatgcgagtcggatggatgatacggcggaaacacaggtagatcagccatgccaacgacatgatcgtcaacataggcaatgtagggaaccggcgatgagttccacttcagtcatgattgcgatttgcttcgcgccaaaggagagagcgtcccttttggtgcgatccgtcgcctgggtggtgttgctatcttgctgcatgattgtttgttgaggaaaccatctgttattccattcccttatagagttctttggctagaccaatcagtgacttgtctgagcctgctgggccaataaggcatgcgccgcatggcagtccatctgctgtttccaatgtcgcgtatcgtccgttcataatcgggcagttgttgaaacatcgacagatcaatcagaccgtgaacgcctttggtgatgtcaacggcttgcgtcgcgtcgaagtcgatggcggccgacagcagcaggtacacttgttgacgtggcatctcgaacatggcggtaatcatatcgatggcgtgttcgacgctttgcgataatgcgtcatccagcgtactgctgaaacccattggaatcagtgtgccatgactgatcgcaaatggcagatccgtgcgtccgaacagtcgtttggcttcggctgttggcactacctgcacgcgaagtgtagctctgagcgacgcttccaatgcggtgagcgacacttcgccattgccttgggtaaaatgcggattgccgatgtataatcctgcgccttcaatctgtactggcagaaatagcgtggattcaacggtgagattgcgtaaatcgatattgccaccataatctgcaggtggaatggagcttggacgctgattactggcggtggtcacgtccatgattcccagaaatggatgcatcgggaaacgtatcgtcgataccgtctcactgcttgtgtttgtggtgtgtgtcgtttgaactggaaaccatgccgtttcggtttcaacatccgctcggcagaactggccgtagttgccgtcgaaatcctcggatcctgccagcactccacgcgcgtggcgggtggagatcacaccgtagggaagcgcggcgccaacgtggtcggagtgattgccagcagatcacctgggtgggcttccggtacggcaatcggactggtgaccacatgcgggccatctgtatcgggattatggtgacattctcgtgctatggcgatgccgtcgttcaacacgtcgtttgcggcgcgaccatctatgagcaatcatgtgtgactgatcaaattctccggattgccgggcatgtcgaaatctacggtctgccgccaatgatcgtgcgggaaatcacgccatccagtttggtaccatcgaacgcactaatgggattgcgtcccaacaacgcattcgcatcgacaacaacctgacggttgggatttaccattaccagattagcccttttgccggggatgatagcaccaccgcctcggggttcagtgcatatgcggctggggcttttcgcgcactttggcggtgaggtagtccgcttccaccttccatacggtgacggcgtgtacctgctggtcggtgaactccacatgttccatgccggcctgctgcttcatcagcagtgcgagcccctggcgcgcttcgtcaagattgtcgatgatggacgcggtaccattgccaacgatcgacttgaacgcctcgccccaattgcacagcgtgcgtccctcgaccacctcgcagtcagtcgccatttcgaatgctacaggaagcgcgttgcccgcggccttgacagcgtccatcttacgtccggtcgcagaaccatggaaatacaaggtgagatgattggattccgtgtcgaacacgtatccgaaattcaacggcacgatggtgatgccttccgcatcggtgtatgcaagactcacgatcttgcatgttgcgataatcgcctcgacctgctgcggttcggttacctcacggtcggcacgcctcatcatgcgatgccttcccgcaaccgtccgctcatcattacgacgcgtcaccatggcacgttcctctctgctggatttacacacccagcctaccggctccctcagccgatgctgtatacgccggaaccatcatcccaccaagcatgatccaccggctccggctgcacaagacgcttcggtcccttcagcatttcaatcgccttcaactccaaacgttcacgctcctcagccaacgcaccgccaacatctgcgcctcatcaaccaccgcaacggagcgcaatgcacatcagaatgagcacgctccaacgtctgcaacgcatcatgagtcttaccagaattcgtaggcccaacatgtaaaaccacccgccgacgcgcagcacgcgttcgcggatgtcggttttctggggatgtgttcgctagtgtgaaactggtaggatgatggggaggtcgtccataggagggtggcttttcagcttctgttgcatggttgatgcttggcgaggtgatatgcgatatcttacgaatacgggcaggtaagtgagaagaccgctcaagtgggagaattcattaagctcatctccgacgctggcgataatcctcgctttgcggtggcggatgctaaacagttgcttaaactttatgaggagcagtacgcttacttgggagacactctagtaaatcagattgcaaagctccttggtgggatttccgatgatgctgttgttggcgaagagaaaggggcaagattcctgtgggccgccaggatgctcaaaaacccggtatcgaactgcatgactccggtttttagtggtaaaagatttgtgctttctggagattttgaaatgtatggcggtaaatcgaccgccgctgaaatgattgaggaggctggcggcagtgttacgaagaccggaccttcaaaaaggatcaattatgtgatcgttggcgatagaggtaacgcagcttgggctttcggcagttatggaacgaaggtcaagagcatgccatggaattaaaacttgcggataatcccaccatcgagattgtttcggagaaggcctttctggatgcgcttgagaagaccaatgcggatgcgcttgaaacactttccgagaagcaagaagaatataagcggatttggtccacggcaaggagcgttggcagagatttccatggtttgactgatggtcagaaaaaaagcttttgatctagtcaaagaaggcaagaacgtttatcttacgggtctcgctggtacaggcaagtcctatattgtcgagcggattattgaatgggctcaaacgtcgggtttgaacgtcattacatgtgctccgacaggtatagccgcgcttaacgtgggtggttcgacggtgcaccgcgtcctttgcattcgtccgggacggaccttggagaaagaccagcatccttttgtgcctacggattctccgcttccggactgtgatctgttgattcttgatgaagtgtccatgtgccgtatggatttattcgattatctttccgcagtgttgaagattgccggcaaaatacgtaaacagaagggcaagggtctttgccaattattggtcgttggtgatttttgccagcttccgcccgtcatcactaatgaagagaggcggtttttggaagaaaaatatggctacgacgttggagaggcgtttgcgtttcaaagcagcgaatgggcgttctggaacttcgaggaagtggaactctgcgaggcgatcaggcaaagggatgcgcactttgttgcggctcttaatgcttgcagattcggcgacaagaatggtgcgcgttggatagagcagcatgctctcgtcaatccgctgcctgactccatcattctttgcagtaccaatgcgcaggcgcgggatgaaaacatgcagaggctcaatgctttaaaagatgaggaaatgacattcgtggcgcatgtgaccggtgaggttcttaagtcggatatgccgactgatgaggagctttcgctgaaacctggcgcgcgagtcatggctcttgtcaacaactccgaagatacattcatgaacggcgcattgggaacggtcataaactgtgacggtccaggtgccctagttcggtttgacggaatagaggctacttttgtgcagagctttgagtggaaaatcacgaagcctgttctcattaatggacgcattgaaaaagaggttgtgggaacattcgaacagatacctcttaaattggcttgggcaattaccattcataagtcgcaggggcaaacattcgatagggcgattatctatccggattgctgggatttcggccagttgtacacggctctatcgcgactgacgggtattcacggactgtatcttgctcatcacataaacgataacttcttggttacttccaaagaagtgcttgatttcctcaacggaaaaagaaaaacggatgatggtcggagggcgaagactgttcagactcgacatgctacacgccgagtatctaacaagaaggatattacaccggataaaaacatcgacggcaatatggatgatttcgatatccgctggggtaccgttccggacgatgttgagctggaagacattggcgatgatatggacttgcttctgcagtcggcggaactgatcgtcacctcgcagttcggttcgacatccatgctgcagcgcaagctgtgtgtcggattcgccaaggctggtcgtcttatggatttgctggagtcgcgtggcgttgtggggccttccgaagggtgcaaggcccgtgaggtgttggtgcagcctcaggacctgccgcaggtgcttgccttcatcaagggtgagacggcgatgcctgtttcgaagcctgcaagcgatccttgggcggccatggatccatgggaagctgaggatccttgggacgtggaagaagcgcccaagccaggtgtcactcaggaaagattcaaatctctcaatgaggaggttgaaaagaaaaagacctcgaaaggtggtctgtttgcgaggattaagcggctgttcggcgcgaggtagcgcgcctatgtagagctgtgttttagccgcagtcttcggggatgttactgtcgcccatgacatccctctgttctttttcgaatggtgtatccgctattgtgcgccccatacggggtagaaaatcgtgtgcgttgtggtgacgtacgccaaatacggtatgggcgactttttgtatgtatcctgcgatgctcgcgagtttacttcgatttacctggtatcctgggtttgagcagccgttgacattcaattcaaggagttttcactatgcccatggatccaataccggtcatagacctgtttgcgggaccaggcggtatgagcgaaggattctcttccctgcgtgatgaaaacgatgagccggtgttccgctccatcatgtctatagagatggagcgtactgcgcatgccacattgaggttgcgcgcgttcgctcgccgtcttatggatgcggatggacggctgccccaagattacatcgactatctcggaactccttccagtgagaatctcgaaagattgaaggattctcatccagaagagtgggctgcagccgaagccgaggcaatccaaggaaccctcaaagagggtgatgatgagttcgtcgagatggcaaagaaacgtttgcaagggtatgacggtcctctcgtgctgatcggtggtccgccatgccaagcgtattcgctcgtcgggcgcgctcgtcgtacccatgataaggacaggctcgaaaaggacgtcaagcagacgctctacaagtgctatctgcggttcatcgaagtgctcaggcctacggcgtttgtcatggagaacgtgaaaggactgctgtccgcgcgcaattacggcgaaggcgtgttcggacatatccgtgctgatatggaggcgttgggatacgagctgcattctatggtcgtgaaagatccagagcggcctcatgatttcattgttcgcgccgacgaattcggcgtcccccaggcccgtcatagggtcatcctgttcggtaccaggagcgggtgcggccagggcgctcccggagtgatgactccacgcccagttattacggtcgaccaagtattaggggagatgccgcgcatccgttctggattctcctccagagttcatgacaagcttgactggaaggaatacgtccgcaaggctgcggaaaaactcatgctcactccggagggatccgcattggggccgagcttggaacccgtgatggagggcaagcatctgccttccgcacagcatgccgatggcatcggtgctgaagatcggaatccattatccgactggtatcgaggccatcttgcaggcagcggtgtgttgcccgagcatgttgcacgcaaccacatggattccgatctggatagatatttgttctgcgcggcttacgcgcaggaacataagacttgtgcgaagctgtacgatttcccgaagtatctgttgccgaaccacaagaacgccgaaggcgcggtcgagggcaaagaggtagtattcgcggaccggttccatgtacagttgtccgatcagccgtcaaccacggtcacgtctcacatcagcaaggacgggcattacttcatccaccccgatccgtctcagtgccgtagtctgaccgtgcgtgaggctgcgcgtttgcagacattcccggatgactacttcttcatgggcaaccgcactgaccaatacaggcaggtcggcaacgctgtgccaccgttgctggcgcagcaaatggcgcaggtcgttgccgattggatagatgagccatctgtcggatattaccgttgatcccggggcttgaacagggaggcggggaaaccgcgctttaccatgtcattgcccaaacgccatagcagaacggtctgccggtcggtcagctgaagtccttcggaaagtctcgccaacgccgccatcatttcttggttgatcatgtagcgtttctgcccccattgaattatggtctgccagttctgctctggaatggacatgagaaaatcacgtctatcatcgacgctggcgtcttcagaagtgatatctattcctggccttaacggaacctgcggttttgcctgcagttcgcgtagcgggaagcctgcatccaagcatcgtttgagcagattgttcaaagcgttctcattaatgggaaggtcatcgccggaaatgagcgtctccaaggagctctttgactttggactcaaatagtgtttgggagtcgcgaaagcgatgagtctctcaagagatttgggagtcaacgcatgccagtcggatactagaacattgtcggtgggtagttcttccacggcttcgttggatgccttgtgtcgcggttccggagcggccgatacttcatcctctttcactactcgtttggtggcggcatgtttgggtttttccatgacgatttcgacgtcagcggcatcgagacaggtcatcttcccttttagattgttccagcattgatcctttttcgcccattcgctcacgttctgcacgggacgacgtggatcgttaagcacctcggaagcctgttctcccgctttcagaaggcacccgagcatatgcgcgtcgatggactgccttcgccagatggcgtcgaaatcacaggacagaccggcacgccgcagatccaaggaatacttggcgacggcatactcggcaacgttcgcctggtatgctcccaagaaccattcggccttcttgatgtgtttgtagacggtatcaaagatgattcgcttgcaaacgagttgcttgtaaaaatcgacgttcaactcatccgccgcgctcttgttcgccgactgctggttgacgaatttagcgaagcacttctgggctccaagactggcgacttgaggttgcccgtcccagcaaacaagatatttgggggcgtcaaccattttaatgcgttgtttgcttgggttggccttctcaaaggccttacgtgaagcggcatcccgacggttcttctcgctgtcgtattggccacgggcacgttcgtaataccaatgtgtctggatcgtgcccggcagaggcggggtcaatgcctgcttggacaactgctcaagctttatctgatactcgctgttggaagagaagtcggcctccgcgaccttgttctgggaattcgtgtaccgggagatatagggaacgagttctcgcgccatatcctcatgaacgacgacgagtttgacagggacgatgaccctgctcagatcggttttgtccttttgccctgtgtagaagatggatgcggtggtttgccctccattgacaatctggaggtcatcaagcctgatgatccgtccctgtccgtctgtttccacatgcgtggcagtggcagtgagaccgttgttgtaggccacgaatctatcaggctgattgcagatggtggtacggattcctttgttgactttgccacgcattgacaggaacgaccgcacgttggcttccatcagtttcgagccatacttcttgtaccatccggaaagaacgtctccagtgacgaacagaagataggtgtccatatcttccatatcgtcaggagctttgaccgtggcgatgccgccgggcagttcgatcgacatgtgctcggccaatccggtggcgtgcgaagcttccataagccttcggatgtcccaagtgtggtattcccagctaatatgctgtcgttccttttcctttttgtactggtcaatttggatagcctctgggtcactacggccggtgtactcgcgatcggtaatgaagtagaatcgtgcacgacgaatgccggcgcgattttgtttgatgaattgagcgaattcgtaggtttcgctactctcctcggcttgcgcttgataactgccgttccatgcggcaacaaagaaccgttgcattgcattgaagtattttttgcactccgcagcttgtatggtctgcggcgcgttttggtcgttcatggtcagtttgtcatcacagacgataaccacgatggactcgtccagttcgaaggcgtcttggtcatatccatcaatggctagcgctttgtttgtgcccataagataacggcagtaggcaggatgataggcggtgatcgcctcgctgtcccgcaggatttcgcacgcggtctcaaaaaacgcctcctgatcgtatatgtctcggtcgcgcgccagctcaaggacctcgttccacagatcgtgccggtattcctcgatttcttccattattcctccaccatggccgatgtgctctccgactgcagatatggcgtcaggttgcttctgctgatatggtacgtgagattcgaaacgccagccggtatcgtcccggtttcgatcctcggaaatccgtcttcgacacggtaagtggatattgttccaatgcggaatgcagtctgggagacaagccccgaatacaggttcagtcccaagctcgccagaccgtcatccacgtattccgtgacggtggaggggtctgctgccttctcgcgtagcctgtcgactagctggggaagggtcagtccatgttccatatccttcgtttcctgtatctcgaggaccatgagcttgatgcttctgtcgctggtatcaagttgctcgggagatgatatggtgatgctttccgccgttttatggatggtcttcacctcccaagctgttttctcatccgggaattgaaaatcctgcggtgccgcgtatgggccctgccatgcgacgcatacctcttcgatggtctttccagtctgtcgtgtgatttccatcgccgcgaccaattccccgaatgtgccgcggagcagtttcgccatgtcggaattgcgggatatcttcagcagcctctgccattgatcaactgtcgcatatatttgccgcaatgccgcatcctcggagggcgcatccgcgatccgattagcaaaagccaaacagatctccccgaaggcatggatcagactccaatcctggagggtgaacgtgagcgcccatttctcgcgaggtctggcgttccctcgcatactgacacgaacgtcgatggcctccaaccgatttaaggtcttgggctgtcgttcggtaagcagcatgatataggggagtccatcgaccgtgcatccaagaacgatgggtagtcgaagagacgtgtccaactcatgattagtacgacccggacgtcgagcctcatcccgccagagggagattatttcatttatggaaagactcatttaatcatcaccgtattcttcagctttcctactcaattcggcgaattcacgtcgctgagcgacggtgttatacatatagaccgttttgccgagatgcttgttcacattcacctcatcaaccgggacgatgagcttcaccccgagcatgccgggaccttcttgtggggacaatccttgatgtccatcaaaattcttcacacatatgcgatagaagagaaggctcggatgatcgccgaagtacttggtcagatagtattgacgctccgaactatttttctggtcaatgggaagctgatatgtacaggctgcaatcttgagcgcatcgttcttggagccaagtcgcattttatcgccattgatttggaactgtctattgtccctgaatgtgcatttacgcttgacctgggtccaatgaaaattgacgccttccacttcgtttccgttaccgttgatgaaaccaatattccaagtcatatcgggattttctgacagctgggtgcatgcgtactgttcggccatgcttgtgttcatctcgatttcctgatcgcgataggtcatgagagtgggaccgaagaatgtatctctatagcccgatcggtattgggaaaggaaatccacgacggccttggcgggaacattctgaaagacttgtgtctcaaccaagggtgatacagatgagatgacttgcggtgcgttgcagacgccgagcagcttcatgaatgcttcatcattctgatttcgacgtttcatatcaacgtcgagtttgattgactcgatgatttcaccggccatgtcaaattcttggtagccgatcccttccacagcgttgcgcatcttgctggcattggtgatgcgtacacccttgttcgggttctttctgatggcaagtccgaactgtttgggcgtcatgccaagatgcttcatcctgcttgcggattccttgagttcttccacgatggaacatgagtagcggtaatcaagtacggattccggcagtaaccagatacgttgcagattcgcgtaattcggacgatatccaaaccaccggcccatctgcaggagagtatcggaagctgtcactctccggtagaacacactgcaaatcagaccactgagcgtcatacctcgggaaagctggtttcctccgatgaatatggtgcattcgttggaagtcagatcgggcgggacatcgtttctgaggctccagtcatcggaatcagagttgaccagtctgacacgaagtctgctggattggacaagacgccttatccgtaggaacatcattccccaggaaatgtccgtgctcgtgtaatactcgctttcaaaggcctcttgcaggtcatcgattctcggatctccatcagcatggaatcgtacggcattctcaacctgccttaaataaccactgacccgatcagcaatctgacgctggacatcggtgaatcgtgacatatggatgagcatggattgctgttcgtcttccgcgttgggacggagagcgcacgcattaatgaaggtgcagacggcatgcttgacttggtcatccaattcgggatctacgatgtcgtagttctttccgtgcgatacgggtagccaactttctagttcaccctcatcaatctctctcacgcaactcgaatcttcgggaacgctatccatgtcgccgaacaacttctttgctccgatgtacgcgtcgggggatttaagtatgtgaatgaaatcctgtgggaacagatcactttcatccgcatcgtcgatgaagatattcgcaaaaggcgttgccgtaacggcaacgtaagaagttcgggaactgatttgacacaggtcgcgaatcagcgaattgattcgtgtgggagaatcatccagtttggcggaattgacagatgcgtagtcgctttcatcatcaatgatgagcacgggcagatccttgtcgaattcgggactgtcgaaccacttattgaacttggagagaattgacgcgtttttctttatcaccgccacgcagggggcggcgctgttccatgttgggcgtggaaagctatggaatgccttatcgtaggctgccacgaagtcattttcgttagtgagctggctggggtgcgcaatgttctgctggtactttccgatgcccactcgtattccatcctgccagccgatgaaatcagtatcgatacgttcctgtgtttgctgtctcagattctcattatcactggtcaatacgatgatgagacggtatccacagtcagcggccttgttcatcagagcgatataggtacgggtctttccggactgcacgtctcctagaatcaaaccttttctggaaactgccggttgatcgcgacgtggatctgccaacagtttgactatctcattggcggtatagtcgagagtcgaatagctggaattcttatccatgacgaggtactgatagtacgaatctgatcgaggggtttcccaagtatcagatgactgcatatctgacagccatggtttccatgccgagttttggtcagtgagagttataccttcgtctattttcggaactaactcgttacgtaattcgcggaaagtgcggttgtatccctcggaatcttctagtagttcaggttttcgagagacgagtatttttaatgcatcctcaatatcctgttcggaaggagcttggtcatcatcgtcatccaccatcagaacaagcttcaccttagccttgactttttcccatttattacgcatgtgatacctccattaggatttcttcggcgttctggcataaggaaaacggctctttggatttgtatttctcgacaaaagctgaagcgctcatgtgctttaactggtttgcaagcatccacatgtcttgggcgcattcgcgtatctcatcatcggtcagaccgttctccgctccatgctcgtccactgagagtcgtgattgtacgtcgttgtacgggaacgctgctgcgaatacttttatcatcccgctgaaatcgcggcgctgctccctggaaaggttgtcgatgaatcctttcacatatggattgtccgtgttgatctcatatcgaaaagagccgtccctgtcactgatgacgtcccagatgcgggcttccggatcgttcgacgtcttgcgtccacggaactgctgcgtgcggcggctgggagcggctaatttctccacgtagcgtttcatcgcgtctcgtatggtcttcggaggtgtggcctgcgactttttgatgtcaagcgtccactcgtcatccatgttgttcgggatatcgacttgcacgcgggatagtttcgttgcttccttgcgggtgagaaggcggaaccagctgccccaggtgattagccggtacgcgcggtagatatagaaaccttgggtatcgaacagcgtgtgtcctttttcctgtttcagatcaagaagacctctgtcttccatggtcagtttgttctgataggggagcgtatatccgcacaacgtggcgtcggtgccggggatgcgctgcatccgttgccgctgcgtggcaaggttgttcacgagaaaaggatcgcgttccggcacgggctcatcgttcacggttatcgagatgcgttcgatttcatcctcaggatatgggtggaggaacctgtggaacacgagacccagatacccggacagttcgagcatggcttggtctatatcctgcagggaatcgcccgcgacgtttcccagacgatccaggttacgccatagcacgcatgtgccatgcgtgctgggcatgagatcccgcacctttcgaggcaattcaagattggtctgctcttcatccaaggtctcgagatcccattcgcgtgttcgtgcgacgtggtccagatcccatcggagcgtattctgacgtccgtgctgaacggtggaaagcatgacggaacgtgcctgtgaaagggatgcggtcttcaaaccgagtccgaaacggcctagatcgttggcattgcgcttggcgttcgggttggttccggcgagtttcatcgcgttcacggccgtctcatagtccatgccgtcaccgtcatcaatgattgccacatacggatcttcgccgtggtcgaagtagcggatgctgatggttttggcgtgggcggcgattgagttgtctatgatatccgccaccgcggtgttcaggctgtatccgacggaccgcatcgattccaaaaggtttggatcaggtgtgcagtctaccatttcgaatctcccggacatctttgtagaatgttgataggaaaagtctactgcgccagaggggataatctttagattgagtcgtcttttttacttctcgggcatttcagcaaataagaattttataaaaaacgctatatgtgaagagccgtccatcgaaagggcggctcttcgtaccggacaaggttgtggaatagatggtaactgttatttcagcgccatcttgctggggaattcctggactcgtgccgtctggggatggtcaatcacttcctggggcgtaccttgctccaggattgcacctttgtccacgaaaacgacgcgatcggatacgtttttggcgaatcgaatttcatgtgtcacgataatcatcgtgacaccggttcccgcgaccttggtaatggtgtcattgatcgaaaaccgttaccggaatacgctacgccttttggagaattcatgaccgcctccgcaaggggagcgacgagattttcggttcttctacgagatagagcatttccaatctgagcacttctcgctctgcgcatgagtcagcttgcatccttcacatagaaaagctaatccacaaacaaaacaacaaagcattccagactagaaaactgaaccatctagcttgtcaagcgcacgcagcaaagaatcaacatgacccttcgcacgcacgttatatcgggcaatacgaatcaccccatcaccatcgatcacaaaagtcgaacgaattacaccctcatagaccttgccatacaacttcttctcaccatacgcgccgtacaaacgatgcacagtcagatcggcatccgacaacaaaggaaacgtcaaatgatcgcgctcgcggaaccggacgagcttgtccatcggatcctttgatatgccgagcacagtgaatccgcgggagcgcaggcgcgcgaggttgtcccggaagtcacaggcctcagtagtgcatccaggagtcatcgcggcagggtagaagtacaagacgatattctgaccgcgcaatgcggagagcgtaatgctatcgccgttgtcgctgggaagtgtgaagttcggggccgttaatcccgcttcgagtcgtgcggatgcgggggagtcctgcgctgttggggtcgctggcgaattgatgtcggacatgattgctccttaccgttcttcggacttcgtgccgatacaaagcgcgaacaggcgtcatcatacccgccttacgtgcgcgcggcttgcttgactcgttgcgcgacgatctatttttctcgttccaaagcaagcgcggtatcgaatatttcgatgtgagcggaacggttttgtttgtgcatgggctattattgggatgacaagttttgtgccattccccaaaccggcttgccgtcggtcggggcggcggaaggcttgcgagaggttactgccggatacctccgccacgtcggagacgtggaaaccgtaagggaggcgtagcataccacccgtgcgaaaccgttggaaagcggaagggtgagcgaaacgtcccgcgagagcgtggcgaaccgcccaagcagtgggcgtcagacccgtcaagggaacagatccgaaaagatctgttcccttctttttattcggagggcaatgatggctgaccacagcaaagagaaggcggagtggcttcggaaagtaagggacgaaatccgtcccgcatatgcccggttgctttcctcgggacggttgattcttcaatgtgatgacggtagcgaagttgccatcaggtttactaaaggcgttttgcccatctatgtgggtttgaatactacatggacttccataagggacgtcgtgcccggcagtcggatttctatgacgacatcatacgaaggaattttacggcgaagcgcgtggactacacccatagacatagcgacaggaacacgtcatacgaaaagcggcggagtcatgcaaaatcaaaactggatatagcaggtgaggccttcaaccatgtggcgagtgctgcctatgtggtggaatctgcgaaaagtggcttgattttatttgctggtgatgagcggtggcgttgggcttgtcggaacaggtgaacaagaaagatgagcggacgggtgattacattcctgcatctcttgtgaatgagagtgttctttccgagagcatccacaggcggggtacgcgtgtgagaagcgtcgtatcagcaagatgggagtgattccggaaaccgtttgcttggtctgtagtcgtaggcttcggcaacatagcagtgattgttgttgcaggataagaacaggatgatgttccggttgcggatgacagctcgtatcattcttcgggttttctcgatgtgtaggttttgtgattgcggccaagtgggcgttctcttggccgcaatcatggttggaaagaggttgagcgatgacttgtggcatagctgagatgcctccgtacaagtccgcgaatctgccatgcataagcgagatgaggacaatgcacatcgaggtgatgatgttttgtctttgccgacgtgctgggcatccctgtcgaaaacgtcgcagtaaacgagttcggcggccttggcggcgcgatgtgctccgccgtgggaaccggcttgtacaaggattcccaagaagcgttcgtgattgctgtagcgaggatggattcgggccacacgaatcactccatcaccatcgatcacgaaagtcgaacgaatcacaccctcatagaccttgccgtataatttcttctcaccatacgcaccatacaaacgatgcacagtcagatcggcatccgacaacaacggaaacgtcaaatgctgtcgggctactggcgaattgatgccgacgtgattgcttcttacggttcttcggacttcgtgccgatataaagcgcgaataggcgcctgttgaggtcggtcggagggctgtgagccacggccggcctcaacgtgctagatggttgttagaggttagaagacgctgtagccgccatctacgcgaatatcagtgccagtaacgtacgaggaggcgtcgctggcgaggaagagtaccgtgctggcaatctcgtcattcgtgccgaaacggtgcattggcacgacttcgagcatagcgtcgtggccaggcatgtcgatacggccattgaaaattccagaccacacgtatccgggggagatggtgttggaacggatgccgtccttggcgagcgctgcggcaaggtaacgtgagtgttccatgatggccgctttggtggcgccatacgcgttcaccggcgtcggacttcccatcatgtagttcgcgttgtgtccggacagggaggctgtgaagatcagtgagccgccatgaccgtgttcgcgcatgatttcatgcgcgatgcggccggtacggtaggtgccgttgaggttgatgttgatggtgcgtgtccatacttcttcggtggcgtcttgatcgtcgcccggtacgttgactccggcgttgaggaatgcgaagtcgacggtgcccagctgttccaccaattgcgttttgagttccgcgacttgtaccgtatcggtgacgtcgcaggtgagcgcgatgacgttggtgccgaaacgttcgctcatgtctttcgccagttcggtgagcttgtcttcttggctgggcaggtcgactagtgcgacgtctgctccggcttgggcgagtgcggctgcggcgttgcgtcctagaccgcctgcggctccggtgacgaagcctttgcggccgcgcattgagaatttgtcgagtatcgagtagtttgaatccttccatttgtcgaggggataacgttcgtcgaagatttgttcgacggttttctctggaatctgcgatgattcaactgccatgtttcgctcctttgcgttatgatgaccgcttttagatgcgttcgcgcatcatgttttgcgcatctatggaccatgtttgcggttgcctatgctcgtgtctgcggttgctcgacgtctatgccgaaccaattcgagtgtagcaaataaaacgatggcggtgctgtcagtatttgtcaggtaaagcgtagtgaggaagccgtagagtcaagaccagaagatggttggcgatcaaaaggggagtggtgatgacggagttgaaaatgttttccaagcctgtggtgttcacggatttcgatggggtgctcaacgcctttccggatgacaagcttttgcgcaggggcggcgtgaacaaggtcatgacctgggcgaagcccgacagtccctacgcgaaaatgtacaatcctgaaaaagcgttccacttggacagtaacgaaaaagcccacacgcccgtaggctcatggcgtattcattggtccagtgaactgtccgacgcgatgtatgcgttggcggtcgacggtatcgtggaattgtggtggctgtccacctggcagccgtactgcagtcagattctcgacccgatgctcggctgggatcccatgctggtcgatgtcgtcacctggtatgatcctgtcaccaaatggggacgtgagacgggcaaatggcagaccatccaacgacgcgtacgcatcgaatgcgaagagaatgaacccgcgccgatcgtatggatcgacgatgatgaatgcttcgaacagcgcgcgcagctcttggaggaactccagccgaaagcgccggtgcttatggtccgtccggactatcgtatcggcatcagccgtcgtcaatggaagctgatcgatacgttcgtgcaccatcccgaacagttcgacacggtcacgttcgacatggaaccaacctgcaggatatacgacatccaccacggtttctagcctaaatgaattaccatgggaggatagtcgagcggaatgaaggaaggatggggttatggcggaacgtatcgtggagcgtcttatccgagagcgtgatactcgatatggtgacggcatttacacgactacacaaatccagttcgcatggaattccaatcatatggaaggttccacccttactgccaaacagaccgcgcagctatttgccaccggtacctataccacggatggcagcgaacaggtcaatcctgacgatgcgttggaaacccgtaatcatttcgctgcgttccgttggattctcgaccatgctgatgagccggtggaccgggatatggtctgtcacctgcatgccattctcaagcagggcaccagacaggtctccgactcgcttttcaacgtgggcggctacaagactcggccgaactttattggcaatcctgtcactccgacaaggactgcgctgccgcaggatgttcccgaatttatggacaggctgtttgatatgtgcacgaaacttgaggatgaaccgtatcagatcgcccgtgtccattggacgtttgagaagattcacccattttcggacggcaacggtcgaatcggacggcttatcatgttcaaggagcttttgcgtatcgatgcgttgcctgtccttggccatgacgcgtatcgtgcggagtacgtcaatggcatcagcaagtttccggacgagccaggatggctggttgatacgcttctattcgaacgggacctttaccggtcgcatgttctgaaaacggatgccgaggcattgcgttacacgtaccatgaccaatggaatatggctgagcatcgggtggaacgagatgaggatctggaattcgccaagctcatcgacacgaaggcccagccgttgttcgatgaggagtatcagcagcgcgaacggctcctatggggcgaatagcggtccgactgtgttgttgtggtggttcctccttccaaacgtgacatgaaccgaatgtgcattgagatgtgcaatttgtgcacattgcggtcgccggccgttcaccttggtgtaagaaggaatcagccttcggactttagcatgagatgcaatggcgcgtattgaatgcgcgcatacgaggaagtgagagctgcatacatgcgtgtattcgacttcgatggaaccatctatgacggagaaagcctgttcgacctgtacctgttttcggccaaatacaatccgaaggtattgcggtacatcgccccggtgctgcgctatgccatcaaatacaagctcggacgagccacgttcgatcaaatggaatacggtgtgggcaagctatgccacggatatttaagcgaactggccgaatcattggaattcgaagaattagtcaacgccttctgggatcagaacatgaagcgcatcaaaccctggtatgagccacgcgaagacgatgtgatcctcaccgcttcgttcgacatcaccgtgggcgaggcctgccgcaggcttggcgtgcaacatttggtctcgtccaccatcgacggcaacacgttgaacgtaaactacctcaacttcaacaccaacaagcccaaacgattccgcgaactctacggagacaacgttcgagtggacgaattctacacggacagccgattcgaccagcccatgatcgacatggcccgacgtgcctacatggtcaaaggcaacaaaatccaccaagtcaaatagccggaaaggctggaacggaatacggcggcaagggccgatcttgacatcttcccttcggcatggacgccttgcacgagccaggatgggcgtcggtcggtcatattgccgtatatggaaaatacgaccgaccgcaaaaacagttagaacgacacgcgcttggaatggtttacggcagaaacctcgcacacgatgccaacaactaccgcgaaacacgcttcacacacaacaaataaatcaaccaagcaacaggcatcgccaacataaacaccggataaaaccacacagcagacaaacgcccatacaccaaaccacccacaaacggaccaaccgacatacccaaatcaatacccgcataatacgtactattcgcaataccactgcgctcgcggcctgcgattaccacggcctgcgcctgcgtgactgaactcatcagaccgtagccgacagcggtgaaaatcgcagccaacaacagcatccaatcattgaacaggaacgtcatgcatgcgagcatcgccagcatgcccaacgagcagaccgtcagccagaaacggaagcccttgctgtcgaacaggtcgcgcaagcccagtcgcaacaccaataacgcgaccgcgtaaaacatgaaaaacaggtcggacgataccggcagatgacgagactgaacataattcacgatgaaggactgatttgcgaaatacgctatcgcaaacatcatgaacgtcagcgacaacggcaccacacgcggttccagaatcgaacggatcgaaaaacgatgctttttggttgcgctagcagaaccgtcaatgtctacggcagtggagggattctccgttatggaagtctgctttttgcgtaccggttgtccgccattcttcaccatcagtgtggcgatcagcatgatcaccgccagcaccagcgaactcaaaaacgtcagacgataaccgatgtatttttgcgcgcgaatacccaatgccggtccgaccgccatagccagcgcgttcatcgtgccatacaatcccatgccggcacccatatgccggatcggcagcaaaagcgacatccacgtggccaggcagaccgagcagcatgcgaaaccaacgccgttgatcacgcgagccatgatgagcatgatgggggagtttgcgaaatagtacagcagtccggcggcgaaatagagcaccgtgccaaccgccacaagcgtgcgcttgctggttttgtcggaaagattgcctgcgatagggcggcagaacagtgagatgaaactcatcgaaccggccaccgcacccatcagcatgccgtccgcgcccaacgattccgcatatccggcaacgatcggattggcaagcatattgctcgacatgaaacagaacgtcgcaagcatgaccaacgccatatcacgggtgatgagacgatcatgcttacgccggggctgttcgggctggttcgattgttgtgccggttgcttctgtcgtaccgattcagatgcgggtatcgttggtgctgtcatgctcgttcgcctccgagcatgcaactgtagcagccttgacgaaaaacggccgtccacatattgcggacggccgatggagatggctttaacgatgtgaaagtatgcttcgcttacagagtttttacagagctttggcggcctgctcgacaaaaccttccataccgtcgatgtcaacgacatggtcgaaacgcacgtcggcggtctcaagaccgcgcagcgcggccggagcggtggtgccggtggccttggcaagcacgtccatgcattcgaaatcggtgccggacgcgtcaagacccagagattcgttgactacgcgcgggaacttgtacgggctggcggtggacagcagcacgcgcggcgtgagcggatcgcgcggcatctgctgcatgacgtagtagccgcatgcggtgtgcgggtcgatcacgtaatggttcttgttccagcagtccgcgatcatctcgcgcacctggttctcatcggcccaaccggtgccgaagatggaacgaatcttcttcatcatcggctcgggaacctcgtaggcgccccactggctcagatcgttcatcagcatggagatcaggcgcgtgtccttgtcggacatgtaatacagcatgcgctccaggttcgatgagatgaggatatccatcgacggggaaatggtctggaagaacggacgctgacggttgtacgtgccggaagtcaggaagtcgaacagcacgttgttcttgtcggacgccaccacaagatgcttgaccggcaggcccagcagcttcgcgtaatagccggcgaggatgtcgccgaaattacccgtcggcacaacgaactcgacctcgtcgcccacattgatgacctggcgttccagcagctgcgcgtacgcggagaagtaatagacgacctgcggcaccagacggcccacattgatggaattcgcggaggaaagcaccacatgcgaatcatcggcgagacgttcggcaagctccttgtcgccgaagatgcgcttgacggcggactgcgcgtcatcgaaattgcccttgaccgcgcacacgttcacattggagccggactgcgtggtcatctgcagctcctgcacctggctgaccttgccttccggatagaacacggtgatgccggtgcccgcggcgtccgcgaaaccagccaacgcggccttgccggtgtcgccggacgtggcggtgacgatcatgatcttctcatccgcgtcgccatccgccggagtggtgcgcgccatgaaacgcggcagaatctgcagcgccacatccttgaacgcggaagtcggaccgttgaacagttccatcacatagtcatcgccgagcggcttgaccggagtgatcttctcgtcggaccactgcgggccgtacgcctcgtcgatgcactccttgagctcggcctcggtgtagtccggcagcagcacggacagcacatcgaacgcgatctgctggtaggacttgccggccaaggaagcgatatccacatgggtctcacccaaggagtcggtcacgaacaggccgccatcatcggcgatgcccttgcggatggcctgcttggaggtaagcgaatcggtggtgctgcgtgtgctgtggaacgtggtcacttgatttccttagcaatagaacggacagattacgtcaaacgtgcttctcagtgtaccggcacaggtgggaagaacgtcgcctcgcgtccgtggaatgggacgccgaccccatacgattgccgacggaaggtcctgcttttccacgtggcaccgcgatcgtgccgtccatgtcttcgcgcgcaggcggtgccatatttcccacatgtttcgaaacccggttttcctccgatcgttttcacacgtacactgctctgtaacccgcggtacagcggatgatcattccgaagtcaaggagggcttcatgactgcatcacctcttgcgcaaacaccgaacgacatgttcaacgcgcccatcgccgaagcggatccggaaatcgccgaaatcctcgacgccgaactgtccaggcagcaaaacggactcgaaatgatcgcatccgagaatttcgtgccacgcgccgtcctacaggcacaaggctccgtactgaccaacaaatacgccgaaggctatccgggacgccgctactacggcggctgcgagcaggtggacaaaatcgaaaccatcgcccgcgaacgcgccaaaagcctattcggcgccgaatacgccaacgtacagccgcactccggcgcacaggccaacgcagccgtctaccaggcgctcgtcaaacccggcgacacggtcctcggcctcgccctcgaccacggcggccacctcacccatggcatgaaaatcaacttctccggccgcttctaccacgccgaagcctacggcgtgaatcccgaaaccttccgcatcgacccggaaatcatccgccagcgtgcgctcgaaacccatcccgccatgatcatcggcggatggagcgcctacccgcgcatcgaagacttcaaagccatgaaggagatcgccgacgaggtcggcgccaaattctgggtggacatggcccacttcgccggcctcatagccgccggactgcatccaagccccgtcccatacgccgacgtcgtatcctccaccgcacacaaaaccctcggcggcccacgctccggcttcatcctcgccaagcaggaatacgccaagaaactcaactccgccgtattccccggccagcaaggcggcccgctcatgcacgtcatcgccggcaaggccgtcgccttcaaagtcgccgccaccccggaattcaaagaccgcatgcaacgcaccctcgacggcgccaagatccttgccgaacgcctcatggccgacgacgtcaaaaacaacggcatcagcgtcctgaccggcggcaccgacgtgcacctggtcatggtcgacctacgcaacagcgaaatggacggcaaacaaggcgaagacctgctcgcacaatgcggcatcaccatcaaccgcaacaccgtcccgttcgacccacgccccgcatccgtggcctccggcctgcgcatcggcaccagcgcactcgccacccgcgggttcggacccaaggaatacgaggaagtcgccgacatcatcggcaccgctctcgccgcaggacaggacgccgacgtcgacgcgctcaaggcgcgcgtcgacaagcttgccgaagacttcccgctttacccgggactcgaccaaatccactgatcaccagcctcgactgacgaaatcgcgtcccgccgcgcaaccaacgacccgaaaatggccgtcattgcccagcgaggcgtgatttcgcgctattctaagagactatgacgaatccacagaaccaaggcaccgccatgaacgccgacgtgttcgaagcagtatgcgccatgggcgacgcagcccgcaccgcgcaatcgcaacttgcccaggcaaacaccgaagccaaaaaccaactgctcaacgccatcgccgacgcactcgaccagcatgcggacgacatcgccgcagccaacacgctcgacatgaaccaagccgaaaccgacggcatggacgccggcaaactcgaccgactcagattcgaccagcagcgcatcgccgccgccgcgcaaggcgtacgccatgtggcatccctaccagaccccatcggcgaaatcgtacgcggataccatctggaaaacggcctacgcctgcagcaggtacgcgtccccatcggagtgctcggcatgatctacgaagcacgtcccaacgtcaccgtcgacgtggcctccctatgcatcaaatccggcaacgccgtcctgctgcgcggcggacacgcggccgaacacaccaacgcggcaacactcgccgtcatcgccgacgtactcaccaaacacggatacgaccacaacatgatcgccaccgtagaccaatacggacgcgacggcgccaccgccatgatggaagcacgcggccacatcgacgtgctcatcccacgcgggggagcaggactcatccaagccgtggtacgcaactccaaagtccccgtcatcgaaaccggagccggcaacgtgcacatctacgtcgaccgcaccggcaaccccgacaaagccatccccatcctcatcaacgccaaaacccaacgcgtcggcgtatgcaacgccaccgaaaaactcctcgtccacaaagacatcgccgaaagcttcctgccgaaagccgcggcagcgctcgccgcagcgggagtcgaaatgcatgccgacgaacgcgcgtatgacatcatcgaacatgccggaatcgcaaatgcgcaactcgtgcatgccaccgacgaggattgggacaccgaatatctggcactcaaaatcggcatcaaggtggtcgactcgcttgacgaggccatcgcgcatatcaaccgccactccaccgggcacaccgaatccatcatcgccgaagactattcggccatcgaggaattcaccgcccgcatcgactcggcggtggtgatggtcaacgcctccacacgtttcaccgatggcggcgtgttcggattcggcgcggaacttggcatctccacacagaagatgcatgcgcgcggtccgatggggctgcgcgagatgaccacgaccaaatggattggctacggaacaggacaggtgagagaatgagcgacgaagtcatgcaggacaatatgcaggacaacatgcagaacaacaagaacccatggaacgcggacttgaccgacccaatgctcagattgcgattggcatccgaacgattgagcatcgtgcggtatgtgttccttgtgcaggtcgaagacggtatcgcgtccgcggacgaacgcgcctcgctcgaatacgccgacgcggtgctgatcggctggcccgaaaccgacgcttcggacgtcatcactcccgatgccgcccagcttgacgatatcgacgagcagatgcgggtcatggaacagcacatcgccaagttcagcgcgatggaacgagaccatgacatcgtcggcatgaccgacacgctgattcgtgtcaccgagcgcgttgccggaatccgcagcatataccagccggatttcccgctgccgacattcgccgagattcgacgtgtggtgcaggacgagtgggatgaggatatggacaagatcgatcccgacaacgcctcaccgaccgcggacagcatcgagcaggaaaccgccgacgcggacaaagagcagcaggccgagaaacaggccgaacagcaggccgatggcgcgcaaaagagcggagcgtccgcatgaccggaccaaaacgcatgcggccggaatctgcggaggccgatcccgaactgaccgtcagctacgtggtcgagccggaacgacgcatgtcggaactatccgtagaccggccgcaatcagccgtgaccaccggacgcaggtccgcacgaggcaactggcacaaccggttgcgcatcggcatcatgggcggcactttcgatccgatccataacggccatttggtcgcagcctccgaagtgtcctgggtgtacgacctcgacgaggtgatcttcgtgccgaccggacggccggtgttcaagttggacaagaaagtcaccaatgcggaggaccggtaccttatgacggtcatcgccaccgcgtcgaacccgaaattcaccgtgtcgcgcgtggacatcgaccgtcccggcgtcacctacaccatcgacaccctgcgtgacatccgcgcccagtatcccgatgcggaactgttcttcatcaccggcgccgacgccgtggcggagatcatgcaatggaaggacgccaacaagatgtgggagctggcgcatttcgtggccgtgacacgtcccggctattcctcgccggacggcgtgaaattacctgaaggcaaggtggatacgctggagattcccgctttggcgatttcctccacggatgtgcgtcgccgcgccgaacatggcgaacccgtctggtatctcgtacccgatggcgtggtgcaatacatcggcaaacacggcctataccgatagaagatggatggggccgtccgcatggccccccgaacacacggggtcggtgaggtctgcgcggccggttagtatgggtcacatccacttcgctagaacagacgtttggagacacggtgagcgcaatccttgaaggaaagccggataagaaccttatccttgtcacaggcagagcacacccgaagctggcggcggaagtcgccgaacagctcggcattgatgttctggaaaccacagcatacgattttgcgaacggcgaaatgtacgtgcgctacaccgaatccgtgcgaggcgcggacgtgttcgtactgcagagccattccaatccggtcaaccaggccatcatggaacagctcatcatgattgatgcgttgaagcgtgcttccgcgcgttccatcaccgcggtttgcccgctgctgggctattcccgtcaggataagaagcaccgcggccgcgagcccatctcctgccgtctggtgtttgacctgctcaagaccgcaggcgccgaccgcatcatgagcgtcgatctgcatgcggcgcagtcgcaaggcttctttgacggcccggtcgatcatctcatcgccatgccggtgctggtcgattacatccgtgaccgtttctccaaccaacttgacaacgtcgccgtcgtctccccggacgccggtcgtatccgtgttgccgaacagtgggcgcagcgcctcggcggcggtccgctcgccttcgtgcacaagacccgcgacatcacccgcccgaaccaggcggtcgccaaccgtgtggtcggcgacgtcgcaggcaaggactgcgtgcttgtcgacgacctgattgacaccgcgggcaccatcgccggcgcatgcaacgtgcttaaggatgccggagccaagtcggtgaccgtcgtcgccacgcatggcgtgctgtccggcccggccgtggaccgactgaagaactgcggggcacgcgaggtcgtgctcaccgataccgtgccgattccggaagaaaagcgttgggacggtctgactgttctgtcgatcgcgccgttgctggcaagtgccatccgcgccgtattcgaagacggttccgtcgccgaactgttcgacacgtatccggaacatcacggccagggcttcctgttcgcctgattttctaggaaactcggatacttctgacacttcagatatttcgaggttttacgttatacgggttccggttcattcggaacccgttttctttatgcttttcgctgcattgcacgctgacggttgcgcgggtgggggtgtttccgccatgccgtacgggccgatccgacttgttcgaatggtaatgcgtgcggaacgtcatgatgcccccgcatcttaaaaaaacgtcaggccggcatcagacctgtacgcctgcgagcttcaggaacttcttgtcggactggatgccttgagtcaggaactcgccgtccttgaacagcgcgtaggtcgtgaccggagctggcatattctgggcctgctcacggctgatgatgtgaatggtttttaatggaatgctgtgctcttccgccaccgcttccacgtgtggcacccagtagtgggtgaacggacactggtccgtgtagtagagaacgaatccatcaccatccgccgtgggatatttggcgcattctttgaattgcggaggctccgtgtccgaaccgaacggcaggtacatgagcatgattccgcatgatgacgtgtccgcaaccatgaaacccttgtgcgcaaggtatttcgcgtcggagaggaattcgcgcttgcgtccttcggcagacaaaatacacaatcccttccgcccctgctccttcgcatccctcacgcacccccgtaacaggtcgttggaatatccgtgccctttcatggagccggcgacccatagacagtcgatgtaaagatacccatccgcttggataggaacccacgcgttctccgcggggatatattcgatgaagcattttccgcgttctacgctgcggtagaagatcaatccttcgtcgaatcgacgtttgagccactcctttttcgcaagggcctgtttgccggacatggcgcagcagacgtgctctgcatcgatgttgtccctggtaattcgaatgtattccattcgggacctccttgtcttgcgcggttccgcccatgttgccgcctatggcgtgggattattgccgagtctgctggaaggcgccgttccttgacatcagcgttgctccgaaaaaacgagattccggtttccatgacgttttcagacttccgtattttagatatttagacaaacgtctaaatatctggtaggatgaatatcgcaatccgatactggaaagagagcgatgatggcaggagaaggattcaaggcgctcgccgaccccacgcggcgtcgtatcctcgagctgctgcgtgcgggggatatgaccgcgggggagctcgcggagcatttcgacatcagcaagccatcgcttagtcaccatctggcgactcttaggaacgctggtctcgtaacggacgaacgacatgggcagaacatcgtgtacagcctcaataccacagttatgcaggacttggtcggatggttcatgggcttcgcggacgatccggaagacaggcaatgaaaggtctgacaatgcaaaagcaggaaaaacccgagacaaccaaagcctcgaccggtattccggcccgtgtatgggtcgtcctcatgctgctttgcgtgctgaacgtcgtggcgcatcttgccgccatgccggggctacctgagcgcattcccatgcattggggtgctgacggcggtgtgaacggatgggggccacgttggatggcatccgttctgggtgcgcttccattgacgtttctcgcactgttctatgtggcgccgcgcattgatccgaaaggtgccgcatatgccaagttcggcggattctaccaaggattcgtgatctcgttcacggtattcatgtgcgccatcagctggcttggggaactcaccgtctggaacctccttcctggcaagggcgcggtcaacgtcatcgtgtccggggcgatcggcgcgttcttcatcggcatgggtaattatctacctcgtgtgcggcaaaactacacggtcggcatcaaaacgccatgggcgctcgacgaccccgacaactggcgccgcacccaccgtttcggcggagcctgtttcatggtggtgggcgttagcctgattgtgctgggatttttaggaggtatattgcctgaaacctggattctggcagtgattatggtgcttgcgattggctcggtcgcagccatgtatgtttactcgtatctcatctggcgcaaatcccacaacagctgattgggtagcacccccggttttcttcagcgaaaccacaggggagtccgacccgaattgcctgaccgtgcgggtcgtgttgacgcggataaacggataaaagacgccccggtgacatggaaaccagcggttagcatgggggctcgtacttgtaagtgcaacaggcattccgatgatgtttgattttcctgcatgcaaacccgtcgtgttctttatttctgttgtattgcgagcagtacggtggcgcgcaggacgtcctcgtcggtgaaattcaggccccatatgatctcgaccttgtcggtgaggcgcttctgcacgccgccgacgatcgccgtggcgtcggacagttggaggctcttcggaccttcgatggcgattatcgctcccgtgacctcgtcggacgcgacgctcgaatcatggaaccgtccgtcgagtgcctccacgatgcccgtcgacgacccgctttccacgcggatgaccgtggtcagggcgccggcgcagacgcttctgacgtcgtccccatcgatgtggatgtacttgttgttgccgaggaatccctccaacgccgcgacggcatcgtccatcgtcgtggcgggatcctcttccgggacgggcaggaggtccacgtccacgcggtccgtggcgtccgttccggctgccggcatgcggacggtcagttcccgttcgccgtcgttttcgttccataggatcttgacgacatggcttccgtccgtcttgtccgtggcgtcgatgtgtcgtgcggtcatttttggttccttttcgatgaggcgggttcgtttctttccggggcatgtcccggccgttcttacttctgtcgatgccggacgggcgtgtggtccgatcggggcgagtgcgaatcaggacgggggtcggcatgggcgtcgtggatcggcgacgagtcccaaaaacgtcaccgatccacgacgcaatcccgacacccgtttcgcagccgaggacgatggcggaaggggcattggcgcggttcttgccggccacgacggaagacgtggtctgtgcgagagtgctatgccttggctagcttcttatgtctgagggtgtaaacggcatcggcggaatcggcgacacgtttggaatgcgtcaccacaatgacacatttaccgagttgatgagcggcatgccgcaaaagatcaatcacctcatcagtcatttccggatccaggctgccagtcggttcatccgccagaatcgcgcggccgggcgccactagggcgcggccgaccgccacccgctgacgttggccacccgacaagtgcatgatgttgcgcttcgattcctcacggctcagccccagatcctcgaggatcttcatatcggccttgggattgaccaggcgcagattctcttcgggggtgagatagtcgatcagattatggtcctggaacaccaaggacacgtgctcgcgacggtgctttgaataacccgtcgtagctatatcctcgccctcaaaacgaaccactccatcagagggggcatccagaccggccaacagagacagcaaagtgctctttcccgctcccgatggaccggttatcgcatacatctttccggattcgaaatctgcgttcacgtccgaaagaacgcgaatcttcgccgcgccatatgagtaattgacatggtccaattgcagacagatagtcatgattagtatctcctaacgcatagaggaaagaatggatttcggggatttggccagcactgcggcgcacgacacggcaagcgcgattgcgatgaccgcgcatccgagcagcaggatgagcagcgtctgttctggcggcagagcctccacctgcaatgattcaagaggtgcgactcccgaatcgtgcagcaggagcgaggacacgtaaccggacaatagggagcccgttcccagcgagcacagggcggcgaccacagccatgagaccggtttcgatcgcgaactgggcgataatctgcatcttgccgatgccgagggccagaagggtgcctatctcatggatgcgtgagcgaatccagaagacaagcgccatgcccaataccagcacatcggccaggcagacggacaacagcaccatgcggaccagatcgcgtaccgtttccaccgactgcagcacgccggaaagctgcgccgagtcatcggtgacgccatactcgcttccggcgattttttttgcttgggccattgctgcggaaagatcccgcggattatccgagaggcaccggatcgtgccgacccgttcctctccagtcagcgcggaaaccacttgagcgcccgaatagatgagattctccgatgcgtccgatggcatagggctctgtgcctgtacattgccagagaagattccggccacgcgaacggtggaatcgcggccttcctgactgagtcggaaggtcgatcccaccgatagtccattctcacgtgcgaaatcccggtgaatcagtacgttccggccattacctgaaatgtggtgtccttgttccaaccggtacaggccgctttggaactcttcggacaacgaggagtcagtggtgcccagcacgctgacctgcgtggatagaccggaatccagtcgaggaccatgttcggggacaaccggatgcgcgccatccacctgcgccagggtcttacgttcgtaaacggttttccctacgccggggatgcgtgagaaccggctcgcttcctttggactgacgggattctcgccggtgtcgacggtaaaacccattcccaggcttccgccgatatcgtcggacattttctgaagcgccgttgacgctccgacctgagccacgagactggtgaaaaccatcagcatcaacagtccgatgattccgctgcgtaccggtttacgtacgattgccagcgtggcacgcttccacacgttcatgcccgtcatcggagctccgacaggcttcgtggcgacttgcgcagcatcggtatgcacgatatggcgacgcataccagcatcaccgccagcaggccgagcgatacatacagtacggcggttgcgtcgatcgataccgtgagcgaatccaaggtacgaaccgacatattggactcaagatcgccgccgacctgtcccatgctgctcagttccttcgccgcggaggcgttcacggaacggagggccgaggtgccaagccattgggccgctccccgtgcgcacagccatccgaggaccagggacggcaggccgatcagaatcatctcggttagatattgggcgatcagggatggcttgccgatgccgagggacaccaatacgcccatctcctgacgtcggtcgttcatccacagcaagagcatgaggctgaggactatcactgccgagatggtcacgccgatcaaagcgccgcgcatcatggagcgcacacttcgggcggcattcagcatgctcgacgtatattggtcattgcgcgtgatctggtagttgttccaatccaccggaagcttcttcgccgcttccatggttttctccacgtcgacacccctgtccagaacgaaagtggcatcctggtatatttccttgccggccttgtactggtacagagtacttgtagtgtccaaatcggtgtacacagtgttggaggtgagttccgcgcggctggatacctttctgtcgctgtcccctttgaatattccgacgatggtggttttgacagtcgccgtcgaatgcgactcattgtcggcatcatatggattggccttgagcgtgagggtatcgccgactttaagcccattggttttggcgagatcctcatggaccatcgacatatgcttatcggacgtctttagatgacgtccttcgaccatgccgagcgtgtgggacgtgaacacattgagttttgacgaatcgtttgtgcctatgacgttggccgtattgccgaactgctgttctttctccgcatcgtaatcatcgccgccggggaccttcaccacgctggctcccacgagatcggcggtggcgttctgcctgaccatgcacgagccaaccccggacagcttcgagattcgttgcacatcagcgggacgaaccattccgcctccgcgaggcgtcagcatgctgccttgcaggttgctggccagcacgaatccgccgaccgcctgtttctcaatctgtccggcctcatgttgagctgcctgagaaaccgcggtcgcggacagcatactcgccgttatgatggtcagcacaatgaacagcaccgcggtgcgcactcgttttctgagcacatagcgcgccgcccgtgagataaaggtcattaataccccctgtaaagctgggaccttctcggtagtgcccgaaaagatgtgcactttggaccatggccgtccatggcacgatgatcagttcgcttccgcgagtttgtcatcgagccgggacctgtcgagatagcggcgggtcgacgctttcctcgcgccgtctgtggcgctcgatgaccgcggattcgaagacctcgcccttgagcttgggcaccttcaggccgagcctgccggccttggcggtcaggctccggtcgtagtggccggcgcggtacaccttccgctccccggcgcgctcgtatctggcggcgttggcgatctcgtcggcctgaagcgccgggcatcgcgttcaatggttcggtgaccttctcggcgaccaggcggtcgagcttggtctcgagcaggttccggtcgatctgtatgatgctcgagggtcttgccgactttgtcgcgtccgcgccgagcggattcctacactctttggcggccctgtccagatcggcggccgccgacacgcacgttccgcgcgccatggccgtcctgtggtcctcatatgcccgatagcccaggcggccgcccacgaccactgcggtagacgcggccgccgccacgccgctgaagcggccggaatgacggactggaacccgccatcggcggcatacgtcggtgtatgcggtcggcgcgttgggcaaacccatgccgcaccggccggaggctgagggggccgttcgaccggaaaactcaatggccgtaggattcccggatgcgggcgtcgggcccggtggcaatccggactggaaccctcatacgaaaaacgggctgccgtggtccgttgggaaccacggcagcccgccatgtgattcgttggaatcggaaagccttacttgttgaggaccttcttcatcaggtcggaggaggccttggcgagtgcgaactggccgaagcccgggtcgatggaggcgaggttggcgttgatgatctggttgaaggtgtcgttcttcatggtgtttcctttcggacggccgcctgtcttcttgctcttgtcttcttctgcgtcgcgcggctcgtcgcttcgttgttttcttgtctctgtatcttctgttgtttttctgttgtgccttcactataggcaggaaagtatgcgtacgtcatgccgcaatcgccatttctattgtagactcatcggttcatcttaaagaaagaataaaaaacggtcatatattctgttgcgcagcctgccgcagcgtagttttgggtagatgaagtgcgattgttctgcccattccgacggaaaagttcatgtttgcgtcggaatgggcggatgaattgcgattgttctgctggtttcgatgcaaatggtagctttatcgtcgtttcgagcagaaaagtcaacggttttctgttgatttcaacgctggcagcccggtttgcgtcgtttcaagcagaagaagtgcggctcgtctgccggtctcaacgcgaacggcagactttgcgtcgttttgaatggaaagaccaatggatttctgtcggtctcgacgtggacggactcggcctttttctgcaccagtggggattgaccttccgtcggcatccggagcgaaggcctatcgcttcgaacgcttgcctacaagaaccatggaacagcctgccgacacgcacaggttcactccgcaggtcaccgccggcaatagccgtatgaccggctggtcatagaaatcgaggacatcgggatccatgaatcctgagtacgcctcgaaaagcggatatggcacgagtgccagtgtcgaactcgcaaagaacaatatccagataacggagaggcacaggatgaaggctcttcgaccttctggacggatggttttcgagaatgcgaaaagagtccatgaaagcacggtgattaaagctccggcgacatacagcagactcggaatctcgtcatacatgatttcgcctcctctcgattcggttgcagacgattcgatctatcggcagtatgggctgattataaggcggcgttgttttttgcgtcaagaggttttggccgctcatggccgatttgacgtttcgccggaatcgcaaggcaatgatgctgtacggatctggcgagtcttcgatacctgcgcatgccaagcgagggacgatccatggggtggcagggtcgagggatcttcgcaatgccgttctcgccgctcgcgaaaacggttcgtcatgattccgttcggctacaacgcggaccgagcgagcctgcattggaacaactggagctactgaaacggcaagacctccgaaaccgcgattgccgacggcgacgaggattcgccgaagaaggagaagtatcggtcaaggtggccgcggtgaacctgaaagcagtctagattatcccgatccacatattgtccattgtgtccatttgccgcatgatgaaaacagatggaggtggttgcgatgaccatgatgatgggtggcaaagtccataggacgaggtctaaggcacggcgctctgctggcggagttcccggagcgttcctgcaaggggtggacggcacgcgtatcccgttgacgccggacgactacaggcgcgttagggagtttctgcttgcagagccggaacgggcggtggcggatgacgagcgtatcacgactggcgaggcggcgcgtattcttggggtctcccaacgcacgctcacacgcatgctggacgcgggcatgattccgtacacccgcatgggggagcgcagttaccgtttcctgaggctttcggatgtgaccgactacaagcgcaggcgcgacgaggccacatccaaggcgttggatgagatgcgttccatcgccgatgaggacggcgcgtacgacatcgactattcggattacctgtcccggttcgataagtagagtgcccttatgattgcgctgcttgacgccaacctgttcgtacctacgtggatcatcgacccactgcttagcttggccgaggctggtctgtgcgagccagcatggtctgcgagggtcatggacgaggcacgcttggccatcatggaagtgcggcatgtgcccgacgtccgggcccgcggttttcttgacgcgatctgcagggcctttccgatggccatggcggaggattgggagcggtttgaaccggacgtgaatttgtcggaccccaacgacgggcatgtggtcgcggccgcccgtcgggccggtgcggaaaccatcgttacattcaacctcaaggatttccccgcagacgaactttccaggtacggactgcacgctcaatcgccggatgttttccttacctccgtgttcgatgcacatccagaagaagcgatggacgccatgcgcagactggtcagctccaaacgccatccgccgcgtaccatgagcgaagaaatcgagcatttgcgcgtcttgcgccttccgctgttcgcacggagattgtccgaaacggtaggctaatccccgtcatctgcaacactgcgaatcatacggtaggcgcaatcaatgcacaatctgtgaataatcgctaatccattggctcaacacaacctattgccgccttgcaccgtggaatcaagcaaatcacgaagaaaaggccgtccgcacggcaagatttcggtcgtaggcgatggattcggacgagccgtatccgagagggtgccagtacgaataggtggactcggaccggtcatgtctagggggtcggaatagccccctagacatagtcctttttgctcccccacctggactcgaaccaagacaaagggttccaaagacccgtgtgctgccattacaccatgggggaacggcgataaaacccgaggttttccgccaagtgtctattatgccatatgcggccatcacctgataccgcgtgtcggacgctttcgcaggtgatggccgcttcctccggattcagttcaatgccttgactagccaaccatgcgtaccgttgtcgaaaagctcgctggtgatgcggtagccaagatgttcatacatcgcgaaattcttatcttcggagtgtacggcggcaacatgtccaccggccttccggatgagacgttccgcctcggccagcaccgtcttgccgataccatggccacgttcgtcggcgaccacggccaaacgaccaatcacccaacgtccgggttgatcggcatggtcgagatcagggtagagacggcatgtcgccacggcgcggccgtttccaaaagccagcagatgcgtggctcggcccggctcatcccattcgtcgaattccggacgataatccttctccacgacgaacaccgccgtgcggatgccgtgcgcctcgtccgtcatcatgtcgtattcgcggatctccatatgattcgacactacagtcgggcggggaagagagacgaatggaagttatgtggcgtcgtgttcgacgatggcactgttgtcgaacgcacgccgaacaacgcacgccaaacgcacgtaggcggatgtatgacagccagcgcacgtgatagggtacacccgtgaacgaaaaagagaaggactccgacacacgcatatacgctttggacgggctcagaggactcgcggccctggcagtggtcgcataccattacacgggaggcaccctccgccaactattgccaggcgcccaattcgtcaccctattcttcattctcagcggacttgtactttccatcgttccgctacgcgtcggaatcgacacatacaactggcctcgttaccagctgcgtcgcatcgccagactcgccatccccacctgcacggcgatcggaatctgctgcatcgtctccacaatcgccatgcacatggggtggaaagcggaagaatacgcaaacgcgttcagcacatcctcgccatcagcctggctacacaatctgctcacccaactcgacatgctttcaatgaccaccgccggcaccagagtggacggttccacattggcaatggtcgacctgccatcatggagcatgtgctgggaattgcttttcagcctcgccctgcccgtatacgtcatcatcgccaccgacatgcgattcgtggcacccattgcgctcgcatgcgtgctgttgtcggagtggacgcagtggccgccgttgcgtcacatggccatgttcgcgcttggcgtcgcgttggcgaaacggcttacggacaacgggcgcgagacgatgcgcgacgtcgttgccgtaccgctcgccctgtgtggcatcgtcttggtttgccaaagcggtttcggtttgctgcctggtattgtcgcccaacctttggccgtgtgcggatgcctgatattggtggtggtcgcacttacctgcaacgtggtatccgacctgctttccacgccacctgtccgttggctggggcgcatttcattcagcctgtatctgacccatcttcccgtccgcgactggattgtgccgtacattcccgtgcagggtctattgcgcccggtggttttgtttgcattgtgccttctggcagcggaggcgttctatcttgccgtggaacggcctgctaccagactgtcaaggaggctgggaaaggtgaaaagggaagcctgatgtatttcgcttgcgcatggtgctttaggcggaatcgccggtttgcatgaatgtcgattgagcgaccggtatacgcttcctgcgaggacatgttcggcatgttccgcggcaaggcgtgcattcggaaactgatccgcggaaacatgtccggccacggcaagtcagtcgccatcactttggaacatggcatccacggaagcgcgtacctgcccggtgtcctgtcgtggcccgtcaaataccatcagggagatggagttggtacgtagttcactcagcgagctcagcaacggacgcaccgccgcggtgctgcccaaagcgaccgtgcgcccgtcatcatcaaacggaacaggacatcctacatgtttatgagtatcaacagctatcagaatctcttcgaccgtcttgaggataagttcgatgcttgcctcgccgacgcccgcatagccgagaacgatggacgccgcaacaggcatggactctgatccgacgcagacggtattcgtggcatgtcaattgaattatgattcccttagtttcagattcgaaggaatcacttggagcgatttccacgacggttcggtcggcattcccgccttcgtgcgcgaaggacagaacgtccacatcaaagcaacagtggacaaatacaatcccgacagcggctttcccgtatatcgatgggttccgtgtttttccgaaggctcaggactttcggaaaaacacggaacccatttttccatttcacgagacttttggccgacatgtggaataccagcctggaaatgcgccgaaccatgtaatatcgcttgcggacacgggggccattatggctgagaggaagcgaccgcttcaaccgtatgaacgtataccggataatgccggcgcacggacgtctctctacttcccgtgcctttgcataagagaaaggcacatacctttatgactgaagaaaaccagtcttccgcagttcgcaaacccaacgtcaaatggcgtgtggtcgacatcgtcgtggccgcgatcgttgccgtcgcatccggcgtgatcttctgggcctgggacttcatctacgccgtcccgaccgccctgttcgacagcctcaccccgggactgggcggactcttccatttcatgtggctgttcgccggcccgctcgtggccatcatcatccgcaagcccggcgcggccttcttcggcgaaaccatcgccgcggtcatcgaaacgctgctgggcaatccattcggcgtggcgcacgcactgctgatcggcatggcccaaggactcggcgccgaaatcggcttcgcggtcttcgtataccgcaagtggaacctgctcaccgtgaccctggccggcgcgttgaccggcctatccaatggcctgtacgaatgggtcgtcaccgccggctggtcgacactgcaaggcgtcgtgttcaccgtctgctgcgtcatctccggagccgtattcggcggagcgctcatgtggttcgtacaaaaggcgctcgccaaaaccggcgtgctcgaccgcttcgaatccggcaaggccgacgtcgtggcctgaaccacgcaactcacaatccaacaacaaacatagaaaacatgccggccgtccgccggcgtatccaagaaaagagaaaatcatgaccaaccacgttccagaagcaacgaaacccgccagcggagactacgcttggctgggcgcggaagccggctccgtcgccgacctcatgtacatgctcaacaccgaggactggtacgacgccatcaactcgcgtttcgtcagcgagctgcttgacgacaccttgccggaatccatcctcaaggcgtatctgattcaggacttcaagttctataacaacggcatgatggcacgtctcatcaaactcgctccacgtcaggagaccaaggacatgctcgcggcgcaatcgcagtggttcgccgacaacgaggccacctacttcgagcacttcctcgaggcctatcacgtcagccaggaggaatacgacgcgaccgaaccgaccccggccaacaaggagtacggcgcatacctcgacagcctgtccgacaagagctggccggaactgatcaccgcgatctgctgcatggaatggctgtacctcgcatgggccaagcgcaccgtcgacgccgacgtcatccagcaggtgccggcgcacaagggctgggtcgacctgcatgaaggcgcgcacttccgcaagtgggtcggcgacctcatctccctggtcaacgaatactgctccatcgatggtccggaagccgaagtgttccgcaccatcgtgcatctggagcgccgcttcttcgacgactcctacccgcaggagtgagcctgcgatccacgaccgcataagccatgagccgggcgcgtacgatcgatgtcgtacgcgcccggctcatttgttgcggttccgtccggagcccggcttcctcgtgcgcgactgccgcgcgggggcggcccggctacagcgagatcccgtcgatgcggcggagctcctcgtcgctgaacgaagtgttcctaagcgcaccgatgttgtcgatcagctgctgtgggcgggacgctccgaccagcaccgaagccaccatgccgtcgtgcagcagccaagccagcgacatttcggcgagcgtctgtccacgctcggcggccagatcgttcaggtcgcgaatctgctgaagcctttccggcgtcaacgcgctctgctgcaggaatcgtccgtcatgcgcgattctgctgtccgccggaacgccgttcagataccggttggtcaacagtccctgggcgagcggggagaaagtgatgagtcccttgccaagacggtgcgcggtctccttgagcccattgcgttccacggtgcggtcgaagatgttgtaacggttctggttgatgatgaacggcacatgcatctcatccaaaatggcggtggccttctcgagtgtggggccatcataattggacaggcccacatacagcgccttgccgctgctcacggccgtggcgagcgcgcccatggtctcttcgagtggtgtggatgggtccatgtggtggtggtagaagatgtccacgtagtcgaggttgaggcgtttgaggctttggtcgagtgaggcgagcaggtatttgcggctgccgaggtcgccgtaggggccggtccacatttcgtagccggctttggtgctgatgatgagttcgtcgcggtggtggtggaagtattcgtgcaggagtcgtccgcagttcttttcggccgatccgggttcggggccgtagttgttggccaggtcgaagtgggtgatgccgttgtcgaatgcggtgaacacgatgcggcgcatggtgtcgtatggggtggtgtcgccgaagttgtgccagaagccgagggatatggccggcagtttgaggccgctttcgccggcatggttgtaggtcatgctgtcgtatcggtttggcgatggcgtatagacggtggtcggttcgagcatgttttctcctttgaatatgctgctcatgtcgtatccgcaatcaacatacacgtccgtttgtcgtgccgcaacattgcgcaatacaataaggcgcatcgcggtattcgatgcggtggtaggagagtggcccatgcgtgtggaacatggattcggtccggtttgggatgccggatcgcgcgtgttggtgttgggttccgtgccaagtccgaagtcgcgtgagatgcggttttattatggtcatccgcgcaatcgtttctggccggtcatggcggctgttttccatgatgatggttgtctgcgcgagtgccgggacccggaccagattgtggggttgcgtagggatttcgctttgcgtcaccatatggcgttatgggatgtgattgagtcgtgcgacatcgatggagcgagcgatgccagtatccgtaatgcggtgcccaatgatctttccccgataatcatgcgatcgaaaatcgcccatgtcttcaccactggcgcgaaagccgcgcaactgtaccgtaagctctgcgttccgctgcttcgggcgcatggattggacggcatgccgatgacgcagctgccatccaccagtccggcgaacgccaaagccgacctgcccggactcgtcgaagcgtacggatgcgtcgcacgctccgtttcgcaggcgtcgtaaggcgtttccgacggctgcagcattgtccgaaccctatttatacaatcgcggttgcgttgaaatccgaagcgtcctccactaatccgtctggaatggacgtttcccgcgaaaaccagcaaaacggaaggcgaaagatggcactgagcgccgcaatcatccttgccgcgggcgaaggcacccgcatgcgttccaacaaaccgaaggtgctgcacaccttggccggcaaaacgttcctgaaccgtgtcatggactccgtggcggcccttgaccccgatacgctcgccgtggtggtccactaccaggccgaacgcgtcgctgaagccgcacgctcctacaacgagcacgtcaccatcgtcgaccaggacgacatccccggaaccggccgcgccgtgcaatgcgcgatggcgcagctcacgcagaaggacgatctggacggcgccgtgctgatcgccgcatccgacatgccgctgctcgacactgacacgctcgaccagctgctcgcctttcacgagaaaagcggcaacggcgcgaccgtgctcaccaccatcctcgacgatccgaccggctacggccgcatcatccgcgacagcgaaggcaacgtgctgcgcatcgtcgaacaaaaggacgccaacagcagcgaactcgccgtacgcgaagtgaacacctccgtatacgtgttcgacgccaaactgctcgccgaagccatcgccaacctcaaatccaacaacgcgcagggcgaattctacctgaccgacgcgctcgaagccgccaaagccaacggagccgtcggcgctttcgccgcccccgacccgctaagcgtggaaggcgtcaacgaccgcgtgcagctcgccgcgctcgccaaggcgcacaacaagcgcgtgtgcgagcattggatgcgcgaaggcgtcaccatcctcgacccggacaccacgtggatcgaggacgacgtgcagatcgcacgcgacgcggtgatcctgcccggctgcttcctccaaggccatacggtgatcggcgaagccgccgaagtcggcccgtacaccacgctgatcggcgccaccatcgacgccgaagcgcatgtggaacgctcccgcgtgcaggagacgcacatcggccgcgccgccaacatcggcccgtggacgtatctgcgtccgggcaacgagctcggcgagggaagcaaggccggcgcgttcgtggaaatgaagaaggcgcacatcggcaacggcacgaaggtgccgcacctgagctatgtcggcgacgccgacctgggcgagcacaccaacatcggcggcggcaccatcaccgccaactatgacggcgtgcacaagcaccacaccaccatcggatcgaacgtgcacgtcggcgcgggcaacctgttcgtcgcccccgtcaccgtcggcgacggcgtcaccaccggagccggctccgtggtccgccacgacgtcccgtccgactccatggtctattccgaaaacacgcaacacgtagtagagggctggaagcccgaatgggagcgctgaacatgcctgcattgcaagattccatcgacgccatccgcatcgccgcagccgcggccgaccgcatgaaggccaccgacatcgtggcgttcgacgttaccgaaccattggccatcaccgacgcgatgctcatcgccagcgcctcgaacgaacgccaggtgctcgccgtcgccgaggaaatcgagaaggacctgtacctcaaggccggcaaacgccagccgcgctcccgcgaaggcctgaccgaaggccagtgggtgctgctcgactacggtgatttcgtcatccacgtcatgcaccaggaatcccgcgaatactaccgtctcgaacggttgtggaaggactgcccgagcatcgacctgcagctcgaacacgccgagggcgagcaggagccgacggtttccagcgaagcgtgatttttcatccatcatcgaaacgtgccttcccgaaaatcatgcggaaggcacgttttggtatgcgccgtcccagcaatccgaatacgacggcagacaggcaataaatcggaaagacaaccggcagataggtgagaggcatgcccagaaacgtcgaactcgaccatgatgagaccatgacgccacacgtgcgttccatcacactggtgcgccacggacgcaccgcatacaacgcgcagcacaggctgcagggacagatcgacattccgctcgacgaagtgggtatgtggcaggttcgccagaccgcgtccgcattgcgtgaactgtacgtggaccgtcatcccgaagcggcatgccagctggttgtctgctccgatctcaaacgcgcggccgccaccgcacacgcgttcgccgacccgctcggactcgacgtgcatcccgacgtccgtgtgcgagaacgcagcttcggcgattgggaaggcatcgccgtcgaagagctcgccaaacggttccccgaggattatctgtcatgggcccagttccgcggcggcgagctcaagtatggcgcagaaccgaagcagaacgtcggcaggcgtggtgtcgaggcgttgaacgattgggcgtcgaaggccggctccgataccgacctgtacgtgttctcgcatggcgcctggatctcgcagacgttgcagacgctgctgggattgagcgaagtgcatggcgatttcgccgacattctgtcgatgcgcaacgcgcattgggtgcggctggcgccgttggaactgcagggcgcgctgcggtggcgtctggtcgactacaaccatggtccggcgatcgccgacaccgagcagtgggagcatccgcagctatagccgccgacgaaaacgggggatgacgcgcgtcccgttcccaagttttttccaagcttttcacagaatcgcaagttttttcaaagcgtaatcggctaccgtcatgctctgtgaagaattttttcaagggcatatcgttttcatcgattttcgcgggcgcgcttgccgcggtgacctcgttcctgctgtccgcaaaaatcggcatcgcgggatcggtgattggcgtcgccgccggttccatcgtctcggccgttgcgacgcaggtgtacaagaacgtgctcaaggcgtcgggggagaagctgcaaaacgccgtaccgttcgtggccaacgacaaggacggtacggacggtgccggcaagagcggcgatgacgccaccacggtgatcgctcccgccgaatccaagggcgagcagaccaagacgctgtccgcggaggaatccgatgagaccacggtcatgacgtccgtggacggggatacgaccgcggcgatgcccgcaacgtcaggccgtgtcatctcctccgcgcaggccggaggacgcgaatcgaacatacttccggacaatgccggcggaagtatccagcatgctggacgccgggcgtcgtttgacgcttggctgcatggcaagcgtgcgccgatcgtcatcgcgatcgtcagcgcgcttatcggcgtggccgtgagcgccggactgatcctcgcgttcacgggcggacatggaaccgataccgtggtgcgtgacatggtcaacagcaagcagacgccgtcggatgacaatgccggcgattccacctacggcagcggaaacaacggcacgcaggacaatatgcagaaccagtccggcacgacggacaccgataaggattccaccacgaactccgacaggaacaacggcaaggacaccgggaagaagacggattccacaaccggcggcaccggaacgtccaccgacggctcggactcgtccaccaacaccggagacgattcgaacaagacggattcgtccacggactccactacgccatccgacggatcgacgtcaggcaccaacaattcgggacagtcgggcgcggggacgaccaccacgccgaatggttcgacatccacgaaccagaatccgacgccgaacggttcgaatcccaatggcacatcatccggcacgtcaggcaatgggacggacacttcgaaatagcctatgaggcatgcggccggggctttcctcgaccacgtacccgacacgccgcgaattgcatgattctgctctgtgttgtatcttatacaaggtttgcagagcagacattggggctatggcgcagctggtagcgcatctccatggcatggagagggtcaggggtttgaagcggcggcgtgctactctcccacaccctctcgagtgcagtaccatcgccgcgcctggccttagctaccgggttcggaatgggaccgggcgtctcaccagggctatgaccaccgcaaaaccgcgatcacggaacgacagccaaaacatggcggccattccggccattatgttatgaaccgtggcggtttgggaaccggctagcggacgcgaggcaaagcctaccgttgtatcgttcagtgaccatcccaacgcatattgccgtccaggacgatccagcacaggaaagacgcggaaccaaccctccacaagggaaggatcggaatgttatgtcgccgtcgcccgttagtaccggtcggctccacccctcacgggacttccacctccggcctatcaaacacgtgttcaacatgcgggctacaggatctcgaagatccatggaatcctaatcttggagcaggcttcccgcttagatgctttcagcggttatccctcccgaacgtagccaaccggccgtgccgctggcgcgacaaccggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgctcggaccgtcgtcctcgcagtcaagcccgcttgtgcgattacactcgacacccgattgccaaccgggctgagcggacctttgagcgcctccgttactctttgggaggcaaccgccccagttgaactacccgccaggcactgtccctgacaaggatgacttgtcgaggttagacgtcaaacgagaacagagcggtatttcaccttgcggctccacgaatgctggcgcacccgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgctccgaagagttgacggatcctcttaaccttccggcaccgggcaggcgtcagtgcatatacagcggctttcgccttcgcatgcacctgtgtttttggtaaacagtcgctaccccctggtctgtgccacccaccaaagctccccgggctagccggttcaccccagcgggtctcccttataccgaaggcacgggagtgatttgccgagttccttgaccaggattcgctcgatcgccttggtattctctacctgaccaccagtgtcggtttggggtacgggcggccatggccctcacgccgaggcttttctcgacggcctggacaaccggatatcgagccataacggctcccatcatcacacctcgccatgcgcgccatgcggatttgcctacatgactggctgcgtgcttgaccacggaaaaccacctccgcggccggctcccattccgtgtcacccctgcgctgacctactgcggctacgctcccaacaccacgcgacgataccaacccgaaggaaggaaccaccacgaggcggaggttagtactcaccgtctcggttttgccggtccatggtcggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccacgaagtccacggccggtttccaccgccgcttcgcccctcgcaggacgctctcctacccagcaaccatgaagattgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtctccctctcgacgacggagcttatcccccgccgactcactgccggaatacacgtcaacggtattcggagttcggctgctgttggtacccaacaagggcccgcaagcatccggtagctctacccccgcgacgcaatcgaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccaggacaagcgactaaaaacgccttttaagactcgctttcgctacgcatacgccacacggcttatgctcgccacccgccactgactcgcagactcatttttcgataggcacgccgtcaccccacaaggaggctccgacggtttgtgggcgcacggtttcaggaactgtttcactcccctcccggggtgcttttcacctttccctcacggtactggtacgctatcggtcagacaggtatgcttagacttacccaacggtctgggctgattcacgcgggattccacgaggcccgcgctacttgggacaacacgatcggaagacggctcacgtccaggtacggggctggcaccctctacggccaggccttcaagcctgttcccctggcaagccgttttatgactcccgcccggcccgtcggaaccgggacacgtgatcccacaacaccggcaacgcaacccccgacgggtatcacgcgcaaccggtttggtctgatccgctttcgctcgccactactcacggagtatcccttcctgcaggtactgagatgtttcacttccctgcgtaccccccgcccataggcggtgccggcccatgacggccggcgggttcccccattcggagaccctaggatcaaagccatgttggaggctcccctaggattatcgcatcctcaaacgtccttcatcggtactgtctgccaaggcatccaccatacgccctcgcaagcggcacaacagcaaaacaaattgtcattgccccacccgcgggtttcctgatagcaagatcgccagacgacaaatcttaacactaaaatgatcacaaaacgatcgatctcgaaaccaaactcaattgaagagtttggcgaaatcgcgataagcaaaaagaaacgttctttcagtttctcttgctcgcgtccactatccagttctcaaaccaccacgcgccaccaccctcacccgaaaccaacaaaggaaaccaggctgacgatgatgggcatcgaaccgcgccacagaaaacccgtggggtggcggtccgggagcccaaaagcatacccataccactcccggacatcccgacgggacatccaagcccatgatctcttccacaccagcatccccatgcgagaccgtggaaccattccacgggcacggggctcacaccggacacggaaccgtgtcctgaaattctccgtagaaaggaggtgatccagccgcaccttccggtacggctaccttgttacgacttagtcccaatcacgagtctcaccttagacggctccccccaaaaggttgggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttaagggatccgctccccctcacgaggtcgcatcccgttgtaccggccattgtagcatgcgtgaagccctggacgtaaggggcatgatgatctgacgtcatccccaccttcctccgagttgaccccggcggtcccccgtgagttcccaccacgacgtgctggcaacacagggcgagggttgcgctcgttgcgggacttaacccaacatctcacgacacgagctgacgacgaccatgcaccacctgtgaacccgccccgaagggagaccgtatctctacggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacggagaccgtggaatggtccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcaccccgaagggcttgctcccagtcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgaagccatggtgggccgttaccccgccatcaagctgataggacgcgaccccatcccataccgcaaaagctttcccagaggaccatgcggtcaactggagcatccggcattaccacccgtttccaggagctattccggtgtatggggcaggtcggtcacgcattactcacccgttcgccactctcacccaggagcaagctcctgggatcccgttcgacttgcatgtgttaagcacgccgccagcgttcatcctgagccagaatcgaaccctccacaaaaaacctcgtgaagagacatcgacacgatgactctcgaaataagaaaattgacgatcgccttataaggaaaggcgcatcgcacaaaaacctcgccgccgtttgaccgatccctcggcaccacgcgtcagcgtggccggcaacgaactggcaatcattgactataaagaagtagtacaaatacgctcttgagttctcaaaccaccacccaaacgtttgacgaagcagttgccatatgctatcttgaagccatgttcgcttttcggcacggcagctgaaatccgagcaggcgcaagccaaaacaacatcggaagcgatcgatgccgcgcggcagcggcaccgcgaagagaaaagagaatcaaaatggcaagtaaaacacgttctgtatggaagaatccttcctatctgcagagctccttcggcattttcatgttcttctgttcctggggcatctggtggtccttcttctcccgctggctcactgacccgacccacggtctgggcatgagctccgcggaacagggccagatctactccatcaactccttggccaccctggtcatcatgttcgtttacggcaccattcaggaccagctgggcatcaagcgcaagctcgtgatcttcatctctgcggtcgctgcatgcgttggcccgttcgtgcagttcgtgtaccagccgatgctgaccgccggcggcaccacccgattcatcggcgtgcttctcggctccatcgtgctgtccgcaggcttcatggccggctgctccctgttcgaagccatcaccgaacgttactcccgtaagttcggcttcgaatacggtcagtcccgcgcttggggctccttcggctacgctgtcgtggcactgtgcgcaggcttcctgttcaacatcaacccgctgctgaacttctgggttggttccatctgcggcctcggcatgctgtgcgtctacgccttctgggttccggccgagcaaaaggaagaactcaagaaggaggccgatccgaacgcggctccgaccaacccgtccttcaaggaaatggtctccgtcctgaagatgccgactctgtgggtgctcatcgtcttcatgctgttcaccaacaccttctacaccgtgttcgatcagcagatgttcccgaactactacgcctccctgttcccgaccactgaaatcggcaacgccacctacggtaccctgaactccttccaggtgttcctcgagtccgccatgatgggcgtcgtcccgatcatcatgaagaagatcggcgtgcgcaactccctgctgctcggcgccaccgtgatgttcgcccgcatcggtctgtgcggcgtgttccatgacccggtctccgtctccatcgtcaagctgttccactccatcgaggttccgctgttctgcctgccggcgttccgttacttcaccctgcacttcgacacgaagctgtctgccaccctgtacatggttggtttccagatcgcttcccaggtcggccaggtgattttctccaccccgatgggtgctctgcatgatgccatgggcgaccgtccgaccttcttcaccatctctgccatcgtgtttgcggctctggtctacggcttcttcgtcatcaagaaggatgatcaggaagtcggcggcgatccgttctacactgacaagcagctcaaggccatgaaggccgctgatgcggaagtgaaggcctgagtctcagcccgtactaagtcggcgtacggcgtcgatggtggtcgcaacctacatcccttctcccgcgatcatcatcggtaccgtacgcatcataacaacaatcgtggtgtccgaagcgtttccctttttccgctttgggcaccatcttcaaaaagctttttatccaacaattcataacccagattcagaaaggcattcaacgatgactggctttactccggacgcacctgtccttcacgaaatcaagaaccacagcgaggaactcaccaaggcagaggccggtgtcgcggccttcgcagccaagcgtaacaaccgctggtatccgaagttccacatcgcatccaatggcggttggatcaacgatccgaacggcctgtgcttctacaagggccgttggcacgtcttctaccagctgcacccgtatggcacccagtggggtccgatgcattggggtcacgtctcctccgccgatatggtcaattggaagcgcgaaccaatcatgttcgctccttccctggaggaggagaaggacggcgtgttctccggttccgccgtggtcggcgatgacggcaagctcaagttctactacaccggccaccgttgggccaacggcaaggacaacaccggcggcgactggcaggtacagatgctcgccgaaccagacaacgatgagctgaccagcgccactaagcgcggtatggtcattgattgcccgaccgacaaggtgaaccaccactaccgcgacccgaaggtctggaagaccggcgacaagtggtacatgaccttcggtgtctcctctgccgagaagcgcggccagatgtggctgttctcctccgacgacatggtcaagtggacctatgagcaggtgctgttcgagcatccggatccggacgtgtttatgctcgagtgcccggacttcttcccgatcaaggacgtcgaaggcaacgagaagtgggttatcggcttctccgccatgggtgccaagccgtccggcttcatgaaccgcaacgtcaacaacgccggctacatgatcggcacttggactccgggcgagcagttcaagccggaaaccgagttccgtctgtgggattgcggccacaattactacgcgccgcagtcgttcaacgacggcaagcgtcagatcgtctacggttggatgagcccgttcgtcgagccgattccgatgcaggacgacggctggtgcggcaacctcaccctgccgcgtgagatcacgctgggcgccgacggcgacctgcacaccgcgccggtggccgaaatggaaggcctgcgcgaggataccgtcgatttcggtgcgatcgatctggacgtcagcggcgagaagaccattgtggacgatgccgaagccgtggaaatcgaaatgaccatcgacctggccaactccaccgccgagcgtgccggcctgcgtgtccacgccaccgaggatggcgcctacacgtccgttgcgtatgacgatcagatcggccgcgtggtggtcgaccgtcaggccaacgctcagggcgatcgcggctaccgtacggcaccgctgtccgaagccgaacttgccgccggcgaactcaagctgcgcgtgtacgtggaccgtggctgcgtggaggtgtacgtcaacgacggccgtcaggcgctcagctcgtacagctacgcgtccgaaggtccgcgcgccatcaagctcgtggccgaatccggcacgctcaaggtcaagtccctggtgcttcaccacatgaagtccatcggactggaatgatagacgtctgtcatgattgacaggcaaacgaccataaggcagtagcaaggggtatatgggaaggcctccgcatcggaagggtgcggaggcctttctatatctgtctctctatgtctaaagtgatatctgggatggtatccaacgcacgttatctctcgttactgccgtacttgctgtgcgggtttgcctacgttccgccccaccgtctatactggcgagccggtaacaatcttttctggccgattggcgagcaggctcctcaccttactgatttcccgcagtcggtcacgtgcgcgtccactttgacgcagaaagcaaggtgaacgatggcggaatcgcacgttcaacgcaaactgcttgacatgatgaaacgtcgtattccgacagtgatcgccatcgtgttgctgctggcggtatgggaggcatgggtacgaatagggcatgtgccgtccacgatgatcgcctcccccagtgagattgctcaggcgaccgtcgaaacctggccgacactctggcccgcgacacaggtcacattgctggaaggtaccgtcggtttcctgcttgccgtggcatgcggcattttaattgggattctgctgtattgctcccgtgttgcgaatgcggcgctgttcccgttactgtcggccgcgcagacgatgccgttgatttcgatcgcaccactgttcctaatctggttcggtttcgagatttccggcaaaatcgtaatcgtggccgtattcggcctgtttccgattgcggtgcagacgattcgcggactcgaggcagtcccccagttctattcggatgtggcgctgacatgtggcgcaacccgtacgtggacgctgtggcacgtgaagctgcgcgtggccgcgcggcagatctacggaggcatccgcgtctccgccgcctatatcttcgccaccgccgccacggcggaatacctgggcgcgcgcaagggcctcggcatctggctgcaggccgcctacaactcgttccgtacgccgctcatcttctcggccacactggtgatcatcgccatcacctgcgtgctcatgtgcctagtgaacctgagcgagcgtatgctgctcggccctgccagcgatgacgaggatccagacgccggacagtgagcagaccaccatctgcggcacaacggacggaggaacttccaaaactggcatcatgcgacgtttaccctgacttttctgacgtttacatgaactcgtccggcagtaccgcgctttattacaagaatgaaatacacaagggcaaacgccgccatgcgccaagatttcggagaaaaccaatatgttatttttgaggcttctgtccttggatcccgaacgcccctttggtgctccccgcacatgcggggatgatccccatgagtaaggaaacactcgaaccgccactgcgtgctccccgcacatgcggggatgatccctgctcaccggcgaattgatggatattaaagctgtgctccccgcacatgcggggatgatcccgctttggcctcgcagttcggccatgaggtgcggtgctccccgcacatgcggggatgatcccgatagcctgatacgtgccctcttggtctgaaagtgctccccgcacatgcggggatgatcccgttcatcatcggcaccgtcgctttcgtgatgggtgctccccgcacatgcggggatgatcccacgatcgcgggcatcaacgcgcaggtgcagcagtgctccccgcacatgcggggatgatccctgcacgatggcgaaatacggcctgccggtacggtgctccccgcacatgcggggatgatccccattggacgcgcacaatcttacccaagtcggtgtgctccccgcacatgcggggatgatccccgattacggtggtcagaaacagctgttcgacagtgctccccgcacatgcggggatgatcccgacggcatcctgcgttgcggacttgatgaaacgtgctccccgcacatgcggggatgatccctccaattcattcacaaaatcactatcaccatagtgctccccgcacatgcggggatgatcccccgacgtgcacctcgaggtcgccggcgtcaaagtgctccccgcacatgcggggatgatcccggacggtcctgctggtcgagcgcgaccagcacgtgctccccgcacatgcggggatgatccctgcacgctgccgcagttgcggttggcgacgatgtgctccccgcacatgcggggataatcccacgcgaacctcagccgcccactgaccttgagcgtgctccccgcacatgcggggatgatccctgttctgcaatgcgccgaaggacgcgttgaatgtgctccccgcacatgcggggatgatcccgtgtcgcgtggcgatcttgtgcaggtggtgtcgtgctccccgcacatgcggggatgatcccgccgagaccatcaagaaggccatgaacgacaggtgctccccgcacatgcggggatgatcccacatggctccgcgaccagtgggagacatgggcgtgctccccgcacatgcggggatgatcccggtagcggaaccgctagcgaaacgtctggcaagtgctccccgcacatgcggggatgatcccttggctccctggatggtcttgttgacgccggaatcgcgcaggttcagcgcatgggcgtggccctgggaaccgtaaccgaggatggccaccttcttgccatcgaacacggacagatcggcgtccttttcgtaccagatagttgctgccataattggcgctcctttattgttttttgcgattcggaacttgctttttccgaacaaactcgctattttctattcttttttcggttgttatcacggcgagtgattcctaggatgttgctccccccggattgtgtccgaggaaccactccgcctctcctgcggaactgttctagtaccgctttctttatgatgtctgttggcgttcacatagtggctatattcacgtcaaacgttttttctaaggctccgagccaccccaagcgaagcagcccggcaagccggtcggcgtcacttggtgaagtcgacgttcttcgtttccttgcagctcaacaccgcgatgaggcagcacagggccatcacaccgaggtacaggcccacggaatgcacgccccaatgatgggacagccaagtggcgatggtcggcacgaaggccgcgccgacgatggcagccaggttgtagccgatgccggagccggagtaacgcacgttcgcgtcgaacagttccggcaggaaggcgccgatcggaccgaacgcggtacccatcagagcgaagccgatgcacaggaacagcaggttggtggcgaagttgcgctgaccgacgaccgccgggtcaagcaggaacgggaacagcagggcgaacgcgataaggcagcaggaggagatgatgatcacgcgcttgcggccgaacttgtcggcgttcacgcaggagatcacgatgaacgcggcgaatacgcagacggcgatcatcagcatgagcagatactcctggttggtgaagcccaggttgccgccaccctgctcgacggtcttggtgccccaagcgagggaccaggttgccagcgtgtagaacagcgtgtaggtgacggccaccaggaacgtggcctggatgacttccttccagctcttcttgaacacttcggtaagcggggacttgacgaccttcttctgctcctgggccatacggaagatcggggtctcctccatctggacgcggacgacgaggccgacgatcacgaggatggaggacagcaggaacggcacgcgccagccccaggcaagcatcgcgtcattgtcgttgaaggtctccagcaggaagtaagtgccgttcgacaggaagaagccgatcggggcgcccagctccgggaaggagccgtacagtgcacgcttgtcttccggagcgttctcggtagccaccaaagcggcacccgaccattcaccacccagtccgatgccctgcacgaaacggcacaggcacagcacggcgacggccgcgacaccccattggttgtaggtcggcaggcagccgatcaggaaggtggcaatgcccatggtgagcagggagaccaccagcgtggtcttgcggcccatacggtcgccgaagtggccgaacaccaacgagcccagcggacgggcgatgaacgcgatggcgaaggtcagcaggctggccagcagcgcgacggtcggattggtggtgtctccgaagaacaccttcgggaaataattcgcagcggcggtgccgtatgcgtaaaagtcgtagaactcgatggcggtgccgaccatggatgctgcgatcacggttttgaccgaatcgcggaccatcgcctgcgctttgccagcggccgcttcgactgtactcattgatgtactccctgtacgtcctgctaccggctcccaacttccgccgataacgatgttgtttgtagtttttctgttttctgttgtgcgctatgccggccggcttcaaaaggttttcgctgcgtctgccttgtgggctgcaacaaaaagaccccgcatcatgcagggccatcaacgtgtgtgttacgcgcgcctcaaaccctgccttcgttggcgagggattgaagccgcaatgctcgaatcagtccgccaacgaaagcggaataataattcgtgcggacagcagtacgcgtgcaaccattccgttcatcttggcgaacctcctttcgcaaagtcttttccccgggcgggatttccgctcgaactaagccgtaaacataggcgcgtccatctcccctatccactaaaggttcactatgtggacgcgccgtttcgctttattttccaatcattggcgatctagcaccgtcatagtcgccgtcattgttgcgatttcaaccgcaatgtcagcagacccgccaacagcatcgaaacagtggcgacagcgaagatcagcacggtggcaccggtcgccacaatcaccgcggcgcaggcagcgacgcccagtatcgtgccgaacgtattggccagactataagcggcaagcgatcggcccacggaacgcacatccggcagcatcgcaagatccaagctttggctggcgccatcgaacaccacgtatgcgaagccggcaagcagggcgtacagcgcaaccgccaggaaaccgtcgtccatcagcaacggcagcagcgcagcgaccatgaacaacacggcggacgcgacggccggaatacgcagatcgccgaacaggctgacgatgcggccaagcagcaacgccgcaatcaaagcaccgacaaacgtgcagatggccatgaccacaaccaccgatccggcaccggcaatgccgaacaaaccggcctcatcggtattgccgacgatattcggcgccagataccactgatatacggcgattccgactgtggccgcaacggcgaacatgcgggccgcgaatgccacagaaaacttcggcgcgttctgtggcggacggtattgcgagaagaaatcgcctttctcaacatccctacgcggcaggtagctgctggccccttcgaacggcagtaccaacagcgtaacgacggccgcgacgacaagccaacccgcgaataccagcatcgcgaaacccgtagtgccatcccaaccttcgccaccggcatgcggcgtcagcgcaacagccacggcgacgccgaccagctggccaagcgccagccccttgccgtgccaggaatcggcgcggtcgcggaacttgtcaggcacacgttcgccgaacgcggcggcgaacggtatggccgccatcgcatacgcggcctgcgtggccagccagaagaacacggcccacgggagaaaatcgcatgcggaaagaatcgccatgcagatagccgccaatacgctgccgctgacgatccatggcgtacggcgcccgaaccggcagtaggaatggtcggaaccgacggcgatgcatgcgttcagcaggaacgtcatgatggcacctgcgatgacgagcatcgccaaatccgtgacgcggttgattcccgacaaacggctgacggtttgcggaatgagcaccgtgttgaacgccgccatcggagcggacagcagcattgagccaagcgcaaaacccgcaacgagccggttggcctgcattgcggtcggcctggtgccgtccggagcggtcatcgggtcgcgcaggtcgaggaaggacgattcgaggttcggcacagccacgtcaagatgcgcggccgcggttaggggcgctccaccttccgatgcgatgcgcgcggcctgggtttccggacgctcgttggacgcttccggaatacgcggatgctgctgcaccgacagccggcgcatggccgccttcgcttcgggagtcagggtcttctcataatcggggcgatcgtcgatgcccgggcggatgaacacctggccgggcagcggctgcggtttgaattcgttattctgattgtcttcggtcatatctgctgttttcttggcttatcgcgtttcatgtgcttcgatactccacgcatgcgcccgcccgctacgagcgacacatacgaaaatcgcccggacgcattgcttcagcgcattcgggcgattcttcaacgcaacttacgataccaacacgtgcggccactgccgtccgcccgacggaccgggtgcgacggaccgggtgcgcgaccgcaaggtggaacgcaatcgcaaggccgtacgtaatcgcaagaaaatacgtaatcgcaagaaattttccgtcaggcgacgacaggcggattggcgatcagatcatccgaacggtggtctcccgcggaatcctcccattccaacatggcgaccggcgtagtgttgtccacaccgagaccgcgcttcggctcgaacgtcagcgtggcctggctggtttcgccgcgccaggtgaagctgatggacgtgtcgtcatcggtggtgtacgagaacgtgccgtcgaacgcgtcgagctcgttgcggaacttggcgagcgcgttcagggccttaacgaccggacgcttgagattctcgtcgatttccgcggtggagtagtaatggcgattgatgtcgcggccgttattcgtcttacgcagcagctccatgtcgttcttgccggcgagcgcgccgacgtagtagacctgcggcacgcccggcaggaagaactgcaccgcgcgggcggcgatgtagtgctggtcgttgcacccgagcgccgaatagtaggtgctgttgacctggtagaggtcgagattggatgcggcggcgccagtggctgcctgggattcgccgtgggtgttggcgtggatggtgttgacgagattgtcgacgtcctcatccggcacgagacccttgagcgagcggtcgagctggtcggagccgatgtcgatcacgccgatgccgtcgtgcgtatcaagcacggtgacggcgttgttcgggcggatgtcggtccagtgcgccactggttcaacgtgaccggtgaacagcgagtgcagcagcagcggaggcagggcgaagtcgtagacgcggtccaccttggatgcgatttcgacctgcttcttgtagtaggagtgcacttcgatgaggatttccagaccgcgcttgacgccttcctcacgcagacgggagatcagcttgaaggtcttcggggtcatgaagcagctggtgccggcttccttggcgccatagccgacggcgtcgaggcggatgtagctgacgtgagaggcggccatctggtcgaaaatcgacatgaggtattcccaacccttgtcggaatcggtgtcgatgtccacctgctgcggggtgaagctcacccataccagtcgcgtcttgccggcgaacttgtagtgggtgaacggcaggcccggacgcggacggtagatgccggccaggtcctcttcggtggcgccgttcgggaacacggagctcatggtgaggaacatcggatagtattcggactcctcgcccttggccagcacgtcctggaactgcttggattcccaactcatgtggttgacgatggcgtcgaccatgatgttgtgggtcttagagagttcggcgacgtcgtcccagctgccgagacgttcgtcgaccttggtgtggtcgatcgggtcgaagcctgcatcggcgccgtcgaacggggtgaagaacggcaggatgtgaacgccgtcgtacacgccgtcgaagcgggtgcgcagaatgtcggtcatcgacttgatggtgccgtcgccaaggcggtcggcgtaagtgatgagctgcaccttgtttttcatggagcctccttcggttccaaaaagtcgttgcgagattctttgcgggagtccttacggccattcccacggttgtgtcgaaccggttcgatattaccgcaaaatggggctcgacaccaaaaccgcaaccggtgttcgggcgtgtcgaaccggctttcggccgaatcgcggcgcatgtctccggcgcccgattcgaaagcgacggacatgcgggggcagccgcgagcgcagggccctcagccttgggcacaggacttcagctgcgggcgcagtccgtaagctggccgacctgcttaaagtaacggtcgggttcgaggccgtcgacggtcgccacgttcgtcatatgcacgccgtcgaggccgccgtattcgacgatctggtacatcacgtccgccttgagttcgtcgggggactcgtccacatagcggcgcccgaatccggccaggtcgcggtacgccacatgcgccccgaccattaccccccgcgacgccgcgtatgacaacgttctcagcatgacggacgggtcgcccgcatggaagccgcacgccacgttcgcgctggaaaccacgtcgagcagcgcctcgtcgtcgccgagcgtccaacgaccgaagctttcgcccatatcgctgttcatatcgattcgtatagccgtctgctttccgtctgtttcctgcacagccatcgtttccattccttccgtcgcctttccgtcgttctaccgtcgcagcgttcttcagccgcgacgtcccttctgccgcagtcgccgcagcacgcatctcatgccgcgccccgcaacctgccgctcggcctcacaccatgtattccaaatcgcgtttgctggtgatgaacatgtgccccggcgcgtgcgtgatcgcgaattccggtttggacgccatcaccgcggcctgcggggtcacgccgcacgcccagaacaccggcacatcgcccggctccaacacgggggcatcgccatagtcgggatgcatgatgtcgtcgatgccgatcgaggacgggtcgcccacacatacgggggcaccgtgcacggacgggtaatagccggaaatccggcatgcgtcggccacctgcgtagacggaatgccacgcatcgacacgaccatcgtcgaatggaacgcgccggccgaacggcactcgatcgacgtgtcgtacatcggcacgttgcggcctgccgtgatgtgccgcaccggcacgcccgcctccatcagcggaaactcgaatgtgaaactgcagccgatcacgaacgtgaccaaatcggatcgccaatactcacgaatatcgggcacttcggctaccagttcgccacgcttccacacgcggtacaacggcacgtcggtacggatgtcggcgcccggcgcggtgacgggtgcggtgacgcccggctccatcacttccagcagcgggcagggtttgggattgcgctgcgcgaacagcagaaaatcgaatgcctgctccttgggcagaatcatcagattcgcctgcgcgtagccttgcgcgatgccgcaggtcgggcggaccaggccgtcacggaacgcggcgcgcgcctgttcgggcgtgctcgccgcgccaagttcggttgttcccatatcggacatcccatccaccattgcgcttacctttcccgtcggccgccgtccggccttttccgaacgaactgccgacgaactccgaaatccgattccgcagaaacggacgttcagagtcgctttccctcaccttggtcgccgaacgttacgggagccgcgcgattcatgacgcgtatgtttccgcattgcaaattggcggtgccaagtggaaacaaaccatggttaggttggacgccgaagacgcacgcgaacgctgacgcaacacaacagcgcaacagcaataaagcggcaatcaaaagacgcggagcgcggaagagaggttcccatgagttcgatcgttctggcagtcggtaacggcaagacgctattcggaggcgcaggcgtggcacccgacgcggatctggttcgtttcgtcgatccggaaagccccatcatcaacgcgttcgatttgtgcgcgctgcgcggcgacggcattttcgaagcgaccacggtatggaagggtttcccggtttcgttggagaaccatctgaagcgtctcgccaattccgcccgcctggtggacatgcccgagccgaacattcccgcgctcacccgcgcggtccagctggtcatcgaccagtatgacgatccggaacccggtccgatgctgcgcatcatcgtctcccgtggtctcgatccggacaccggcgtgggcaaggcggccgaccgcacgccgaccgtctacatcttccttgacgcgaagggcacgctgcattcgctggagccgatcaccatggcttcgatgacgcgcggctacccgtcggacatcaccgcacgcgccccgtggctgctcaacggcgcgaagacgttgagctacgcgttcaactgcgccgtgcaccgcgaatgcgcccgccgtggcgtcggcgacgcgattctgttcacggaggacggctacacgatggaatgcccgaattcgtcgatcgtggcacgctatggcgatacgttcgtcacgcctgatccgcgtatcggcatcctgaacggcacgtcgcagcgcgaaatgttcgcctgggcgcttgaagaaggcaagaaggcggagtacaggaagctgccgatcgccgagctgcgcgaagcggacagcctgtacatgacgcacggcggatggtcgattccgatcagcgcgatcgacgggcgcgcacttgccgtggatgcggcggaaatccaggcgatcaacgatgcgatccattcgggccgcacgcacgaggacgcgttgaagatcggtccgaccggcgattacgaataaggcgaaacgacctgcttagcaggtgaaacggcccgtcaaatgatgggcgatacggaccgcttagcgggtggtatcgcccagtttgagcgtcacgggaatcagcacgtccggctcgtacggcttgcgtcccgtggcgcttgtcgcatctgccttggcatccccttccttggcgatcgcacgaacgatattgccgaccgcgacctgcgcgattttgtcgaaattctgcgccaccgcggtcattttcataccggccaggtcagtcagatacgtgccgtcgtaggcgatgatctgcaggtcgcgcggaatcgaaatatgcctccgcatcgcttcgcgcacgcaaagcgcggcaccgatatcggagctgaccacggcatcgacgccgtccaccggcatacggttgagcacagcattcaccgcgttcttatacccttggaaatcctccacattgccggcttcgacgtactcgtaccgcacgccggccgccttcagcgcctgctccagcgcaaggtagtagcggatggtggggaacgtcgtcttatgcagatcgaaatcgtctggaacatcaccttgcgccgccaaatcgaagaactggtcgcgcgggccgccgatcatcaccacgtggtgcgcgccggtgttgaccagcatgtgcgccataagccggccgccctgctcatggtcggagccgatcgacgcgatgccgccgcccagcacacggtcgaaggcgacgatcgggcggtggatggacgtccagtaatcgttcggatgggtggtgtgcgagcagacgatgacgccgtccatcatgcggcggcgcagcatgtccacgtattcggcctcgccattttccgtatcggcggtggagcacagcatggtgcgcaggccgtacacggcgagctcatgctgcagatgcgcggcgagggtggcgaaaaacggatgacggatggtcggcacaatcacaccaaccaggttcgtgcggttcttgtacaggttgcgtgccagctcgttgggcacgtaattgagctctttcatggcggctttgacgcgcgcgcgcatgtcgtcggacacgtagcccgtcttgttgaccaccagcgaaaccgtgctcagcgagactccggcctctttcgccacgtcgcgcatgccgaccattgcccaacacctctcccccgcatcgtcgggatgtttccttacaaatcgcgatattatgtgttattttacatgcatctgtaacgtttctttgcaatcgtccgcacaatatgaactatcaattgacgaaagacgccctccccctcttcaattcccccgaaaaatccactttttcacccgtgaacgacgtatgtttcacgacgcgttccacgcatcttccacgcacgctccgcatgtactccacacgcgttccgcccgcaaaaggggcggtgcgacacttgcgatcatctcgcttgcgtcgcaccgccccttgcgttgcgtggcctggccgtcagccgtcacgtccggccatcacgtcagtccgcaccacggacgaaccgaccgtcatgccttcggtacggaaccttcctgggagtggtcgaagaccggcttgttgtcggcgtcgtacttatagacgccgatggaagccgagctcggatcatgcgcgtcgttgaacgcgccgatggaggtctggcccttgtactgaatctccttgccgtccttcagcagggcgaggcaagccttgtaggaatcgcattccttgcccttggtggagccggagacggccataaggttcttctgcacggtcgtaccgtccgtggcgccgcccttctgcgcggcgagcgcggccagcacgatcgcgtcatacgtttcggcggtgtacgtgaaatcggtgaccttggcgttgaaggacttgacgttcttctggaattcctcggtcgggtgggcacctggaatggtgccggtggagcccttgagcaggcccgcgtcgaagtcggcggaatggtcgacggtgttgccgtcggtcatgtacagcttgtgggtgtcgaggccttgggcggcgagctccttgacgagcggcacggtctggtcgaaggcgatgacgagcgtcgcgtcggggttggtggccttgatggccgtgaccatcgatgagaagttcgtttcggtcggatcgaacgtgtccttttcgccgtagacgacgttcacgcccgcgtcttcgacggttttgacgaccacgtcacgcagggacgtgccgtattcgtcgttgaagaccgcgatggcgaggttcttcacgccatcctgtgcgatgatctggcccaggaccgcaccctgcaccgtgtccggcggaatggtgcggaagaagtagtcgctaaggccggagaaggccgtggacgtggcgcccgaagaaatcatcggcactttggcggacgtgacctgcttgtaagtgttcttgaccacggagctggacggcggaccgaccacgacggacgggttcttggcaagcaccgactgcgcggaagacgtgttctggtcggcatggtccgcgtcggacgtgtcggcggacgtgatttcgatgtctttgccgagcacgccgccagccgcgttgatgtctttctgcgcgagcttcatggtggcgatgttggcggggccgaggtacgccatggaaccggtcagcgggaacaggccggccgccatgaacgtatcggatttcgcgctgccggacgagccggacgcagccgaatcggccgtgccggacgaaccgcagccggcgagcgccatgactgcggcggccaccatggcggttgctgtgatggacagtttcctcatgcccttcatgttgatcttcttcatttgaatcaccgtttcctctcttggctccgctgattgccgaacccttggtgacgattatcgagatgtgttgctcgaccatcttgaatcgcactataagtgccgaggaaaccgaatgtgtatgcgtgaagttaaccgaaggtgaagcccgaaaactgttggaaacacaaggttttgagcttgttttcaggcatgccgaagccactgtcgggcagtgtcccaacagcggtaatcggaattgagaattttgaatcatagggggaaatcgcggaacgcgtgcggagaccgccgtccgagcccgaaggcgtacgaacgtacgtcgagcggcaaggaaaggcggtatacgctccgttccgcgatttcctgggtcctaccttccttcctcttgaacctcttcttccaggttgcccaggtagagggagacgactttcggatcgttcatcaggtcgcggcccttgccggagtaggcgttgcggccttggtcgaggacgtagccgcggtcgcagatctgcaggcagcggcgggcgttctgttcgacgatgaccacggatacgccggctttgttgacttggcgcacgcggatgaaggtctcgtcctggagcattggggacaggcctgcggagggctcgtcgagcaggaggacggatggtttcatcatgagggctcgggccatggccaccatctgacgttcgccgccggaaagctggccggcgagctggttcttgcgctggccgagtttggggaagatggagcacacgtagtcgaagcgttcgttgaacagtttcggtgcttggaacgcgcccatgtgcaggttttccgcgatggtcaggctggggaagacgttttcggtctgcggcacgaagccgacgccacgggagacgagtttgtcggcgcgcaggttggtgatgtcctcgcctttcagcagcagcttgccggagtggatgtgcaccaggccgaacaatgatttgagcagggtggatttgcctgcgccgttcgggccgatgatgccgacgatctcgccttcatgcagggtcagggatgcgccgttcaggatgttcacgccgggaatgtatccggccaccaaatcgaccgcgtcgagcaacggttcgccttcgggctcgcccatgtggatctgcgcgcgggtcagcggctcgtcggccacgcttgcgatgtcgctcatttcaggcctccttcaggtcttccagcacggaatcgtcgcccaggtccacgttcgcgtgggcgcccaggtatgcgtcgatcacggccggatcgttcatcacgctcttcggttggccttcggccacgatcttgccttccgccatcacggtgacccagtcggcgatgtgtctcaccatgttgatgtcgtgttcgacgaacagcactgtggtgccttcctcgcgcaacgccatgatgtggtcgagcagcgactgtttcagcgcggggttcacgccggccatcggctcgtccagcatgaccagtttcgggtcggacatcagcgctcgtgccatttccagcagcttgcgttggccgccggaaagcgcgccggcgtaatcgtccttctttttgatcagcaggaagcgttccagcagcgcctcggctttttcgatgttcgcctgctcctgcttcctccacatgccggggaacagcgcgcggaacatgccttcgcccggctgcacgggggcaccgaggagcatgttgtcgagcacggtcagacggctcatcaccttggtcagctggaaggtgcggaccatgcccatgcgcgccactttttcgggctgcacgtgggccatgtccttgccgtcgaactgccaggtgccggtgttcggcgtatcgaagccggtcatcaggttgaagaacgtggttttgccggcgccgttcggtccgatcagcgcggtgatgccgtgccgttcgatttcgaagtggctcacgtccacggcggtcatgccgccgaatttgcgggtcacgttgtcggccacgaggatcgggtcgggcttgtgcacgcccggcttgttttcgacgaatttcagatcgtcggtgactttgtcgcgataggcggtggagatgagggtctcgccttccggagctttggtggcccatttggtgaggtcctggaatggtacgccgggctgcacaccggatacgggttgcacgccggttgcgggttgcgtggccggctgcacgccagtggtcggagaattcgttgtatcaggcatggaaagccaactcctttcgatcgcccaacaggccttgtggtctgaagatcaccaggcacatcagcgccacgccgacgatcacccagccgagggcttcgatctggttggaagagatgagggtttcgggaacggtgttgcgcatgacctccttgacgaaggtgagcagcacccacagcacgcaggagccaagcaccgggccgagaatcgtggccgcgccgcccagcagcagaatcgtccacacgtagaaggtgacggtgcggccgagcgaatcgggctgtacggaacgcggcaggacgaagatgatgccggcgatcgcgccaaacaggccgcccagaatcagcgattccatcttgtatcgcgtcaccggcttgccgagagaacggatcgcgttctcgtcctcgcggatgcccttgagcatgcggccccacggcgagtggaaccagcgccagcacagcagcgccgcgatcaccaccaaaacccatgccacgatgcgcagccaccaggagttggcgatgttgttgctgtacgtccacagcaggaacgtggtcgaaccgtccggcagcggcgaaagcgattcgaatttctcggtgaagtcctgcggcgagatgcctgcggaaccgccggtgaagttcgtcatggccgtcgatctgccgatgatgcggatgatttccgcggcggccaatgtgaccatggccagatagtcgggtccgagtttcagcgtcggaatgcccagcagcagcgcgtagatgaccgcgagcgcgagcgccgcgcatacggaggcgaacaggttgcagcccatcgactgcgtgatggcgaatccgtacgcgccgaggagcatgaaaccggcctggcccatgttcataaggcccgtcatgccgaagtgaatgttcaaaccgatggcggcgagtacgtatgccgccgtggtcggggcgatcagctcgcccgccgcgttggagatgattgtcatgatgtccatggatcagcccaccctttgctgcttgccgaagatgccctgcgggcgcaccagcagaacgatgatgaggattgccagcgcgctggcgtaacgcatatcgttggggatgacgagcgagctcatgtccgccacgatgccgatgaccagcgagccgatcaacgcgccgttggcggtgccgaggccgccgagcgtcaccgcggcgaacatcagcaggatcagggtcgcgccggtgttccaggagatgccgttcaggtagacgccgagcagcacgccggacagggctgccatcgcgcacgagaggatccagaccacgcggaccacctgatccacgttgataccggatgccgcggcgagcgccgcgttgtcggacacggctcgtgtggcgcggccgagtcgcgtcttgtagaggaacagggtgacgccgacgatcacgcagatggcgatcaacgcggagaccagcgtcggcatgtcggtggtgatcggtccgagctggaaactgtccggcaccgatttgacgatgcctttgatgtcgccaccgaagaagaactggaacgtgtactgcaacgccatggacaggccgatggtgacgatcatctgctgcatggtgccgacgtggcgtctgcgtagcggcccccagacgatttcgttttggatgaagccggtcagcgcgccgatgacgatggcgaagatggcggaggcgatgagcggcatgtgtagcatctgcgtgccgacgtatgccatgaggccgccgagcgtcacctgttcgccgtgtgagaacgactgcaggccggtggtgccgtagacgaggttcatgccgacggacatgaggcccagcatcaggccgaagataatgccggaatacagttgctgccagatgcgtttgccgacattggagccgtcttttttgactggcgattgcgtggccgccgtcgatccggatgtgccggtcgcgcctttcgtgccgtttgccgagccggacgatccggatgtgccggacgtgccgctgccggcggaatcgcccgcctggtcgaatcggacaacgccgcgctgcttgtcgaagctggctttcctgatcgtcaccgtcgcgctgcttgccttcaggccgtgctctttcgcaacggacgcgtcgatggtgacggtgtaatcgccgtcatcggcaacggagaaggcccatttgccgtccgccgcggttttggtttccgcggttgccttgccggacagcgtgatggtgacgtcggcgatcggcttcttgtcggcgtcctgcaggatgccgttgacgcagccgttgctggcggtcggattgcattcatcgacggcctgcgcgccggaatcggcggcggacgcgatggcgggagggagtacgaaaagcatcgagagaacggcgacaatcgaacagagtatgacgattcccggtcgacgatgccgtgtgagatacgttacggctgtcataggtttttcctctcttgttgctttcacaacgtaggagaggaaacagcccgcgcggttgcgctcagatttcctgaacgttacccgatgaccgctcgtgtaacgtgaaaattacgcgcggctgagccggtgacagctatgcgtggccgcccagcatggcgatgccgaatccgagcgccacgcaggcgagcggcaccgcgaccgtggcagtgccatagcccagggccatggcgaaacggcgtttgcgaatcagcgacagcacctcgttgatcgccgacgagaatgttgagaatccgccgaggaaccccacaacgaacgtcattaccgtgcccatatcaaccgactgcgcatagtacgacatcatggcgatgccggcgcacagggaggcgacgccgttgatgacgagcgtggccagggggaagctgtggttgccgtcacggttccagctgcgttggatcgacacgtcaagcacataacgggccatggcgccgatgccgccgaacaggcagatcatccaggtcatcagcgcacctctcctgtggtcgggtcggcgacgagcgggatttccgcggtgaccggcttgggttcgaagctgggcagaggtgcaacgggttgcgatgactgcggctgcgattcgattttcggcacctgcccggtctgcgcgacctgctgggcgatctgggccgcctgctgtgccgcctgcgcggcctccaacgcggcctgcgcggccgaatgcgccgcatccgccaccttcacgtggcgcacgccctgcgcgtccggcacgttgttctgcacattttgcgcgtccggcacgtccgattcgcccgaatcggccatggggaccgtctgcgtagcactctgcgtagccgatactgcagtgtcggtcatctggacgtcctgcacgatgccgtacgcgtccgaatcggacattgaggatacggaagccgtggaggcatcggcgatcgcgttacggacccgcttgcgtgtgccgcgcgccagcaacgcctgcatcagcgccacgccaaccgcggccgcgatcagaccgccggcgaaacttcccgcaagatagccgagcgcgctgccgaaacgctgctcgcgcatgccttccatggtttccaacatcacgccggacatcgtcgacagtccgccaagcaaaccaagcccgacgccacggctgacgacctgccgtaccctgcggcgcagccacgacgcggtcgccatgtattcggtcagcatcgcaaacaggaagcaggcgagcatattcgacacgaacgtgcccaccacgaacggcgaaccgttcaccgacggcagcagcaggtccgtggcgcgacggaaaccgacgccgacgaagccgccgacgaacaccacgagatacatcagaccatcggcaagagggttgaatcgcgcctgcatgcgtttcatcggcgcgagcggaatctgcggcggatgcttggatgcggcggcaccggacgggcgcacatccgcgcgcgccacttcggcgacgtcgatcgactgtgtggcgggattcggctcatcacccgcgtttggcgagtctgccgcccgttgttcttgcgattccatcacgttccccttgtacttggctttccgcggacagcgtcgttccgccccagccatacggcaacgagctggccgcaggtgccgtcttcctaaccttgtacgagtctacacgtgcgttgcaaccaaacatcgaacatgtccgattcggtggataactgtggataacttcgggtggccctagacgtctacgaatggttatggaagacggtacggccgcgtcagacggatacgtcgcacaaccgccgcatcgcatgccgtgcgtcgctttcgtcctcgccgctgaacaacacgaccagatagtcgccggcgcgcagccgcgtatcgccatgcggcacgatctgccgttctccgcgacgcaggccgatcaccagacagccgtacggccagcgcacgtcacgcatcagcttgccgtccgcggtcgcgcccatttccacaggcagttccatgatgccgttgtcgatgcgattggcgattgccgtcgcgcctccttgcgcgcgcatataccgttccagcagctcgccgtagatcggtttcgtacgcagcaggtcggagacgagcagcgcgatgaacgcgacggcggcgaccggcagcatgtgcgtcaacgtgccggacatttccacggccagcagaatcgacgtgatcggtgttttcacggacgcggccagcgtgcccgtcatcacgcataccgcgaaaatcgccacggaatcggacggcaggttgccgaactggcgcaacgtctcgccgcagataccgccggcgagtgagccaaccgcgagaatcggcatgaaaatgccgccgggagcgcctgaaccgaagctggtggaggtgaacagcactttcgccacgaacagcacgcacagcatgcccaagccgacgcgcgcatgctcggccatggcgatcaggttcgagccgccgccgagcacgtcaggcagccaaatgccgattggcagcgcgagtgcgatcgcgatcaaagggcggctccatgcgggaagcttgccgtacagcgtttggaagccgagcagcgaacggttcatcagcgaaccaaccaaaccggccaccaatcccagcggaatcagccacccgtattcgccgagcggcagttggccgatggtgccgaagtcaagcaccggacgcaggccgaaacagtatttcgatacgaaatcggcggtcagggacgcggcggtggcgcccatcagaatcgcgggcgaaaaactgcgatgcaccccttccaaagcgaacatcatgccggacagcggtgcgctgaacgcggcggacaggccggccgcggcaccggcggtgaccagataatgctcctgcatgtcctcacgtttcttgccgcgcagccggtgcgataggaactgcgcgcccgatgcgccgatttggatggacggtccttcgcggccgagcgagaggccgaagagcgatccgagcaggcctccgatgaagcgaaccggcagaatcgtctgccatcgcattttcaggccgcagatcaccacgccgttggtttgcggaatgccgctgccgccggccatcggctcttttttgaccatccatgcgatggcgagcgcggctgcgattgcggcgaccgcccacggtgcgaccagccacggggtttcgcggatgcgcgcgtagatccagcgcgcggtgtcggtgccgtattcgatgccgagacggtagaggacgacgaggaagccggaaatcaggccgacgagaatgccggcagcggccatcttccatttcaggtggtcgaatcgcgggaccagtttgctgaacctgtcaaacctgtcgaacctgtcgttaggcggcattgcagtcatcgcactccccttttccgttcctccgccgcgcaccccgtcggtgtgtatgcggtgtgcgtcatacgcgaacgccatcgcacgcaccatacgcaaagtgccggcaggcacaggcccaccggcacttgtcattgacgttcgttgccgacgttcatatcgacgaatcagccgaatcagcttcagtcgatcagcgagttgatctggatgatgtggtcgcgctgcgggccggtgccgatcacggaaatgcggcagccggacagttcctcaagacgcttgacgtaatcctggcaggtcttcggcagatcgttgaagtcgtggacctgggaaatgtcctcgtcccagcccggcatggactcgtaaatcggcttcgcggcggcgaattcggcctggtcggtcggcatatcgtcgcgacgctcgccgttgacgtcgtacgccacgcacagcgggatttccttgaggccggtgagcacgtcgagcttggtgagcacgatgtcggtcaggccgttgacctgggccgcgtaacggttgacgaccgcgtcgaaccaaccgcagcgacgcgggcgaccggtggtcacgccgtactcgtggccttgggcgcgcagccattcgccgtcctcgccgaacagttcggtcgggaacgggccttcgcccacgcgggtcacatacgccttggagacgccgatcacgcgggtgatcttggtcgggccaacgccggtgccggtgcaggcgccgccggcggtcgggttggaggaagtcacgaacgggtaggtgccgtggtccacgtcgagcatggtggcctggccgccttcgaacagcacggtcttgccctcgtcgagcgccttgttgagcaccagggaggtgttggcaacgtacggcttcaggcgttcgccgagcttgagcagctcgtcggtggtctcgtccacgtcgatcgggcgacggttgtacagcttgacgagcatctggttcttctgatgcaggctggcctcgaccttgtcatgcagatgctccgcgttgaacaggtcgtgcacgcggatgcccacgcggttgatcttgtcggcgtatgccgggccgatgccacggccggtggtgccgatcttgtgcttgccgaggaagcgttcggtcaccttgtcgagcacgcggtgatacggggcgatgatgtgcgcgctttcgctcaccagcagtcgggagcagtccacgccacggctttcaaggccgtcgatctcctggaacagcacttccggatcgacgacgacgccgttgccgatgacaggggtggtgttggggctgatgatgccggacggcagcagatgcagcgcatacgattcgtcgccgaccaccacagtatggccagcgttattgccgccgttgaagcgggccacgtagtcgaccttcgtgccgatcagatccgttgccttgcctttgccctcgtctccccactgggcaccgatcaaaacaattccaggcatgttgttgcacctccgtgcgtacgcgattctgccttaagccttgcgcctaaagccttacaaaggttactcttcaccctctaccgggtctgagggatgctcacggctccggaccgaccgtaatcggattgcaaccggtccgaaaaacagaccagaaaacgcccgaaaacagttcgaaagaccgttggctagttcagcgcgcgcccggcactgccgagctgcttgcatgcttcgaccacacgcgcggccatcgcggattcagcttcacgaccccaagatcgcggatcgtacagcttcttgttgcccacctcaccgtcgattttgagcaccgaatcatagttggagaacatgtgaccggccaccgcacggctgaatgcgtactgcgtatcggtgtcgatgttcatcttcaccacgccgtagctcacggcctgcgcgatctcctccggcgcggagccggaaccgccgtggaacaccagggcgaacggcttaccgggagcgacatccagcgagtgcgcggggtcgggcatttcgccggccttgatcgcgagcgcgaccgtggtctggatttcgtcgagcagttcggggcgcagtttcaccacgcccggtttgtatgcgccgtgcacgttgccgaaggtgaaggcggccatgtagcgtccgcgctcgccgaggccgagtcgttgcgcgacggtgatgccttgcgcgggcgtggaatacagtttgtcattgatttcggcgctgtgcccgtcttcttcgccaccgaccgcgccgatttcgatttccagcacggtgtgcgcggcttgggatttgtcgagcagttcttctgcgatgtcgaggttttcatccagcggcactgtggaaccgtcccacatgtgtgactggaaggtcggttcctgaccgtgcttcacctgttcgacttcatggtcgagcaagaggcgcacccattcgtccaaatactgtttggcgcagtggtcggtgtgcagggcgatggtgatgttggggtatttcgccgcgacttcgtgcgcgaaggctgcgaaggcaagcgagccggtgacgcggtcgttgacgcgttgcccggagaagtaggcggcgccgcctacggagacttggatgatgccatcggattccgcctcggcgaaaccctggagtgcggcgttcagggtctgcgtgctggtcacattgatcgcgggataggcgtaaccgccgcggcgtgcggcgtccagcatttgcgcataacgttccggcgttgcaatagtcatgcctccattatcgcccaaccctatcccacttgtcatgtgacaacattcgccatctttcctttccgttttcccgaccgtccgctccatatccaggtcgcccgccccactagagccatatgccgagcgttttcgtctcatatcccgacacttgcgggaccgaccaataaacatggcgaaaccattgcgatcgttccatcggaagtcatagaatgtccaccggatcgcgcgacgaagagcccaaccgggtgttcccgcacgggcatgccgccgcacgtagatgttgcgaccaatacccgcgaggaggcttgatgcaccaggttttcgccatcttccttcgagacgtgaaacgcattctgaagaaccccgtggcgctcgtcgtcacgctgggtgtggccatcatcccatcactgtacgcatggtgcaatatcctcgccaactgggacccgtacgcgaacacgggcaacatccaagtcgctgtggcgaacgaggacaagggcacaacctccacgctggtcggccatctcgacgctggccagcagaccgtcaaccagcttaagaagaaccatcagctcggctggcgtttcgttcccaagcagcaagccatcgaaggcgtggaatccggcaaatactatgcggcgatcgtactgccggaagacttcagctccagactaatcggcaccgtcaccggtaaaggcgaccgaccgtcgatcacgtactacatcaacgaaaagctgaacgcgatcgcgccgaaaatcaccgatacgggcgcgaccacgatcgacgagcagatcaacaccactttcgtttccagcgtggccgacgccgtggcaaaggaagtgaaggaggcagcgggagaaaccaccggcagcgtgaaaagcgcgcaaagcgacgtcgtcaacgatctgaccgacaccatcaaccagctcgaaaccgtccaacagcagctgcgcgacacccgctccacgctcgacaaggccctcaccaccatcgattcggccaaacagtccaacatcgcgctcgcctcggaaatcaccaactcgcttgacaccgtcggcaaggcgtccgacttgctgagcgagacgcgcacacaaaccgaacgattctcgaacacgctggtcggagcgctcgacaacggcagcacgcaactgtccggcctgcaggtcaacgtgagcaatgccaccggcaccgtgctcagcggactgaacaccacgcaggacgcgctcgaccaagtgtccagcaccatgcatcacgtcaacgccaccaccggcaatgtgctcgacggcgtggagaaggcgttgcaggccagccagctggatccgaacagccaaacgtataaggatctttccgcgcagctcgccgaagcccgcaaacagctgacgttccagcagcagcgcatcgacgccttcgatcaggacaccacggctgcgatcaacgcggggaagaacaccgcgaacgggttcaacgacgatgtcaccacgctggcgaagaacggcacggcgtcgatggcgagcgcacacacgaccatcaccggcacggtcatgccgaatctcaacaccgggctcgatacactcagcctggccaatgggtcgctgtccggcacgcttaccacgctgcaaagcacgctggaacagggcaacgggctgctcgaccagttgtcgcgcaccgtgacccaaacgaacaccaccattgctggcacgcagacacagctcgccaatctcgccaaacagctcaacaccacgcgcaccgatgtggccgcgttgagcagttcggcgatgttccagcagctttcccaagcgctcggacttgacgcgagcgaggtcggctcgttcgtgggcgagccggtgcatttggacgaacaggtcctctacccggtcaaaaactatggttccgcggtcacgccgttctacacgaatcttgcgctgtgggtcggcggattcgtgctcgtcgcgatctacaagcttgaagtggaccgcgatgagaagatccgcatgtacacgccacgccaaggctatatgggccgttggctgctgttcgtcacggtcggattcctgcaggcgaccatcgccacgatcggcgatctcgcgctgggcatccaatgcgagcatccgttcctgttcatcctcgccggcattttcgcctcgttcgtctacgtgaacatcatttacgcgctcgccgtggcgttccggcatatcggcaaggccgtcgccgtgattctggtgatcatccagattccgggcgcggcaggcctctaccccatcgagatgatgccggaattcttccgccgtctgaaaccgttcctaccgttcacctacggcatcaacgcgatgcgcgggccgatcggcggcatgtatgccaaccattattggatcgacatgctctcgctgttctggtatctgcctgtggcgctgttcatcggcttggtggtccgcaagctggcgttgaacctcaaccgcctgttcgacaaccgtctggcggacactgatctgatgatcaccgaacataacgaaggcacggtggaaccgttgcggctcaccgagaccgcgcagcagatcgccgaggagttccccgaactcgcccgcagacgggcgattcatttcttccgcctgtacccgcgcctggtgcgttggggattcctcgcgctggcggtactgccgttcgtgttcctgctattgctattcatcacgcgcatgaagctcgccatgctgctcggttggatcatttcgatcatcgccatcgacacgtatctcatcgtggtggagtatctgcgcgaacggtatgcgaattatctgggcgaggaagcgatgagtgcggaagagttccgcagcgcgatcctgcacgagaacctgctgttccggccgggcatgcattacaagccgatgcatgccgtacgtacgaggctgtatgaggctgcgcatggtggttcggccggacatgcgcctgaacatgcggctgagtatgcggctggaaacacggacggaaatgctggcaggagtctgcgtgaggaggggaacgaacagtgaaaatgatctggggcatcttcaagcgggacatgtgccatgccacccgcaacgtgatcgccgtgatcgtctcgatgggcctggtggtggtgccggcgctgtacgcctggttcaacatcgcggccagctgggacccctacggcaacaccaaggcattgaaggtcgccgtggccaataacgacaagggttacaagtcggatctcataccggtgcgcgtcaacgtgggcgaaaccatcatcagcacactgcacgccaacgaccagctggactggcagttcgtgaaaagcgacaaggcaatcgacggggtgaaatccggcgaatactatgcggcgatcgtaattccgaaaggtttcagcgccgacatgatgacgctgttctcccccgacatcaaacacgcgcagctcaagtactatctgaacgagaaaatcaacccgatcgccccgcatatcaccgatcagggcgcgacaaccgtggtcaacacgatcgacaaaaccttcgccaaaacgattgcgcaagtcggactcgacctggcctcaagcatcctacactattcgcaaagcccgcaaatggccgaatacatgcgcaacctcaacggcaatctcacgaccatggcggatacgctgagcggcgcatcgcagcaggtgacgtcgtattcgcagctgctcggctcggcgaacgacatcgtggattccacgggcaaactgctcgcctcggcgaccaaggcgggcaaacaggcccagaacgcgttgaagcaaggcaaatcaggtgccacgtcgttcacttcggcaggtgcgaacgtcacctcctcggtgaacaccgcgctcgaccaggtgtcaggcgcgttcgaccaagtagctgccaaggtaaacaaggcgttcgacgcgatcggcaagggctcagacaccgcagccagccagttggcaacgttgagcgaacaaatctccagcggcgaatcgctgtacgacacgtacatcacaagcctcaaccacatgcgcgaatcggtggaacaactaccggacagtgattccgcgaaacaggcgctgctggaagccatcgaccgggagatcacgctgctggaagccgccaaaggcgattcgcagaagctcgcgcagcagctgaaagacgcttccacgcaggtcacgcaggataccgcagccgcggaacgctcccgcaaggagatcctgaaccgcatcacctccgcgaagcagtcgatcagcaatgtgcgcgacgattacgccacgaacgtcaagccgaaaatcgacgcgctcgcctccacagtcagcacgctgatctcccaaaccgacagcatgatcacccagctgagcggcaccgccgacggtctggacgatgtgacgggcgatgtggggacgaatgtgacgtccatccgttccacgctcggcgcgatcgcgaagaaactcgactcgtcggcagcgacggtgaaggagctgatcacgaagctggagacgggcggaaacgccggtgacggcaacagcgatggtggcaatggtggcaacgacgccagttcgtccgattcgggtgaatcggacgaactacgtgcattggccaccgccaacgcgtccacactgtccacactgatttccgcgcccgtcgcactgcatcgcgtctcggtgtacccgatcgcgaactacggttcggccatggcgccgttctatacgatcctgtcaatctgggtgggtgcgatcatcctgtgcgccatgctgaaagtgacgatttcggaccgcgagaaggcgcatgtgctgggcttgggcgacacgctgccgcgcatcgccggcccgtccggcccggggaacgcctcacgttggggactgcgcctcgaccacgagtatttcggacggtacgcgatcttcgcactgctcgcgttgctgcagggcacactggtttgcctgggtgacacgtatttccttggcgtgcaggcgaatcatgcgctgcagttccttgccgtggggtggcttgccgcgctcgtgttctcgaatatcgtgtatacgctgaccgtgtcgttcggcgatatcggcaaggccgtggccgtggtgctgctggtgatgcaggtcgccggttcgggcggtacgttccctatcgagacgctgccgaagttcttccaaatgctctacccgttcctaccgttcccgcacgccatcgatgccatgcacgccgcgatggccggatcgtacggcaatgagtacctgcttgatatggtgtatctcgccttgttcctgattccttcgctgctgctgggattggtgttgcgcaagccggtgatccggttgaacaactgggtgagccgcaatctggagtccaccaaggtgatgtgacgaggcggatttgaacgggctggtttgagccggtttagatcggtttcggctggtacacgtgaacgcgctgcccgccatcatcgacgacctgaaaacccaaagccacgaattcgtcaccatcgaccagccggcaaaaacctaagctagcgtggaggcgtagggcattgtcctgcccagtcacttcccttacgtaccgctgcgccatcccggcgctcctctgcgccgccactaccccacatgtcgcctcctcacgcaccaacaagtgtccgatccccccgaatcagccacccacgcgtcatccggtcaccccaggttgtccgattcgggagaaacggacactcaggggcaccgtgcaaaccacacgttgatcagagaaccggcaaccaccagcacaacaccgatccagaacggcatgcccagcgccacgcccaacagaagcgtgctagaagccgtggaaaacagcggagtcgcgtacgaaccaatcgcaagcgtttccatactgccgtgcaacatgccgtatccccagcacgcgtagccgcccgaaatcgaagcggcgcacgcaatcagcgcagcatatccaccgatgccgggcgccgtgtccggcaaaccgtctcccgaaacgaaatggatggtccacagtacaacggccacacagcagaagaaaatcgtcgtgccgtcgtaaccgccggacaacgacggcgtaaaagtcgcataaatcgcccaaataaaggcgccaacaaacgcgagcacatacggtagggggttactggcgatattgtggaccgcttcctgcatatcaaggctttctccgccaaccgccatcgccacaccgatggttgcgatcaccgcgccaggaatcgctttggcgaccgcaccacgtttgtgcgataccgctgcggtcatcagcaccagcagcgtcggccacaagtagttgacaaggctgacttccacggattgcgcgttcgttgtggccaggccgatcgacagcgagattgacgcctcgtatgcgatgaacatgagtccgcctgcgatgaggtacttgcatggcgcttcgcggattggtttcggacggcgcacaatgaacagcatgacaccaccgacggtgtagatgagcgccgaaccgagcgtggcgccgaacgattcggagaccagtcgcacgaggccggccatgaagccccacaggacgattgcgaacaggccgatgagtgtcgccgcgtgtgatgtggcatggccgagtagcggattgcaggagttgccggtggggtggtttgcgccggaatcggagggggacttctggttcgtgttcacgggctccagcctacccatcgccctccacgagtgtccgattctgcagaatcggacactcctgcaacctgcgatgccgcgaacccgattacccccggaaccgcaccaacagcagagtcaaccaccccatccgacgctgccacaccagccgtatcggcagccaagtccatgcgtcccgcatccacacagcccacgcgtcccgcacctccacggcccgccgacgcgcacacgtcgcccatgaccaaatcatccaacgtcacaccgaacatgtcgcaaagcatcagcagcttgtcacaaacgtcgcgttccacgccaccatcttgcggttgcattgcgattcgcaaccaaattttgcgacgcaaccgacagttgcgcgacgcgaagttggcttcacgggtcttttacgacaatagaaaaacccttgaaattccaacgattccaagggtttcgaatggagcggatgacgggagtcgaacccgcctttaaagcttgggaagctttcgttctaccgatgaactacatccgcaaggtgtgccttttgggcacgagccattagtctagcacgccattcccactatatgtggcagattgtccggttccgcaaaatcgatttgcgctatatgtggcagttctccgcgggcaagagctgttagagggtacgaaatcgaaggtatgggggcatcttcgcgaaggaaagtgccacatatagcggaaatcactttctcggcagtctcttatctgccacatatagcgattttgggagtcgtcagcacagcaagtatgcgtccgcagcaacatcagtaccggaaaaggctgaaagccggggcaggaaccagcggcgcgggaggctgtgcgggcgtcagcgcgaccctcttctgcgcatggggcgttgcgaatagtcgcgcgaatatccaccggtcgaacccgccgaacccgccggacccgaaccgtacgaatcgtaagcggaaccatactgcgagccgaactgcggcccgtcataaccgccctgtcgaatgtcgatcgcggcaacgccggtcgttgcgtatccgccggccaggtagcccgactgcgcgccctgctgccgcatctcctgacccatctgcatgagccgcgcaatgcggtcctgaatcggcggatgcgtggaaaacaggcgcgagaagccctccgcggagaacggactggcgatcatcatcgcagccaccgactgcgtgccggcggtcttctccatcggcatcgcggctgcgccgccggaaatcttgctcaacgcggaagcgagcgcttccggatcctccgtcaacttggaaccgtcttcgtcggcgtcgtattcgcgtgtgcgggagattgccatctgtatcagcgacgctgcgatcggcgccagaatcgtgctcagcagcacacccagcaatcccaagccgccggacgccgaatcgtcgcggtcgtcacgcgaacggccgccgccgaaatacatgagcgagtagccgaggtacgagatgacggtggccatggcggaggcgattgcggacgtcagaatgtcgtggttgtagacgtgcatgagttcgtgtccgagcacgccgcgaatctcacgttcgttaagcgtctgtaggatgccttgcgtgcagcagaccgccgcgtgtcgttcgttgcgccccgtcgcgaacgcgttggggctcatggtgggggcgatgtagatgcgcggcatcggcctgcctgccttcgccgatagctcgcggacgatcttgtatagtacgggggcttcccgctcgctcacctgtcgagcgtgcatgctggcgatcgccagtttgtcggaaaaccagtaggagacgaacgtggagcccaggccgatgagaatgtagtagccgagcgtgctttgactggcgccggtcgcccaccagatgagcatgatgacgccccacatcaacgcgaacaaaagcgttgttttcaagccattgcaatggccgtgcacctgcaatttgccgttcatggccaccagcctaggaattcaggctgggattttgctgtatacaagctgaagggtggatttgcaacatctagaaacatgccacgcaacgacgctacagcatcggccatagacctatctgcggcacggcgagagtcaccccaacttgaaacgtattacccccgcatatcccccgaatgcactgcgtcgagcgtgccgatcaggctggtcagcaaatcgttgcggccgcacgcgttcgtcagcaccgccagcacgtacgtgcccgactgcgacatcaccagtccggcatcgttcagcacgtacaaaccgccttcgccgttgatccatccggccttcgtgtacacggtgtccgcatcgccaagggccgcgtggatgcaggagttcagcgaattcgtcatgtctccggacagccattgcagcgattcgggcgtgatgttctgcacccccgccgtttgcccggcgaacaggaaaccgtatccggcggtccacagtttggccatgtcgcgcgcggaggtgaacaggtacccgccgcgatcacccattctggaagccgcgcccgcctgttcggcccacgtgttgaagcagtcgaggccatacgttttgtacagccagtcgtaagacgcgttgtcggaattgcgcaggacggcgtcgaccttctggtggacggtggcggactgcgcgtcagcggattgggccacgctgttcaggtcgacggtgcccgttgagaacagcgatatcaggtatggcgcctccgccgacgaggccgaatagatctgtgcatcggcgttgtatgcgatcgtgcggccggtcgtgatgtcggcgagcacgaatgatgcggtatatccgtcggcttcgaaagtggcgatttgagactgcacggcggcctgcgaatcggcgcttagcgtgaagccctgcgttgtgatcgtggcgctgccctcgactgcggaaatgccgtccagcgcgacctgcgtcggcgacgagacggcttgtgtctgcgattgcggcgcgctgttttgcttaagcgcgcccgacgtggaggacgtttccgaagacgttcccgaggacgccgctgcgtgggcttcctcttcgagatgcacatcgacaagacccacgcccatggcgaagccgatcaggcaggcgatcaacaggcccacgacggacacggaacagcagtacagtgccttgcgcttgacgtgttttccaaagttcatgccgacttcacaaccttagatttcaatgcccacatccgtttgcgatgatattgcgcaccgcgtttcactggggtcagcctagcgcatgaacccgaacttcgggggtaataggtcaaaacgaccgcgtatatccgattctggagaaacgggcggttgtgcgatcgaaaacgcacgctacgcgaccagtccgccgaaaatcgaccactaaagcggcaaaaactaacgccctgcacgtccgattcagaggaatcggacgtgcagggcgttactagattgcgttaaaaggcttggagttagggtgtcaggaagtcagcactcccaccctaattccagccggcccgattcaggcatgcgccagcgcgcgcatctgctccgggtcgatgaccttcttgtgctcgcggccttccttcgcgccttcggcacgttcgaacgcgtcgaccttcttccagccggcgaagtcgatcggcttgacaccgcgggaagccagcagactgtcgatggattccggatcgcggtcagcggccacgcgaccgccttcggcggccttggacaggtcctccagcatgttggtgacgatgagcagcgcgtcggacttggtggagccgatcaggccgaccggaccacgcttggcccaaccggtggcgtacagacgctcacgcacctgcgcgccctcgccggaggcctccgtggtgatgcggccgtcgccgttcgcgttggccaggtgcgcgcgacgctcgtcgtacgcgatgcccggcgcggtggccggcttatagccgatcgcatggtacacggcctgcaccgggtactcttcgaattcgccggtgcgagtcatcttgccgtccgcggaagtcgtcgtcttctccacgcgaatcgccttgaccttgccgtcctcgcccagcacttcgaccggagcggaattgaagtggatgtagtacttgcgatccgccgggttgccttcgaaatcggtgtcgccgtcgtcttccatgtcctcggccatctcgcggatggtgaacagctcctcgaccatctgacgggtcagcttgtccttgccggcctcctcgatagtgtcgtcgtccagatcgaagtcgtcttcgttgatgatcagctgcacgcccggcagcttctccatttcgcgcagctcctgcacggagaacttggcctgagccacgccacggcggatgaacagatgcagagtcttggccttgttggccttgatgccttcgtacacgttgtccggaatgtcggtgcgttccttcaggtcgtcggcgttgcgcatcagctcgcgcgccacgtccatggccacgttgccgccgccgatcacagcgacttcctcggcatcgagcggccattcgcgggcgccggtcgggtaaccgtcgtaccattccacgaacttggcggcaccgtacacgccgtccaagtcggcgcccggcaggccgagcggcttgtcttcgacggcaccagtggcgaacagcaccgcgtcgtaacgttccagcagctcgtcaagcgtcacgtccttgccgaattccacgtcgcagtacaggtggatgtccgggttgtcgagcgtcttctcgagagcggatgcgatgaatttgatggaagggtggtcgggggccacgccgtagcgcaccaggccgaacggcaccggcagcttttcgaacaggtcgatgcgggccttggtgcccagtcccagctcttcgccgagcttgcccagctggcgcaggaaaatatcggaagagtagacgcctgcggggccggcgccgattacagcaatacgaagttcgttggtttcgctcatatgctccagcctaatatattccctgcatttccaacagggggcatacggcactttcttgcgattcccttacttgcctcgcaacgcgcagcccggcccatgtgccggcgcaggagaacgtacaatcgcagaagatcacaatcggtccctcactaaagaaggtccttatcgtaagagggtgggcatatgcgcattcacatcacgtataccggcggcaccatcggtatggtcgagtcaccgaacggtctggttccgggcgccgatatgcgcggctggctgcgccggctgattgaggacgcgcatctggacccgagcttgttctcgttcaccgagctggacccgctgatcgattcgtcgaacgcgacgcccgacaattggcagacgatggcggacgacctgcgcgcgcaccgcgatgacgccgacgcatttgtggtgttgcacggcaccgatacgatgagctattcgagcgccgcgctgtcttacgcgctgaccggtttcggcaagcctgtgattttcacggggtcgcagcatccgctcggcaaaatcgaatcggacgccaccgcgaacgtcacgggtgcgctgaacgccgcgatgagcggacgttttcatggcgtcggcctgttcttcggccatcatctgttcgccggcaaccgtgtgagcaaatcgtcaagctgggcgttcgaagggttttcggcgccgtccaccggcccgctggcacgtaccggcacgccgtggcattggtatgcgggtgattcggccggctccagttgcggttgggcgtcgccgctgccctactcccgtcacgatgtggccgtgatcgacatggctcccggcatttccgccgcgcgattggccgcgatgctcgaccctcgtccggaagcggtgctgttgcgcgcgtacggcgttggcaatgtgccgagcgacgagccaggactgaccgacgtgatcgccgacgtgctgcatgacggcgtgcctgtcgtcatcgcatcgcaatgccagcaggcggaagtgctgctcggccattacgagacgggcgacgcgattgcccgcgccggtgcgatcggatcgggcgacatgacgctggaagccacgtacgcgaagatcatgttcctgctgtcgcagggcgtggatgcggccgatttcggcacgtggatgcgccggaacatcgctggcgaaatctcgcccagctcgatgtagcacggcgcaacgcggttcagcctccgcacggctcgtcgccgcaaccggcgctactcgcggtcgagcagggcggtgagcgcccacaggatgctgaccacgtcgatcgcttcctgcatgaacgcgccgacgaccaccggaatgaggttgaacgcggccgcgaccatgccgataatcgccaatccaaggccgaccagcaccgcctgcagcatcactttcttcgtgcggcgggcgatggcgatggcgcgcggcacggaggcgatgtcgtcgttcatgatgaccacctgcgccgattcggacgcggcggtggacgtgccgtcggtcatggccatgccgatgtccgcaaccgccagcacgggggcgtcgttcacgccgtcgccgaccatcatcgtcacctgtcgggtcatggattcgccgaccacgcgctgtacgaccttgtcccacgccggctggttttggtgcgcgtcttccgtggcgttcttgacggccgcgaccttgccttcggggaagagttcggattgcacgtcgtcgatgccgacctcgcccgcgatgatgcgtgcggaagcctccttgtcgccggtgagcatggacagtttcttcacgccgagccggtgcagtttttcgagggacgccttggcgttttcgcgcggcacgtcacgcagcacaatacgtgcggcgagcttgccgtcgatcgccacgtatgcggccatttcgtccggttcgagaggtgcgaacagcgaattcacctccggcttcttggaagcgccggcagcggtaccggtcgccgaatcgccaaccgcgctatcggccacagcaccagccgcagtaccggccgccacccctgcgcccagcacatgcgtgaagccggcctcgtcggccgtcacgtacgcgaaacgacccacgcgcacggcatgcccgttcacctcgccggacacacccttgcccgactgttcctcgatgttcttcaccacggggtaatcgcgtccatgccccggcaaatcgcgttcggcgcacagccgctgcccgttctcatagcgcgcgtacagttcctgcatggccttctgcccggccgccgcgatgcccttcgacagaatgtgcaccgagtagccttccaccacgccggccatcatcagaatgtggttctcgttgtacggcgagctgttttcgaacggcttctcgacgcgcacgacctgcggctgcttgacggtaagcgtgccggttttgtcgaagaagatatgcgatacgcggcccaggttttccagcacatcctgcgctttgataagaatgcccgccttggcaaggcgaccggtgccggccacgtacgcgacgggagcggcgatcagcagcgggcagggcgtggccaaaaccagcacctgcgcgaatcgcaatggcgtgcctgcgacggcccacgcgatgccggcgatcgccagcgaaagaatggtgaacggcaccgccagcacatcggcggttttgacgacggtcgggcgcgattcctgcgccgacgacaccagttcgaggatcttctgatactgcgaatcctgcgccaattgcgtggcacgcatcgtcagcgcggtcgatccgttgaccgcacccgacagcacgcgcgcgcccgcatacacttcgcgcggcaccggctcgccgttgatattgctcagatccaacgtggcgacgcccgacagcagttcgccgtcgaccggcaccgtttcgcccggcagcacgaggatcacgtcgccaagcttgacctggtcgaccggaacggtttcgaaatgctcgccggccgcgtcgtaaggcttggtttgggtggtggacttattcgtttccgcagcgttaggcacatccacactggcgaccttgcgaaagccgtccgccgtcatgtcgccctcagcatcaccggcagtaccgtcggccccggcagccgccgcacgtgcacccacgcctggcaacgtcaccacgtgcgcagtccgcggcgccgcatcaaccagcgccgtcaggttgccttccgccttcgactgtgcgaattcctcaatcgcctcgccggaggaaatcatcagcaccacggcccacgcagcccagtattcctgcaccgccaccgtcgacgcgatcgcaataaccgcaagcaaatccacaccgacgtgaccgtgccgcaaatcgtcaatcatgccgatcacagtcaccacaatcgtgtacacgaccagcgcgatcacgatccactgcccgacacccggattgaacggtccgaaagtcagcgagacgcccgcagcctcccacggacgccacgaacccagcaatgccaacggaatcgcggcaatgatggcgatcggcagcagcggaacttctttgcaaatggaaatgattctacgcatgagaatctccttacgctcgtatcggacgccttgttaacccatcggcgccccgcctgcgcggaccatcgatacacggcgtaaaaagatatttccagcataacagagcattgcgattgccgcggtcgtttgcgtgtgcttccgttcgtcgcgcgcgttccgcgcatacgaaaagggccgtgcgattgctcgcacagcccttgttttccgccgtttttcggcttgttcagcgttttccgcgattacgcggattgcggttgcgacttcgccgtcagcctatcgggtggcagccacccgtatcgctgtcggcatgaacgccgcacaccgtacgttgccgtacgatgccgcgcatccggctttaccacagaccgaacggatcgaacaggccaccgccgtcgccgttgttgccgttaccgccattctggccgttctggctgccgccattctggccgttgccgttatcgtcgttgccgttgttctgctgacgctgttcctgcttgttagaggagttcgtcttggtctcttcctggtcgagcgtcacttcgagatccatggtgttgccgccgcgcacaacggtcagcttcaccttgtctcccatggcggaggcgcgcacgtaaccgagcagcgagtagttgttgttcactgcctttccgttgaacgccacgatggagtcgccggccttcacgccggccttggacgccgggccaccgtcggtcacggcctgcacctgggcgcagccgcgggtcacaccgtccgcttccaccgaggagctcttgatggtgatgccaagcaccacatgcctcacggaaccattgtcgatgatttcgttggccacgcgcttgacaaggttcgacgggatggcgaagccaataccaatcgaaccggcagtaccggacgagcttgcggtggaggcgatggacgaattgatgccgatcacctgaccagccgcattaaaggtcggaccaccggagttgcccgggttgatggccgcgtcaatctgcacggcgttggtgacgatggcgttgttgtcgtcatcggtcacggtcaccgggcggttgagcgcggacacgatgccggtggtggcggtgtcgtcgtagccgagcggattgccgatcgccatgacggcctcgccgacggcgagattgtcggaatcggcgaattccgcgactttcagatcgctcggcggattgtcgagcttgatcacggccaaatcggtggtggtgtcggtgccgaccaccttcgcggaatagacggcgccgctggcgagcgtcacctgaatctgctgcgcgccggaaatcacgtggttattggtggcgatatagcccttgtcgctgatcaccacgccggagcccttggcttcgccgtcgctggtcgccacgtcgatggccaccacggaatcggacacttccttggccaccgcggtccaatcgaccgccgtaccggacttcgccttggcggaaccggaaccggacgtgttggacttgacgtcggacagcgagctggaggtcggcacatgcacccaaccgttggtaatcgcggtgaagccgacgccgaggcacagcgcgccggacaccagtgcggccacaacggcggtgaccacatggctggtcatgccggacttctgcttggtgacgaccggcggctggttcggctggttcggctggttcgggaagccctgccccggagcgccgaacggattgcggttgcccggtcccgcagggggcatgttcgcgccgtactgcggctgctgctgattgttctgctgcgcgccgttctgcgcggacgagccgccaaatggattgccgaacggattgccattgttccgctgattgccggtcgtatacgggttgccgaaagcgccgaagaacgacggacggttgtcctgcggctggccctgctgctgcgcgccgtactgcggttgctgggcggtctggccgctggcatcgccagccggcggcgtcggcaccggaccgtacgcgccgtattcgggcgccggacggtactgttcggtcggcgcatcctgcgtcgcgttgttgatcaccgtgcgttcaccggcagcggaagcataatccggcgtatcgtcagcggtattgcctgccgtgccatccgccgcgtccacggtaggaagggcggtggtgggccgctcgcccgcgttcggcactgcaatcggttcggtaacggaagtctgtgcttcgtcggcgacgttctcgctcggcgtctgcggcgcggtctgctgcgtgccatcctgcggctgggcgatgttctgatcgctattatcttcagccattgttgctccttattcgtctcgcggcattcaacatggtcagcaatcgtgccgctcgaactgctatctaagagtaaagatacctgctctggaagtttcctgaatgtttgttgaaagtagcaatcgaatcgcttggcagtttgctccatacgatgccaccgtcgaccgccgatggcgccaccgcggcaatcggcgctatcgcatacagttgagagcatgacaagcttgaacgaaccacagaccggcgcggtggcgcacgagacctcagcggccaacgcggcagcccgcgcaacgcacgacgcagcaggcaacacgaccagcgcggcatcgaccgaaaaccttattgagcatccccgcggcgcggaacccggcaagcccggccgccgcgacgcgttctacttcgagcagaaaacccgcctgccagatgcggccgatggcaagggccgcggcggcgcgcgatacggacgcaccggcatcatccacaccccccacggcgacatccacaccccggcgttcgtgccggtggccacgcaggccgcgatgaaggccgtgctgcccgaaaccatgaaggatcttggcgcgcaatgcctgctgtccaacgcgttccacctgtatgaacgacccggagaacaggtgctcgacgaagccggcggactcgccaaattcatgaactggaacggtccgacgttcaccgattccggcggattccaggtgctgtcactcggcgcgggcttcaagaagacgctcgccatggacgtcaccggcatgaaatcggacgacgtgatcgcggaaggcaaggagcggctcgcgttcgtggacgaggacggtgtgacgttcaagtcgccgctcaacggctcgctgcaccggttctccgccgaaatctccatgggcatccagcacaagatcggcgccgacatcatgttcgctttcgacgagctgaccacgctgatgaacacccgcggctaccaggaacgttccgtggaacgcacctaccgctgggcgcaacgttgcgtggccgagcacaagcggcttaccgaggaacgtctcggcaagccgtatcaggcgctctacggcgtagtgcagggcgcgaattacgaggatctgcgcaggcatgccgccgaacagatcgcttcgctcgatttcgacggcgtcggcatcggcggcgcgatcgagaagcgcatcatcggcgacacctgcgcctggatctgtgacgcgatgccggaaagccgtccgcgacacgtgctcggcatcgcggcggtcgacgacattttcgcctgcgtggagaacggcggcgacaccttcgactgcgtggcgcccgcccgttgcggccgaaacggcgcgatcttcacgcgccacggccgctacaacatcaagcgcgcgcagttcaagcacgatttcggcccacttgaggaggactgcgactgctacacctgcacgcactattcgcgcgcatacgtggaccatgcgctgcgtgcccgcgaattcaacggtttcacgctggcgacgatccacaacgagcacttcttcgtgaagctgctcgacgatatccgcggatcaatcgacggcggctatttcaacgaattccgcgacgagacactcgccaagttctacgagaacggttcgcgcggctaatccgcaccggcatggagcgttgcgcttcggccggtcctcccggtttcatcgaattgtgtgagtcggatgtccgattctggaggatcggacacacagagtcatgttcgggatgcatatttgtccgattctgccgaatcggacattcgttgaacattcgaaaaacgaaaatgccgggcaccttgcacgggtgtccggcattgtttgcttagtgattaccgcgattcacggcttgcggaggccgtgggatcagccttcgatggcgatctggtgtttgacctcgacctgctgttgcgcttcaggcttcggcatttccaggcacagggtgccgtctttgtaactagcgtgaatatcggaatccttcacgtcctcgccaacgtagaagctacgagagcaagagccggcgtagcgttcgcgacgcagccagcgaccgttgtcgtccttgtcctcgtgagagctgtcgcgatgcgcggaaacggtcagataaccgttctgcagatccagcgagatgtcatccttcttgaaaccaggcatgtcgatgtcgaccatgtagcccttgtcggtttcgcgcacatcggtgctcatcatgcccgtcgacatattcgcatcacatgccgcgcgatccatgttgcgccaaccctcgaagaacggatcatcgaacaggtcggagaacattgtgtcattcatcaaagccggaaacattgccataatcggtactccttaagcaaatgcgcgttctgcgcgcggagtaatgcggcttggcagccggccgtgcgattatcgccgcggcgccaccatctggcgacaccgacgaccgggttcgttgccacatccggaaccctcccgggctcctgaccttgacctttcacttcagtcaactcttccgggcgcctcccattccggaattatgctcacagtgaaatacgatgacggtgcaatggaaacgacgttgccgccttggtatttccgatggattcgaagtcgtgtaatgcctggaaatttcgggatatggcgaggcgatatcggcatattcgaccaattcgtcgccgatcgtccgaatattcagtatattttccggttgcgccgcatacgagaaaaccccggaccattggtattccaacgttccggggctttaaatcatggtgcgagcggggggagttgaacccccacgagcatacactcactgccacctgaagacagcgcgtctaccattccgccacgctcgcagacaatcgattaatttacactgcttcatcctaagtaacaaatcggcgtgtcgcgattggcgaatgggcacaaagaggctggctcaggcggcatgctcggccttgtactgcgtaccccagtccttcatcgcctcgatgatcggctggagcgtccgtccggtttccgtcagcgaatattccacgcgcggcggcacctccgggtacacctcgcgatgcaccaacccgtcacgttccatctggcgcaggttcgccgtcagcaccttctgcgacacattgccaaccgaacgacgaagctcgctgaaccgcatggtcccgttcagcaggtcacgcaggatcagcaccttccacttaacgccggaatcgcgcaggttcagcgcatgggcgtggccctgggaaccgtaaccgatgatggcaaccttcttgccttcgaggaccgagagatctccatcgttctcataccaaatttgtgcagccattgtacttggcactccttttgtgtagtggggtgaacgcttggaaagcgttcgggtttctaccattcgcagatgaaattcgtggtttcgtgcatggattttgtcctgcaaactggggtccatcctaccggagcggccgttttggtacgtatccagtccacaaagtgagccgcgaaatcgtaaaaaattcgtcgcggcgcaatcgtgatacctttcctgcgaaacccctacggaagcgacgtttcgggccgttggaatgttgtttccgttgggaattgcgattaagtccctaccgaagcgacgtttcaatcgctgaaaatgacgtttgtgtgggcaagcatgtgcttatttaggtgacgcttcacgcattttggtaggaaagtggcttaggataggcacgtaggattgtttgatgaggaagctgaagcaatggtcactgcgacggggattgcgcctggttccgaaatgacggcgcagatggagcaggtggaggagcgtaatgtctcgggcgtgctgcatatcgcctcgattttcgcctcgcacatggtattgcaacgcaacaagcccattgcggtgttcggcgcattggctgccgattgcgccggtatggaggttgtggcggaaatacacgactttgacggctccctgattgcgcaggaacatgcttattcttcgcagaacgtggtcaacggcttttcgcagtggcgcgtgatgctgcccgcgcaaccggaaggcggtccgtacacgcttcgtatcgtcgcgggcaatgatgccatcgaattcgacgacgtgcttatcggcgaagtgtggctcgccggcggccaaagcaatatggaacttgagttgcgtaacagcgagcatgccgacgaagcacttgaggattgcgccgatccgctgctgcgtttctacaatgtgccgaaaaccggtgtcatcaatcgcaatgcggaaaatacgtcgagttggcaggaatcatcgccggaaaacagtggtgtgatgagtgccgtcgcctactatttcgcacgcaagctgcgctccgaactcgaccccgatctgccggtcggcattgtcgactgctatatcggcggcacgtcgatcagctgctggatgagcgaggacgcactcaattccagcgatgccggccgcgactatctgacgcgctaccagcgtgcgatcgcaggcaagacgcaacagcagttcgagctggaaaccagcgaatggcagtcgcagatggacgcatggaacgcggctgtggaaacggtgcgtcagaccaatccgaacgcaacgagcagcgagttgagcgaacagtgcggcacctgcccgtggccgccgccgctcacccctacatcgcaatggcgtccgtgtggccccttccacaccatgctggaacgtatcatgccctactcgctggccggtttcctgtggtatcagggtgaggaagacgagcaatacagcggttcctaccgcgagctgctcggcatgatgatcggcgaatggcgtgcgctgtggagcgaaaatctgccgttcctcatcgtgcagttgccgcaatggatcaacggcaagacggctgcggacggcaacgatccgatgcgctggccggtgctgcgtgaggcccaatgggacgccgcgcagtccatagacaacgtgtacgccatctgcacgatcgactgcggcgaatacgacaacatccacccgctggacaagcgcacgcccggcgaacgccttgccaattgcgcgctgcggcaaatctacggcatggatcgcgttccggtgcacggcccgacggtgctgggcttccgatgcgacccgaacggccgcgtacgcctgttcttccgctatgcgcacggtttgcatttcgaaggcaccacgcccggcggcggcgacgacgatgatttcgatggccagctgccgactttggtgcgcgtgccggaacattccggcttcgaactggccggttccgacggtatgttccacccggcgaccgccgcgattttcgtggattgcgacatcgatgatctcgtcaattccagagtgaacgtggtcgattacaacgctacggaattcggcattccgattaacagccgcagcatcggcacgatcacgctggcgactcctgatgtgcccgagccgatggcgatgcgatacgcctggcgcagttggggtccggctccgctgttcaacgacgacggcctgcccgcgcagccgttccgtctggacctgaccgaccatacctcccccgtcgagtccaccgagcccgtcacccccgacggcaccgctgactgaggccgtcggtctaatcgccccgtctaatcgcaaaaacggcattcccatccggcttttgttaccgtaaccagccgattcgggtaacaaaagccggaagaggaggccgttttgtgtttcttgcgattactcagcggttgcagcagccgcgtcgacgatcactgccgcttcttcaccccgttcgctgccggacttgccaagcgcaagttgggcggcggcgaacagcaccgccagccagatgacgccggcgatcacggcgatgcggtagcttgcggagaagcacatgagcaccacgaccagcagcatgaacgcgatcaccacgtacggcgtcacgttggcgaatggcagcttgaacgcgatcttgtcgagcgcttccttgcccttcagccccttaagttcggccgggccatcgccagccgcaaccatgcgacggaacttgatctccgtaaccatgatcatgatccagttgatcgcagccgcgatcgtggcgatcgacatcaggtaattgaacgcgaattccggccatacgaacacgacgacaacggcaatcgcaataattatcgcggaagtgataacacccccgaccggcacgcctttcttgctgagcttacccaggtaagccggcgcgttgccctgctttgccagcgaatacagcatgcgggagttggcgtacaggccggaattgtagacgctcatcacagcggtcaggcacacgaaattgaggatgccggcggccgcgtgcacgccaacggaatcgaagatctgcacgaacgggctggaatcgccgtcgattttgctccacggaatcaccgccatgatcacgccgagcgcgcagatgtagaagacgagaatacgccagatgatgccgttcgtggccttcggaatggtggtgcgcggattctcggtttcgccggcggtgatgccgatgagttcggtgccgccgaagctgaacatcaccacgacgagcgccatcagcaggccggtccacgtgccgtcggcgttgcgggtcatcaggccgtgcggcaggaatccgccgtccacggtgaaccagttggcgaagctcgcgcgaatgcccgacgcggtcggcacgttggcgatcacgacatacaggccgccgagaatcatggccagcacggccacgatcttgatgatggcgaaccagaattcgaattcgccgaacttgttcacgcccatgagattcagcgccgcgatggccacgaggaacaccgccgccgacacccacttcggaatgttcgggaaccagtagttcacgaacgagccgaccacggcaagctccaccatggccaccagcacgtagttgaaccagtagttccagccggaaatgaagcccgctcgccgtgaccagtagcgcgtcgcgtagtagctgaacgcgccagccttcggatcctcgaccgccatctcgctcagagcgcgcacgatcatgaagatcgcgagaccgccgacgaggtaggcgagcagaatggacgggccggccagctggatggattcgctggagccgtagaacaggccggtgccgatggcgccacccagcgcgatgagctggatatggcggtttttcaacgatttacggagcgtcggcggaaccggtacatcgtcggttccacgcggcttctttgcggcggtgacgtcgctcatggagatttcctcttctctgtttccttgcgattgcgcgttgcgcgttgcgcttgctgcttgcgttgcgtgctgttgcacgcttgcatgtgcttgttttgcttgcttttttgcgattcgccctttgtgagggaacgttcccgattgtagcgggaagcggcgggcaaagtgttggtttgttcgttccggaatgtctggtttgcttaacgggttgtttggtttagaagttcgattcgcgcgattgctgtgcgattcgaacgcgcgatttggacacgtgttgcggatgtgcggtttggcgcgtctttccaagcttcatggtgttcaatggaatgaggggctacgaacggaggtcaacatggcattcgtcaaggacatgctgcgaatgtgggcgcattcgtggaaaagattcatttccatcgccatgatcacgttgctcggtgtggccgtgctcaccggcatttacgcgggctgccgtgacgcgttccgcagcaccgaccgctttttcgacgcgcagggcctgcacgacgtccaggtgctgtccaccgcgggcctgtcgaacggcgatatcgccgcgttgcgcaaggtgaacggtgttgcgaaagtgcaggcggaacggtcgcaggaagtgacgttcgatttggacggccgcaagtcggcgaccatgcaggaaatcggcacgaacggcattgaccagccatacttgcaggaagggcgcatgccgaaaaaagccggcgaaatcgcggtaaccaggaaatttattcgcgattcgggcaagcgtatcggcagccgcctcaccgtaacccccgaatcggcttcctccgatacttctgatgcttccgatacgaacggtgcggacggcacgaatgaaacgaacggcacggacgaggcgccgagcttcccgaccaagctcaccatcgtgggcgtggtgctcgatccgcagaacctgagcaacccggacggctactccgccatgacctcgttccgttccaccgccaccaccgactacacgttcttcgcgccgtccgatggtgtgaccggcaccctctgcacgtccgccacgctgctcgtcaagggcgcggccgccgaaagcacgttcgacgaatcgtacgaaaacaccgtcaagcaggtgaccgaccgcatcgacggcaccgtgaaaaccgaccgccagaaggcccgtcggcaggaactgctcgacgcgggcaacaggaagatcgtcgacgcgcgtgcggaagccgacaagaagttcgcggacgcgcagtcgcaaatcgacgcgaatcggcagcaattcaaccaacaggtcgaccagattgtcagcatgcaggcaagcgcggctgctgcgggagctgcgacaaacggcgcgaacgcaggtgcggcggcggccgcaggtgcaactaccccccaacttgacgaaaccacgcgtgaaacaatgcgtgaaaccatcatcgccgctagtcccgaactgacgcaagccaagcagcagctcgaccaggcgcaatcgcaattgaacgagcagaaggcaagtaccgaacaaacgctgaaaaccaaggaaaacgagctgaaaaccagcattccgcaagtgcgctggtatgtgcaggaccggcagtcgctcggggggttcagcgcgctcaaatccgacctcgactccatccaatcgctcggcaacgcgttcccgattgtgttcctgctggtggccgtgatgatgagcctgaccgccatggcgcgcatggtcgaagaggaccgctcgctcatcggcacgtacgtggggctcggctacgggcggctggcggtcgcgtcgcgctacctgctgttcgcgctgctcgcctgcctcatcggcggcggcctcggcctgatcgccggcttccttggcattccggcgttcctgctggtcgtattgcaaggcatgtatgtgatgcccggcctgcggctggaatacgactggctgtacggctcgctcggcatcgcgctgttcgtggtcggcgtgctcgccgccaccatctacgcgtgcgtgcaggaaatgaggcagacgcccgcctcgctgctgcgtccgaaagcgccgcgcgccggctcgcgcattctgctggaacggattcggccggtctggaatcgcatgggcttcctcagcaaagtgaccgcgcgcaacattttccgcttcaagtcgcgcctcatcatgacggtcggcggtgtggccggctgcaccgcgctgatcgtctgcggcctggccatcaacgacaccgtcgcagacctcggcatcaagcaataccgcgacatctaccagtacgacctgatggtggtttccgacgattcggacgcgtcggcgatgcgcacgaaggtcgcgtcagacgggcgcgtcacgtcgtcgcttgacgtgcgcatagaatcgggcgatctggcgatttcgggcggtggcgacggtgacagcggcaaggccggcagcagcggcagcgaaagcatccagctggtcgcggtgccggaaaagcatctgtccgatttgggcgaaatggtcacgttgcagccggtctcgtccggcatactgggcacgtccggcgtcggcaaaaccggttcgctgaaactcgatgacgatggcgtgatcgtcgcgcagtcggcggcaagcgcgctgggcgtcaaggccggttccaaggtgcgactgaccaacggcgacggcgtgcaggcgacggcgaaggtgagcgcggtgaatcgcaacctcatcggctcggatgtgtatgtaagcgaaacctactacgccaagcttttcgactcgaaagacgcgaagaacaccaagaattccaagagttccgaggattccgaggctctgacgtggaacgccatgctcgccaagctttccggctccgacacttcgcaaaccgactatgcggaatcgctcgaagaggacagttcggtgatgaaggccgtaagctgcgcgcacatggccgacagcttcaaattcgacctcatgggcgcggtggtggcgctgatcgtggcgctcgctggcggtctggcgcttgtggtgctgttcacgctcgccaatacgaacgtgtcggaacgcgtgcgcgagatggccacgctcaaggtgcttggcttcttcgaccgcgaagtgcaccattacgtgaaccgcgagatgatgatcctcaccgtcatgggtgtgatactgggcctgccgctcggccggctcgtcggcggcatgctgacgatggcgctcaacatgccctcgttgtatttcgaggtggaggtcaagccgctgagctacgtgatcgcggccgtggcgaccatggccttcgcgctgctcgtgcagctgttcgtcaaccccgtcctcgaccgcatcgaccccatcagctccctcaagtccgtggagtagcgcccctccgaagccctctcagttcttcgggtagcggtagttgtgggggggttgggtggtgagctgcgggtcgaggccgagttccttgagttggcggtcgatttcgagacgcgcacgttccacaagttcggcgcgacggctgtccaaaccgttcagcccctcctgcttttccagcgattccaacgtctccgccatacgcttgagccggtcctgatggtgcagcagcgcacgtacctgcgcatgttcgcgtacgatcgtccgccaatcggatggcgtgtgcgcaatctcccgaaccgcggtgacggggtgtatgtcggccacctgatacgtgatcgagccgagcagcggcatcaggaacaccgtaatcgcgccggctgcgaccagtgtcgacgcggtgtcgctttgcatggtgccgaccttcaccgccagcgatgtgacggcgacgatgatcggcagcgcggtcgtgcaatacagggctacggtgacgcgatgatgcgatgacagcggattctcgcgtttgtcgagcgacaacgcaacatatacgggcaccgcgcgaatcagcatgagcatgacgatgaacgcgacgagcagtgcgggccggcctgccacggcgcgcacgttgatcgcggcgcctgacaccacaaaaaatacaggaatgaggaagccgtagccgacaccctccaacttcatttccagcgacttgctgccgtcggggatgatgtaacgcaggatgaagcccgcggcgaacgcgccgagcaccgcgtcaagttcgaacagtgcggaaatggtgacaaggaagatgagcaggaatgtggtcagtcgcatgagcgtttgcgatgacgtgttcgcgttttccgtaaggaaacggtacaggcgatggccggttttcagtgctttcgtaggtagcatcgcgcacagtaggcagatggcgaggaacgcgccgagcacgagcatggtctgccagccggttcgggtggatagcaggatggccatggcgaggattgggccgagttcgccccacgttccgtacgagatgatggcgtcgccgatgggggtgccttcgaggctgcgttccttgagaatcggcatgagcgtgccgagcgcggtggtggtgagtgcgattaccgtggccacgccgttgatgccttgcttggtgaagaacggaaggaatgtcacaaccagccaggcgaggcctagcgtgattccccatgtaagcagtccgactttgccttgatgtccggcgagtcgtttggggtcgatttcgtagccggcgagcaggaacaggaacgccatgccgagctcgttcaagagtttcacggcgtcgtttacttcgatcacgcctagtccgtacgggccgagcgcggttccggcggcgagcagcagcacggtttgcggaatgaacttgcctgggatcagctgcgccacgattgggctgacggccgccaccgccatgatgatggttaatgaaacgagctcttgcgtcataccgtcgagcctagtgagccattgtgaccggaggttgaagaatgtgatttccgctatctgtggcaggtttcttcggtgaaaccgacctagggggcatgattcctaccccctaggtctggatttgctcaaggaacctgccacgcataacgcaaatcgttttcttgtgaagggcgaatctgccacatatagcacgtttcacgacattaagggggggggtcggtcgcgtttgcgaggcggccaacccccggttctcgtccgccgcgcgcgcaccacccgcccgccaaatgctatctagcttatagatggtgggtggttcgccccatttgccagttcgggggtataaatcatacccccgaaccgcctattctcgtctagcacccgccatctataagcgaaatacctttccgcaaagccccaaatccgccatctataagccagatagacctatcagtttgaccatggatagactcggttagagatgctcttggcaaaaatgccaatttcggcctcctgcaagggttttgctggggctaacccacgatttacataaaacctaacccatgatttgcgtaagtcctaacccatgatttgcgtaaaacgtggttcgctcagagctgtggccggagaccgtccaagttcgaccgacattatcggaatcgtcagggaagaaggcacgcgggcggagtgcaatataatgttccctatggctggcagttcaagggggcaagactgatggcagtttttccgcatgggagcgcgcggcgggtcgagaagcgacggtccgcagcaaattaaggacttacgcgccgacgatttttatggcgattcgcacgatggcaacgacggctcgcgcggttcgcacgacaccacgcgcaacacccgcacctacactttcccgacgttcgccgaggcgaccgacgcgtccgaagcgatgcgcgagcgtcgcgcggatcgcaacaagtccattgccatgcgcgtgcttgcggcggtgctgattcttaccgcgctcggcattggcatgtttccgagagtgttgcaataccgttcggcgcgcgagctggcgagcacgtcggcgcgttccgaaaagcgcgtggcgggctggccatacccgcaggccgatgaggcgttcgccgcggccagggagtacaacaagcgacttgccaagtcggggcagccggtgattggcgaggcgaaggatccgctcgccgaactgtatgacgatccgcagaatgcagccaacaacgccagcgccgacggctcagacaactccggcgactccgccagcgccaaagacacggaatatcaaagcctgctcgactccggcgatggcgtgatgggggccatccgtattccgaagatttccgtgaacctgccggtttactacggcacgtccgagctgacgcttgcgtccggcgctggtcacctgtacggcagtagcctgccggtgggctcgactccgaaaccgccatcagcatcatcagacagcaggcccgccgcatcgacgagctgcagcgcgaaaacgaagacctccgcgccaaactcgacgagctgaccgcctagcccgctcattcttcatcatgccggcttctgttcctcccaacagagccggcaagcgtcatctgtcagacaaaagcgggcgcattgggcggttcccgcggtagggtgtgaccattatgactttagggaatacgaataccgggaaggccggcacaaacacgcaagctgccgacgcgtctgacgcaacgcagaacgcgcaaagcacacaatcgcatatcaaatccgtcgaaagcctcgacaaagacaacgacatggaacgcggcctgaaaaatcgccacgtccaattcatcgccatcggcggcaccatcggcaccggcctgttcctcggctccggcaagtcaatcgcgctgaccggaccgagcatcatcctcgtgtacatcggcgtgggcctcatcatgttcctgctcatgcgcgccatcggcgaaatgatgtacagcgaccccagccagcacacgttcatcaacttcatcacccgctacctcggccgcgcgtggggcaagttcgccggctggacgtactggattgtgctcatcctgaccggcatgaccgaaatcacggccgtcagcacctatttcgtcacattcttcggcacgttcggcatcgacctcaacgcgtggaaatggcttatcgaactgtgcttcctcgtggcgctcaccggcatcaatctcattgccgtgaaagtgttcggcgaggcggaattctggttctccatgatcaaaatcacgctgattgtgggtctgattgtcaccgccgtggtgatgctgttcctcggtttcagctacccggccacgcatatcgaaggcgtggacggcacggtttccggtgccactgtgagccttacgaacattaccgacggcttccagcttgcgccgaacggctggatgaacttcttcatgagcttccagatggtgttcttcgcctaccagctcatcgaattcgtgggtgtgaccgtgtccgaaacccagaacccacgcaaagtgctgccgaaggccgtcaacgagctgatcatgcgcatcctcatcttctacgtgggcgctctcgtggccatcatggccatcgtgccgtggcgcaacttccatcagaacgcggacggctcgttcggctccccgttcatcatggtgttcaaatacgctgggctcgactgggccgccgcgctcgtgttcttcgtggtgatcaccgcagccgcgtcggcactcaattcgctgatctactcggcgggccgccacctataccagcttgcgcaggactccgaatcgcccgctatgcagcgcctcggtgaggtgtcggatcacaaggtgccggcgaaggcgattatcgtgtccggctgtatgattctgttctccccgctgatcaacgcgatcccgggcatctccagcgcgttcgtgctgttcgcctccgcagccagcgccgtcgtgatcttcatctacgtgctgacgatgcttgcgcaccgccgctaccgtcaaagcgccgacttcctgccggacggcttcgtcatgccggcatggcaggtgtgcgactggattgcgattgcgttctacgtgctcgtgtacgtcacgctgttcctgtccgcagatacgcgcggttccgcgatcgccggtctggtttggctcgttgcgttcggcggctactgcctgctgcacgagcgcttccagaaccgcgacctgaaggcggctctagggaagtagacgtattgcctgtcgctgcggtatgcgtggcatgcgcgtgttgcgctacgtgccgcgcatccgacgaaagagggtcggtggaaaccttgcgaaaatgtgcgtttccaccgaccctcgtcgtgtaatcgcaataaaacagtgcgaaacgttagtgcacgaatcgtacgaaatcggcgcgaatcagccgatgtagtcggcctcgttcgtcgggctggacgggacggcgtggtcctccgtaacctttcccaggccggacaggtacgcttcacggccggcctcaatcgcattcttgaaagcgcgcgccatcagcggaatgttgccggcggaagcgatcgctgtgtatgccatcaccgcgtccgcacccatctccatagcctccgcagcctggctcgggcggccgatgcccgcgtcgataatcaccggaacgttggcattcttgatgatcacttcgatgaaatcgcgtgcgcgcaggcccttgttcgagccgatcatcgcgccgagcggcatcacgcatgccgcgcccgcgtcctcaagacgtttcgctgcgatcgggtccgggaacatgtacggcatgaccacgaagccctccttggccagcttttccgtggccttgatggtctcctcgttgtcaggcagcaggtacttcgactcgtgctcgatctccaccttcacgaagtccgtctggcacacctcgcgggccagacgtgcgatgcgcaccgcctcctccgcgttgcgcgcgcccgacgtgttcggcagcatggtgatgcccttcggaatgtagtcgagcaggttgttttcggtggtgcggcagcggcgcagcgccatggtgacgatctgcgtgcccgcgttctcgatggtcgccttgatgaggttcaggtcgtaacggccggaaccgaggatgaaacggctcgtgaacttgtgcccgccgaggatcagcgggtcggcgtcgccggtggcgatctcgtcgtacgcatgagcgtccggctccggcaggatcgcggtgtttgtggtggtgccgaccagctcgtcgagcgtggcgttcggcgcggccgcgacgtcggcggctgcggtggtgatggtgttttcggtgctcatcgtcggttcctttcgttggggtgtttggtgttgctgttgttgcgattgctgtgctgctgttgtgttgccgttgcgtcgctgttgtgttgtgtgcaacgtgcgtttgtaatcgcaataaaaatttcgattacggcagtggagtaacgtagcagtgcgtcaggcgtcttcctcgccgaggatcagtcgcgtgatcatgttcgcttcgtggcaggcgaccacgcccacgcgcggcgccatcaggccggcacccggtaccggagccgtctcgccatcgccacagaagtagaagttcttcgaaacgcgacgcgtgctcaccaggttggagctgcggaagccggccatgccggacgcgctgacgagcttcttgcccggcagattctccagcaccgcgttgacgagcatcgtcttgttttccggcacgtcgaacgcctcgcagatgatgtcctcgttttcgaacagcgtcggcacgttctcgtcggtcaccttgacggtgtcgatggtgatgtccgtgaacgggttgatttggcgcagattgctgcgcagcgcctccgtcttgtactggccgaggtccttcaggaaatactgctggcgattcaggttcgtcatatccacgcggtcgaagtcgatcaagtgcaggtggccgacgccgatgcgggtcagcgccaccgcgatggtggagccgaggccgccgcagccgcagatggccacgtgcgccgcgtcgagcttgtcatgcgtggcggcggtgtggcggtcgagcagggccgcgcggatctcctcgcggctgaccagcgtggccgggtcgggctggttgtcgaaagcgtgctggcgggcgtcgatctgcgcctgcgatgcggatggttcaaaagtcatggttgttctcgtattctcgtttccgttcgtatggtttgtttcgctgctgtgctcagccgccctgcacgaacgtgacgatttccaacgtgtcggtgcccttgagctgcgtctgcgcacgctgggcgcgcggcacgatctcgccgttgagctccacggccacgcggtcggcgcgcagaccgcgctgctccactagttcggccacggtgatcggcgtggcgacgtcctcttccttgccgttgatgatcatgtgcggtgttcccttctgtgcctgcggcactggtcttgtggccccttgagtgtccgattctgcagaatcggacacacaaagtgccttccgggatgcgcggatgtccgtttctgcagaatcggacattcaggcatctgtttgcggcttccatatgtccgttttcccagaatcggacattcacggttggtacgaaaaaagggtcgccgaaggaaccgtaccctatgaggtggtgcgcccctccgtgaccctaatcacgcgatattcggttatcgcgaacggaaatgagatgcgcctcgcggcgcgaacaacccgtctccttacggcggcattacccgcatcaagtcctcggtcgaagctcgtcgagctccctctcagcctttcggctcccgttcggttgtgccctcatcttcccgcacccgcccgacaacccgctccgcgctgttttgtgcgagaatgggtggcggattttgtagcgacggatgtggcgacggaagggagacggttatgacgaccgcacgaaacatgggcgaattggcgggatttgcgattccacggctcggcatgggcacgatggctttggcgattgagggccgcccggaccgcgatacggcgatccgcacgattcacgccggcttggacgcgggcgtgcgatatctggacaccgcctggtcgtattacctgccaagccaacccggcaccggcaccgccgaagacctgggctacggcgaaaaaatggtgcgcgacgcgctcgccagctgggacggtccgcgcgacgaagtgctgattgcaaccaaaaccggctatcgccgcaccatggaggcgccgaacgttgccgaaaacgagccggaacgccagcatttgcaggctgtgggcagccagtacgggtggatggcggattcgcgtccggaaacgatgatctgcgacgcaaaggagtcggccgcgcacctcggcgtggaggcgctggacctgctgtactcgcacggaccggacccggaagtggcttatgaggaccaggtcggcgcgctgaagcagctgcttgatgagggcgtgatccggtacgcgggcatttcccgcgtggacaacgcgcagatcgacatcgcccgcgagattctcggcgacaagctgatcgccgtgcagaaccagttctcgccctcgcaccccgaccctgagcatacgatggagcactgcgcggaacttggactcgcgttcgtgtgctggagccccctcggcggcttcctcgacgcgttcgaccagcgcgcgtacgacccgttccgcacggtcgccggcaaccacggctgctcctaccagcgcgtggtgctcgcctgggaactgagccgctacgagcggttgttcaccatccccagcgcccgcaatccgcaggaaatcaacgattccttcgccgccaccgaactgacgctcacgcaggatgagctggcgatgctgaacgcctccgtcgacgcccgtcgcggctgaattccgcgcaatacgtacgattggccgcgcccgattccgcacaataatcgcgattcgggccgcggcctttttcgtgccttctgtagcttgctcgctgcaaaatcgccctgggaataacttacactgtaaaatgtttacactgtaagatattatgacggcgattgcgacggaaggaggtgccgcgtgggctttgaagaggaactgttccacgaattggcgaccaacacatgggacaaacgctcgcgcatgcagcaggagatggtgaaaggcgcgaagggcgaacccttcgccgtgcaggaactctataggaaaggcccgctgacgccatcgcagctcgcctcttcaatgaaaaccaccaccggacgcgtgtccacactgctgtccgcgttggagaaaaaaggccagatcacacgcgaatccgaccccgacgatcgccgtgtggtgcacgtgaacctcaccgaagccggcagggaacgcgccgaacggcagcgcgaaagcatgcgcgaggcgatctgctggatcttctcgcagatgggggagcgccgcgcgcgcgaattcgttgagctcaccgaggaattcaccacgtacatgtcgctgtgcatgcccggcaaaccgcgccccacggcggacgaggtcaaagccgcgttctcaggaaacgcacaggaagacgcgtagtatcttacgctgtaaataattcacagtgtaagtaatcgcaatccagtaatcgcaaaaaccgcgaaaaatcgcaaaaactaatcgtaagaaaacaagcaaaacacaaaacgtaagagaaggaaccaagcatgcttcgcatcgtacgatacctctccaaagcggagatcggtcagatgctcgtcgcgctggtcagcatcgtcggtcagatctggcttgacctgaccctgccggattatatggccgacatcacgcagctcgtcgaaacccccggcagtgaaatgcgcgacatctgggtggccggcggcaaaatgctgctcgtctcgctcggctcggcggcctgcgccatcgtcaccggcttcatcgccgcgcgcgtgggcgcctcgttcagccagcgcctgcgttcgctcgaattcaacaaggtggaaagcttcggaccggcggaaatgaaccgtttctccaccgcgtcgctcatcacccgctccacgaacgacatcacgcagatccagatgttcatcaccatgggcctcatgatgatcgtcaaagcgccgatcatggccgtgtgggccgtgtgcaagatcgcaggaaagggcttcgattggacgctcgcaaccggcatcgccgtggccatcctgctggtggtcatcgccgtgctcatgcacttcgtcatgccgaagttcaaggccatgcagcgcctgaccgacaacatcaacctcgtggcgcgcgagaacctcaccggcctgcgcgtggtgcgcgcgtacaacgccgaggactaccaggaagccaagttcaccgaagccaacaaggaactcaccgagacccagctgttcaccaaccgtgccatggccatcatgatgccgttgatgaacaccgtcatgaacggcctgatgctcgccgtctactggatcggcgcgtaccttatcgacgctgccgaagcgctcgacaagctcaccaccttctccaacatggtggtgttctccagctactccatccaggtcatcatgagcttcctgctgctgagcatggtgttcgtgctctggccgcgagccgacgtgtccgcgcagcgcgtgctcgaagtcatcgacaccgagccgatggtcaccgacggcacgcaggacgcgggcaagccgggcgaggaaggcgaaatcgaattccgcaatgtgagcttcgcctaccccgactcgcgtcaggccatgttggaaggcgtcaatttcaaagccaagaagggtcagacggtggcgttcatcggctcgaccggctccggcaaatcgtccctcatcaacctcgtgccgcgtttctacgacgccacgcaaggcgaggtgctcgtcgacggcgtcaacgtgcgcgactacaagctgaaggcgttgcgcgacaagatcggctacgtgccgcagcagtcgttcctgttcaagggaacgatcgccagcaacgtcgcgtacggagatacggaccgcgacgacgacaccgtgcgccgcgcatgcgacgtcgcgcaggcgacggaattcatcgacaaaaagcagaagaagtacgattccggcatttcgcagggcggttccaacgtttcgggcgggcagaagcagcgtctgtcgatcgcacgcgccgtctaccgtcatccggaaatcctgatcttcgacgattccttctccgcgctcgacttcaaaaccgaccgtgccgtgcgtgacgcgctcgaaaaggaagcgaaggattccacgaaactcatcgtcgcgcagcgcatcggcaccatcatgaatgccgaccgcatcatcgtgctcgatgacggcaaagtggtcggccagggcacgcacgaggaactgctcgacacgtgcgaagtgtatcggcagatcgccgaatcgcagttgagcgaagacgagctgaagcgctgaaagggggagagatgcctagaggaccaatgggacgcgggcgcgggcccgtggagaagccgaaggatttcggcggtgtgatgaagaagctgatgcgattctgccggcactacattccggtgatgattttcgcgctgatactgggtgcggccggcacggtttgccagattatcggcccggacaagcttaaggacatgaccaacgagattacgaagggtctgcctgccatggtgcacggcaagcccgtcatgaactcgatcgacatggatgcggtctcacgtatcgcatggctgcttgtcgcgctgtacgtcgggtacgcgctgctgagttacctgcagagctggctgatggctaacgtcacgcaacgcaccgctcaggagctgcgcgaggccatcagcaagaaaatcaatcgtctgccgctcaagtatttcgataaagtcagctacggcgatgtgcttagccgcatcaccaacgacgtcgacgccatcggccagacgctcggccagtcggtcggctcgctcatcacgtcgatcacgctgttcttcggcgcgctcatcatgatgttctacaacaacgtgatcatgacgctgtgtgccatcggctccgcgctgctcggtctgatcatcatgggcgtgatcatgaaggtatcgcagaagtacttcactcgccagcagattgcgctgggcgatgtgaacggccatgtcgaggagatgtacaccggacacaccgtggtcaaggcgtactgcggcgaaaagggctccatcgagcagttcgagaagtacaacaacgacctgtacgtgtccggctggaaaagccagttcctgtccggcttgatgatgccgatcatgaacttcgtcggcaacttcggatacgtggtggtgtgcgtggtcggcgcggcgctcgccatggacggcaagatcgaattcggtgtgatcgtggcgttcatgatgtacatccgcctgttcacgcagccgctgtcccagttcgcgcaggcgttccagaacctgcagcgctgcgcggccgcatccgaacgcgtcttcggcttccttgaggagccggaactgtccgacgaaaccggcaagcaggcgctgctgggcgtcggcgcggacggcaagccgcggccggtgcgcggcgacgtggaattcagccacgtgcgcttcggctacgacgcggacaagaccatcatcaacgacttctccgcgtccgtgaaggccggccagaaggtggccatcgtcggcccgaccggcgccggcaagaccaccatggtcaacctgctgatgcgcttctacgagatttccggtggcacgatttcgattgacggcatcgacaccaagtccgtgccgcgctggaacgtgcacgaccagttctccatggtgctgcaggacacgtgggtgttccgtggaacagtgcgtgaaaacatcgcgtattcgaagaaggacgtcaccgacgagcagatcgtggccgcatgcaaggccgtcggcctgcaccactacatcatgtcgttgccgaacggctacgacaccgtgctcgacgacaaggcgtcgctttcccagggccagcgtcagctgctgacgatcgcgcgagcgatggtggaggacgcgccgatcctgatcctcgacgaggccacctcgtctgtcgacacccgtaccgaagagctgattcagaaggcgatggacgcgctgacagtgggccgcacgagcttcgtgatcgcgcaccgtctgtccaccatccgcgacgccgacatgatcctggtgatgaacggcggcgacatcgtggaacgcggcacgcacgaggaactgctcgccaagggcggcttctacgccgacatctacaacagccagttcacgctggccgagtgaggttggtgtgctgactcgctaaaaaatccggagggaccacccctccggatttttgcgttttggcttcggcatttttattgtgttgcgctgacgggacggcggatttaccattgaggtgactgacgtcaatcgattgacgtatttgaaaatcacaaagaaagtgggcagtcatgaaaagcatcgaaatcggcaaatcggcagtggtcgcatcgcaagcggcgttaggcgtgatgcgcatggacgcgctggacgcggacgcggcggcggaagtcgtgcgcacggccgccgagcatggagtcaacttcttcgacacggcggacatctacggattcaacgtcaatcacgaccatgccagctcgcgtgtgctcggccgcgcgtggaaggacgccgggctcaagcgcgaggacatcttcctgcagacgaagttcggtatcaacatcgacttcagcgacccgaacaacgtgcacgccacccgctacgacttctccgcgaagcacctcatcacgcgactcgacgaggaactggaagcgctcggcactgactacgtggacttcgcgctcctgcacaggcccgacaccctgatggaggccgaggaaatcgtcgaagcgttcaccaccctgcacaaggcgggcaaagtgcgccacttcggcgtgagcaacgtgaacccgtggcaggcggaactgctgcagtcctggctcggcgacgacccggccatgaggctcgaggcgaaccagctgcagttcggcctgatgcacgcgcagatggtcagcgacgagctgatgaccaactccggcgccgaaggcatggtcgtggccaaccattcggacggcctgctgtcctactcgcgactgcgccacatgaccatccaggcgtggagcccgttccagtccggcacggaatacggcccgttcgtaggcaacgagcacttcccggagctgaacaaggcactggacgaaaagggcgccaagtacggcgtgagcgccaacgccatcgccaccgcatgggtgctcaggcatccggcgaagatccagatcgtgctcggctcgatgaaccccacccggctgggcgaaatgctcgacggcgcggacatcgacctcgacaagcaggattggtgggacctgtacgtggccgccggcaacctcattccgtgagttttgttggaaatcagaagaagcggccggggaaaccggcactgatggtggcgtgacggtcgacgtccaacgtggcgcaatcgaaagcgaaagtgctgctcagctcgttcggatccgcaacgaacagcgccgtagccaacccgtccgccaccgcagtcggatagccgccaaacgacgcggatcgcaccgcaacccaggtggcctccgtctgctgcacgggcaggccgtcgatggcgttgagcaggtggtggatcgccagatgcgtttgctcgctgaccgccacctcccaatggcgacggctgggcgcgctcgcgcagaacgcgccatcgctgatccgcgcgacgccaaccgcgcgggacggatcgtccggatcctcaagcgccacacgaatcggcttgttcgtgcgcaccagcagatcgccgcccgcatcgatcacaaattccggggcagcgctttcgcgtttgctgtctgaggtggaagattggcatgtcgggttggtcgtttcggctgacttgacatgcgatgtgcgcgaaagttctgaatcggtgagcaatccgcccagcgaatccaccagataacccttgccgcacgcgccgaaatccacatgaaccggactgcgtgtaaccaatgtcgtaccactcgaacgaaccacatcacgaccccatacggcccgtccgtgcagcgcgcccaggcgctcgccggcgtcggcttcaacggtgaaactcagcgcgggatcgtaaccgagacgaatcaggtcctcgcccacgcacgggtcgatcgcaccgcgcgtggcggcgtgcagcgcgtcgtacaaatcgaatagcgggccggcccaatcgggaaaatcgaaatgcccgccatgctccgcattgccgatgtgcgcaaccagcgaatcagcgcggaatcgcgaaagcgcatgctcgtattcatcgatgaaccgttccatctcgccgcgcaattccgcagtgatcgggtgaggcgtcgaaatcaacaaccccgtgccgagcgccttggggaacgcggtggtatacggcatgcgctgtgcgagcggtgcaatggagtccataccacgatgctagcgcgtgcccggcttggcgtagttcgtgcctggggctggcgggcgcgcgggattttgcgtgcggtcgaggcgcgggcgtcaccgaggatggtatacgcattgtcaacgccattgattggctgttgggtgattgagccaattgagacgcgtatctcgcttatagatggcggattccggggttcgcccggtgctatctcgcttatagatggcgggtctcggcggagaaacgaacctagggggcatcttttcgcccctctaacccttgtattttgcaaaggggccgccatctataagcgagataccaactgtcaccccgccaaatccgccactcataagcgagatgttttttcgtgggtgtggcatgaggcatcgccttattttgataccccccgtagctttgtatggttacgattatgctaatcgtgattatgcaagtcgcgattatacaaactgacgctttggcatggagttcgcttcacgttttcgggcggacgggggtgttgcggaacggcggtgagcgtcacaatgtgagacgacacgcggaaaacgggaaaaataaaaacggcggaattccaacgttttttcatgcgcgatacaacaagaccaattaaaaatcaagactgttattcaaaaaactttcgttctatcttggcttccgatgcgcgcttcgtacgtcgggtacgtcggggaaatcgcgccgaaaagatttgcggaaggaaggttcgacccatgtcatctcgcgtcgcgcagcgccacgcagccggttcctacgattcgtgcgattcgcgcgtctcggcttccggccgtctcatcacgctcgtcgccgcgctgatgatcgcgctcgccacgctgtttgtcggcatcgcgatgccgcggcaggcgtccgccgctgacggcaaccagacgaatttcgattcctggactgccgtcgcgcagaatatcgccaagcagctcgccaccgccgaaaaagactacaatgacggcgattacggccaggccggcaccgacttccagaccgcgcattggatcggctacgacgcatccaacttctcgaaggccgtcaacgacaccatctccgccgacaagcagcaggcgctgctcacgcagttcaccgacttggaaggcctcgcctaccagcaaggccagggtagcgcaatcgctggcaaaatcgatgcactgaacgccgatctcaccgccaccgcgcaggcgctcgatggcaacgcgaaccttgccgatcccaaaacctacgcgaagcagcgcgccgaacagaccgccgcggaacgtaagaagctcgacgcggccaaaaagaattcctccaaaggcaaaggcgaccgcacgtggagcgaagtcgccagcgaaatgaacgtcatcctcgacaaggcatacaaggccgccatctccggtaagggcgcggaaggctccagcctcgtcaacgacgcgtactaccagtactacgaaaagctcggcttcgaaaagaacgtcatgaacgccatctccggcgaccgcgtctcgcaggtggaataccagttcaagatgacccgcaaaaccatgcgcgacggcggttccgacaaggagatcaaaaagcttgtcgacgacctgaaaagctggctcgtcgaagacgcggccaccctcgacggtggcgcggccggcaacgtcaacgccttcaccaaagccatcaccagctccgccggacaggcgttcctcatcctgatccgcgagggtctcgaagcgctgctggtggtggccgccgtggtggcctacctcgtcaaatccggcaaccagcgtttcaccaagtggatttacctcggcgtgctcgcgggccttgccggctccggtctggtcgccgtgctcttcacgttcctgttcggcggctccggcccggttcaggaaatcagcgaaggcgtgtgcgcgctgatcgccatgctcatgctgctgtggaccagcaactggatgctcaacaaaagttccgtggaagcgtggaaccgttacatccgcaccaaaaccgagtccgccgtggccgacgcgcaaaacaaagtcgccgccggcgaaggcgtgggcctgggtatggtcgtttcgctcgccatgttgagcttcctagccgtgttccgtgaaggcgccgaaaccgtcatcttctacgaatcgatctactcgatgagtcgcgacgcgcaaggcatgtggatcggcggcatcgccgcgggtgtggtgctgctcgtcatcttcctcgtgctgcgcttcacctccgtaaagattccgattggcccgttcttcctcgttacgtcgatcctgatggccgtgctggtcgtcatcttcgccggcggtggcatccacgcgctcatcgaaggtgacctgatcgacggccactacctgtccagcgtgcccacaaacgactggatcggcctgtatccgtacgtcgaatgccttgcggcacaagcgatcgcggcgattgccgtactcgcgctgttcgccgtcggcttcgcacgcaaacgcaagttgcgcacgcctgacaatcgcaagtaatacgcaaattttccgagatttaccgatattttttccacatccaacaacaaaggaaagagaaatgaagaacaagaagatcgccgctctgctcggcatcctgctggccggctccatggccttctccctgtccgcatgcggcaattccaacgattccgccgcttcggacaagtccagcgcctccgcgtcggcttcaaaggccgacgactccagcaaggacgattccagcgattccgccggtttcgaagagatccaggtcgatgagaagcactccgaccaggaatgcggcccgctgaccgtcaacgccgtctacttccagccgatcgacatggaaccgtccggcatgggcctcaaggccgccgatgcgagcttccacctcgaagccgacatccatgccaaccagaagggcaccgaactcggctacggcaagggcgatttcgtgccggacctgaccgtcaactacgacatcatcgacaagacctccaacgcgtccgtcgcctccggaaccttcatgcagatgaacgcctccgacggcccgcactacggcgccaacgtcaagctcgacaaggccggcgcgtacaagctcgtgctgaagatcgaatccccggagaagaagggctggatgctgcacgtcgatccggagacgggtgtgaagggacgcttctggacggaaccgatcgaggtcaccttcccggactggaactacactccgcaggagtggtgatctcctagcgtagcccgttcgcggttaccggtgacctccgccgtgacagggcggcgctctaaccaactgagctacgcggccattgccaccttgttaccaaggtaagtaccccctgagagagtcgaactctcgttgtcagattgaaagtctggtgtcctaaccgttagacgaagggggcgctttcagcgtttccgcttgacaacttgacttactatacgcggttctgacctacatgcaaatcacggcgtgtcgcaacgcggcgcagcaaggcggaaaacactggaaaccgttggaatcacacgctttgcaaggtcatacgcggcgataggtgaaatcgtggatcacacgattggcggcaagtcccttcttctcgaaattggtgaggacacggccgtcgaaccgctccgattcgacgaaatcggcgtgtcgcaacgcggccgcctcgtccgcattgcccttgccgacatgctcgacgggcaggctcacggtgagcgtgccgtcgttatggaagtccttcagaccgtccatgacctcatggacgtgcaatgcgtagtcctcgatgtcggtggcgatgcgccacaccccgccttcggccagcgtgcggtggatgtccgaggcgagctccggctgcacgatgcggcgcttgtgatggcgcatcttcggccatggatcggggaagaacgtccacacttcggcgatggatccgtcggcggcggccttgaacagctccggggcgttgacctgggcgatgcgcaggttctgaagaccctgcttgccggccagcagcatcgtatgggccacgcccgggtcgtagacctccagcgcgaggaaattggtctccggatgcgcggccgcgacggcaacgacgttctcgccctgtccggaaccgatttccacgatcagcggattgccgttgccccaggtctcgcggatacaggcttggtcgaacacgaatccgtcgcgcacgtcgagcgacccctcgcccgcgttgatcttcagcagataggtatcggaataggcatcccatgcgcgctgcagacgcgcatcgagccgtgcggaacgtcgcacgaacgacagcaccttgcgtccgtacagcgctggcctgccgtcggcggacgcctgcgcgtccctcacgttttcgtctgttccatggccatcaatcggcgtgttttcgtcttgttgcataccctaatttatagaggaaacacaggagcgaatcgattatgtgcgttcgtgttcgcgtgttatactcaaattgttcaaaaggtaacaaactcgagcaaaagtgaacaatggttgacgttttcaccagccattgcatcccggagctcatttggaggaaaggccagaacatgacagttctcgtcactggtgggtgcggttacatcggcgcccatgtcgtccacgcgcttcatcaggccggtgaaagggtcgttgtcgtcgacgatctgagctacggcaagcccacccgcatcgaaggatcccgcctgtacggcatggatatcgccgctccgggcgccggcgagcgcctcgcggagatcatgaaggccgaaggcgtcgattccgtgatccatttcgcggcccgcaagcaggtcggcgaatccgtcgagaagccgctgtggtactaccagcagaacctcaacggcatgctcaacgtgctgatcggcatgcgcgattccggcgccaagaagctcgtcttctcctcctccgccgccacctacggcgtgccgccggtcgatgtggtgccggaagacgtcgtgccgatgctgccgatcaacccgtacggccagaccaagctgttcggcgagtggatggcccgcgcctgcgaggaaccgtatggcatccgcttctgcggcctgcgttacttcaacgtggccggctgcggcccggtggaacttgaggatccggccatcctgaacctcatcccgatgctgttcgaccgtctgaagaagggcaaggccccggcgatcttcggcgatgactacccgactccggacggcacctgcgtgcgcgactacatccacgtgtccgatctggccgacgcgcatatcgccgcgctgaagtatctggaccgcgacgagcgcaagtatgacgcgttcaacgtcggcaccggcgagggcacctccgtgcgccagatcgtcgatgaggtcaagaaggtcaccggtctgccgttcaaggagaccgtcatgggccgccgcgccggcgatccgccgcacctgatcggctccccgaagcgcatcaacgaggagatgggctggcacgccaagtacaatgtcgaggacattgtgaagtccgcttgggacgcatggcaggccaacccggagcaccacatcgacgtcgacacctggaagcagaccgactgagattcgtctcctttcccgcgaaactgcggcgcgccacgcccaacacaccgtgacacgccgcagttttgcataattgcgtttttgccgtagtatttctatctgttgtcagtcgcaaggctgaaacaacggccgcgtagctcagttggttagagcgccgccctgtcacggcggaggtcaccggtgggtcgccctgtcctacctgctgtacgccatcgccaacgtggccaccaccggcgtgctcatgtacatgttcaagttcatcctgaacaactccgccgcctactccatcgtcggcgttgtctcggtcattgccggcatcatcatggcgccgctgtacccgattctgaacaagcgcataccgcgtcgctacctgtacctcggcggtatggtgctcatggtcctcggctacctgctgttcatcgtcggcaccaacaacctcgctgtcgtcaccgtcggcctggtgttcttctacctgccgcagaccttcatccagatgactgccatcctctccctgaccgactccatcgaatatggccagctgaagaacggcaaacgtaacgaggccgtcaccctgtccgtgcgtccgatgctcgataagatcgcaggcgcctgctccaacggtatcgtcggtgctgtcgccatcgccgccggcatgattggtgacgccaccgccgccgacatgactgccgcgaacatccacactttcaaggtctgcgccttctatgtgccgctggctgtcatcatcctgagcggtgttgtgttcctgctcaaggtgaagatcagcgagaagatgcatgctgacattgtcgagcagctggaaactcagctcaacgaaggctgattcgcttttgattgcgattgaatttcaatcgtcgcgctgaaggagccgcatggtggacgccatgcggcttttcgcgtttcctacgttcgtggtaagtgctaggctgacgatttgaaacgtatagcaatgatccgttatcagcggggagcttccggaagaacggtcggcgcttttgggtgcggcctagtagaaccggcgggatcggcccgaacagccgaacgtcaagcggtcgtatgaaacctgtgcagggaagcctgcgtaagaaaacaggggagtgcggcaagcgaggtggtaccgcggtgtcggacgtgcgcaatcgcacgaaaatcatcgtcctcgtaaagtaagtaatgaaaccgccaaacgaggagcatacggtgagcgaatccaccaatcatgtgtatccgaaggctgctgccggtgagcagagcgccaatgtcgcgccgaaccccagcttccccaagcttgaggagtccgtgcttgactactgggagaaggacgacaccttccagaagtccatcgaacgccgtccttccggcgatcacagccagaacgaattcgtcttcttcgacggcccgccgtttgcgaacggcctgccgcactatggccacctgctgaccggctatgcgaaggacgtcattccgcgctatcagaccatgaagggtcaccgtgtaaaccgtgtgttcggttgggatacgcacggtctgccggccgagctcgaagctcagaaggaactgggcattgactctgtagaccagatcaaggaaattggcatcgacaagttcaacgatgcctgccgtgcatccgtgctcaagtatacgaatgagtggaaggactacgtgcaccgtcaggcgcgctgggttgatttcgagcacggctacaagaccctgaacattccgtacatggaatccgttatgtgggccttcaagcagctgtacgacaagggtctggcataccagggctatcgcgtgctgccgtactgcccgaaggatcagacgccgctgagcgcgcacgagctgcgcatggatgcggacgtgtaccaggatcgtcaggacaccactgtgtccgtggccgtgaagctgcgcgacgaggaagacgcgtacgcagtgttctggaccaccaccccgtggaccgtgccgaccaacttcgccatcgtggtcggtgccgacatcgattacgtcgaggtgcgcccgaccgaaggcaagttcgccggcaagaagttctacctcggcaagccactgcttggctcctacgagaaggaacttggcgagaactacgagatcgtgcgcgaactcaagggctccgagatggagggctggcgctactacccggtcttcccgtacttcgcaggcgacgagaacgccgccgagggcaaggtgccggggccggaaggctaccagatcttcaccgccgactacgtcgacaccgttgaaggtaccggcctggtccatcaggccccctacggcgaggacgatatgaacacgctcaacgccaagggcatcaagagcgtggacgtgctcgacgcgggctgcaagttcacgtcgctgtgcccggattacgagggcatgtacgtgttcgacgcgaacaagccgatcctgcgcaacctgcgcgccggcgatggcccgctggcccgcatccccgaagagcagcgtgccatcctcttccaggagaagagctacgtgcactcctacccgcactgctggcgttgcgccaccccgctgatctacaagccggtgagctcctggttcgtggccgtcaccaagatcaaggaccgcctgctcgaactcaaccagcagatcaactggattccgggcaatgtgaaggacggccagttcggcaagtggctggcgaacgcacgcgattggtcgatctcccgcaaccgtttctggggttccccgattccggtgtgggtttccgacgatccgaagtacccgcgcgtggacgtgtacggctcgcttgacgagctcaaggccgatttcggtgactacccgcgcgatcatgagggcaacatcaacatgcaccgcccgtacatcgacgagctgacccgcgtcaacccggacgatccgaccggcaagagccacatgcaccgcatcagcgacgtgatggactgttggttcgaatccggttcgatgagcttcgcccagtatcattacccgttcgagaacaaggaaaccttcgaacagcacttcccgtgcgactacatcgtggaatacatcggccagacccgtggctggttctacgtgcagcacgtcatggcgaccgccctgttcgacaggccggcgttcaagaacgtgatctgccacggtatcgtgctcggctccgacggacagaagatgtcgaagcacctgcgcaactacccggacgtgaacggcgtgttcaacgactttggctccgacgccatgcgttggttcctgatgagctcgccgatcctgcgtggcggcaacctgatcgtcaccgccgatggcatccgcgacaccgtgcgccaggtgatgctgccggtgtggagctcctactacttcttcacgctgtacgccaacgcggcgaagaacggcgccggctacgacgcccgccagctgcgtgccgacgaagttgcatcgctgccggaaatggaccgttacctgctggctcgtacccaccgactggtcgaaaagacccagtcctcgctggaccagttcctgatctccgatgcatgcgacgccgtgtccgacttcatcgacatgctcaccaactggtacatccgcaacaaccgcgaccgcttctggaaggaagacgagaacgcgttcaacaccttgtacaccgtgcttgaggtgttcatgcgcgtccttgcgccgcttgccccgatggaagccgaatccgtgtggcgcggcctgaccggaggcgaatccgtgcatctggccgactggccgttcctggccgacgagaagaccggtgaagccaccgaacttggccgcgtgctcgtcgacgatccggctctggtcgatgcgatggagaaggtgcgcgaggtcgtctccagcaccctgtccatgcgtaaggcgaagcagatccgcgtgcgtcagccgctgagcaagctcaccgtggtggtggaggataccgccgccgtggccgcgtacgacgagattctgaagtccgagctcaacgtcaaggacgtggagctgtgcacgcttgaggatgcgggctcccagggcctgaagatcatccacgagctgcgcgtgaacgcccgcgttgcaggcaagcgcctgcgcaaggacgtgcagttcgccatcaaggcctccaagtccggcgcatggcatgtggacgcttccggcgctccggtgtgcgagaccccgaacggcgacattacgctggaagagggcgagtacgagctgatcaacagcgtggaggagcagaacgccgaagaggccgccaactccgtgtccgcggccctgccgaccggcggcttcgtgatcctcgacatcgagctgaacgacgatctggttgccgaaggctacgcccgcgacgtgatccgctccgtgcaggacgcccgtaaggccgccggtctcgaggtctccgaccatatcgcgctgaagctgaccgttccggccggcgacgtggcgaaggtcgagcagttccgcgatctcgtgtccgccgacacgctcgccgactcgcttgacgttgttgccggcgccgaaggctccgagctcgccatcgaggttgccaaggcctgattttggttggggtgaatcagttgggctgattccgcttggtcgattcaactaagtcgaccggattggccgaattggttggtgcgatccggttgggattgggttggtttggctgaattgaccgggttgtgcggatttggcttgattgggctgatttcgtcttgatgcgaaggggtcctgccgtttaaacggcaggacccctttcacgtcgttgtcccaccctatatccttcagtctgtattccttcagtctgtattccttcagtctgtattccttcagtcccaccaacgtcgtcaccggcaaggccgacgtgttctacgccgattcgccggtcgcgggttatgcgatctcccagaccgacgaccagcttgaggccctcggtgaggacgtcggcgtgaccaaggaggccgtggccatcaagaagggtgattccgacacggccaaggcggtgcaggcggccatgcagaagctgatggatgacggcacgtacatgaagatcctcaagcattggggcgtcgaatccggcgccgtcgacaaggccgagatcaacccgaccgatttgggctgatcggcgcactgacgctgcgggcgtaggggcatcggacgtatatagatcgatgcccctacgctttttgccgattaacgtcggcgtagcattgcggttttatcgtgtgcctttggaatactggacgtctgattggcaaatggacgattaccgttcagtggatgggaagagaatagaaggagaacccactatgtcgttgaaattcaaatcgtttgccgctctcgcgctgagcgcggccatgatgttctccgtcgccgcatgcggcaccacggattccggtgacgccaaaagcgactcgaaggcgaagaacaccaccgttggttacgatgtgagcaccatcaagaaggatgacgagctggccaagctggccgcctccgcgaagaccgtcaaggacggcgagctgtccgtcggcatggaactgtcctatgctccggccgaattctacgccgaagacggcaagaccccggtcggctacgatgtggacatgtccaaggccatcgcccagacgctgggcctgaagccgaagatcgtctcctccatgttcgacaccatcgtcccgtccatcggctccaagtacgatctgggcatcaccgccatgaccatcaccgaagagcgtctgcagtccgtcgacttcgtgagctactaccgcgccggctccacgtgggccgtgcagaagggcaacccgaagaagctcgacacctccgacatgtgcggcgcgaagatcgcagtgcagaccggcaccgtccaggaggacgaggccaacaagatcgccaagggctgcaaggccgacaagaaggccgaagtgatgtcctacaagcgtcaggccgaagccgccaccgcagtggccaccggtaaggccgacgtgttctacgccgattcgccggtcgccggctacgcgatctcccagaccgacggccagcttgaggcgctcggcgacgttgaaggcgtggccaagcagggcatcgccatcaagaagggcgaccagcagctcgacgaggccgtgcagaaggccgtgcagaagctgatggatgacggcgcgtacatgaagatcctcaagcattggggcgtcgagtccggcgctctcgacaaggctgagatcaatccgaccgacctcaactgatctcatcagatagatagaaaaaggaaacagcatcatggcgaagaaacaagtcgacggcgacggcctcgatattcccaatcgcattaaagccttgcctgtcaagcgtacgggtccgatcgtggcggccatcatcgtcgcgctcttcgccgcgatgctggtgcaggctttggtcaccaatccgcgcttcgaatggaatgtggtctggaaatacctgttcaacgagaacgtactggaaggcatcaagtacacgctgctgctgaccgtcatctcgatggtcatcgccatcattctggcggtcgttctggcggtcatgcgcaaatccatcaacccggtgctgcgcggcgtgagctggttctacatctggttcttccgtggaacccctgtgtacacgcagctggtcttctggggtctgttcgcggtgctggtgccgcgtatcggcgtgggcatcccgttcacctcaatcgaattctggagcattgactcccagtcggtcatcaccgcgttcaacgccgcatggctgggtttggccctgaacgaagccgcctacctggccgaaatcgtgcgcgccggacttgaggcggtcgacccgggacagacggaggccgcgaaggcgctcggcatgaagcgcacgctcatcatgcgtcgcatcgtgctgccgcaggccatgcgcatcatcatcccgccgaccggcaacgagttcatcggcatgctgaagaccacgtcgcttgtcaacgccgtgccgttcacgctggaactgcagttcgccaccacggcgatcgcgacccgtctgtacaagccgattccgctgctgatcgtggcctgcatctggtacctggtcatcacctccatcctgatggtcatccagtcgcgactcgaaaagcacttcggcaagggcttcgacgcccgtccggccggcgcccgcggcaagcgcacgccgttgccaggcaagaccttcggcgagcccaaggatgacatcgacaagcagaacgaagccacgttcgcgggaatgaccgcgtgaggggaacgaccatgagcgaaatcacaaccaacgaaattgttcctgcagtcaaggcgacgcaggttcataaggccttcggcaatctgcatgtgctcaaaggcatcgacatgaccgtcatgccgggcaccgtcaccgtgatcctcggtccgtccggctccggcaaatccacgttcctgcgtctgatcaaccagctggagaccctgaccggcggcgagatcgacgtcgacggcgagatgatcggctacaaatacgtcgacaagggcggcgaacgcgtgctgcagaccctgaacgacaaggaagtggccgaacagcgttccaaactgggcatggtgttccagcgcttcaacctgttcccgcacatgacggctcttgaaaacgtcatggaggctccggtccacgtcaagcatatggacaagaaggaagctcgcaagctcgccatcgaggagctgaaccgcgtcggcatgggggagcgcctcgattattatccggcgcagctttccggcggtcagcagcagcgcgtggccatcgcacgcgcgcttgccatgaagccggagatcatgctgtttgacgagccgacatccgcgcttgatccggaactcgtcggcgaagtgctcaacgtcatgctcgacctcgccaaggaaggcatgaccatggtggtcgtcacccatgagatcgggttcgcccgcgaggtcgccgaccagatcgtcttcatggacggtggcgtggtcgtcgaacagggcggaccggagatcatcgaccatccgaaggagtcgaggtttaaggacttcttgcagcacgtcctgtagcaagtaaggctgtcgtactgccgtaaattcccaatccactgacgtcaagcgtccgcagacgtccggtgggttgggttttctttttgctgccgacgatgggcgcgttgcgtgtgccactggttcgcacaatttccctgggggagtgggatttcgcatatatggcaaagatttgtaaggacgcgcggcttggtttcatgattgacatccttacccgataggctaaggagctatgtgtggaatcgtaggatatgcaggaaatgttcggaccgcgtgcggcaagcctttggaggtgtgtctccaaggacttcagcgattggaataccgcggatatgattcggccggcgtggcgctgacggcgcctggcatggagcgtgtggccgtccgtaagaaggccggacgtctggccaacctggtgcaggacatcgaacgtgatccgatgccggacgccaccgtgggcatcggccatacgcgttgggctacgaacggcgtgccgaacgacactaacgcgcatccgcacacgtcgcgtgacggcaaggtcgccatcatccacaacggcatcatcgaaaacgcgtcccagctgcgtctcgacctgcagacggagggctatcgtttcgtctccgaaactgataccgaggtcgcggcgaagctgctgggcaaaatcagcgacaagatcatcgaggaaaccggtaagcctgacctgttcaaggccatccgccgtctggcccgcatgctggaaggcgcgttcaccatcctcgccacggacgtgcgacagccggacatcgtggttggcgcccgtcacgattcgccgctggtggtcggtcttggcgaaggcgagaacttcctcggctccgacgtggccgcgttcgtggcctacaccaagcgcgccatggaaatcgaccaggaccaggccgtgatggtgtccgcagacaaggtcgtcgtctccgacttcatgggcaacatcgtggaacatccgaagacctacaccgtggattgggatgcctcggctgccgaaaaaggcggctgggactccttcatggacaaggagatccacgaggatccggccgccgtgcagcgcaccctgctggggcgtctcgacgagaacggcaacatcaacctcgatgaggtgcgcatcgacgagcatgatttcaaagccatcgacaagatcatcgtcatcgcctgcggcacggccgcgtacgcgggcatggtggccaaatacgccatcgagcattgggtgcgcattccggtagaagtggaactcgcccacgaattccgctaccgtgacccgatcctcaccccccgaacgttggtggtggccatttcgcagtccggcgagaccatggacacgctgatggcgttgcgccacgcgcgtgaacagggctccaaggtattggccatctgcaacacgcagggcgcgtccatcccacgcgaatccgacgcggtgctctacacccacgccggtccggaagtggcggtcgcctccaccaaggcgttcgtggcgcagatcaccgccgcatacgtgctcggcctgtatctggcccaagtcaagggtgccatgtatcgagacgaaatcgcccagactttggaatctctgaaggacatgccccgcaagatccagtgggtcctcgacacccagaccaagaccgtgcaggaagccgccgaacagatggtggatgcgaaatcgttcctgttcctcggccgccatgtgggctatccggtggccatggaaggcgcgttgaagctcaaggaaatcgcctacacgttcaccgaaggcttcgccgcgggtgaactgaaacatggtccgatcgctttggtggacgagggcgaaccggtcgtattcatcgtgccgccggcgcgcggacgcaacgtgctgcacgccaaagtcatctccggtatcgaggaggtcaaggcccgtggcgcctacatcatcgccgtggccgaggaacacgatccggacgtggaacgttacgccgacgtggtgttctggcgtcccgcatgcccgacgctgatgagcccgctggtggacgtagtgccgctgcagctgttcgccatggacatggccaagctcaagaactacgacgtcgacaagccgcgcaatctcgccaagtccgtcaccgttgagtaacgaacgcaggcaccggtacgtgctcgaggaacctcatattcccttcgaatatgaggttctgtacgaggacgagaacatcatcgtcatcgacaagccgcatttcctcgccaccacgccacgcggcatgtggtatcgcgaaaccgcgctggtccggttgtgcgagcggtacgacgagccgaacatcacgccggcgcaccgtttggaccgactgaccgcaggcgtcgtcgtgttcgtacgtaatccgtctgcgcgaggcgcgtaccagatgctgttccaaaatcgcaaaaccgtcaaaacctacgaatgcctggcaccgctcgccccgacgcagcggccgcgatatggaacggcggtgcgcatcgaccggcacctgccgtttccgctggtacgcaggtcgcatatcaacaaggatcgcggacgattgcaggcgtacgaaagcgccgacgtgcccaacgcggaaacgctgatcgaacggggaagcggcatccgcttcgttgccggcagaccgtacgtgaattacacgctgcatccgaaaaccggcaagacgcaccagttgcgcgtgcatatgaattcgctcggactggcgatattgggcgacgatttctacccggacatcgtgcagcgcgcgtacgacgacttctcgcaacccttggaattggtggcgcgcgaactgcgattcgatgacccgctcaacggcgagccacgtcgattcgtatcgcacgtgccgttgggcgcgggcttatagaaacccacgattttggacattcccctatctcgcccgacacgcccgattatcatggcgttctgttgacttgccggagcgtttccggcatcacgagagtaagagagaaccatgggtaaaatctcgaaagccgtccgcggcgtcgccgacatctacaacggcgcatcgctgatcgtccgtatcatcgtcggcctgatcatcggcaccgtgctggcattgaccatgccccacgtgacctggatcggcgaattcggcaccctgttcgtggccgcgttgaaggccgcggcaccgattctggtgttcgtactggtggccagcgcccttgcgcagggcacgtcgaaactcgaccgccgtttcggcaccgtgctgttcctgtacctgttcaccacgttcctggcagcggtcgtggccgtgctgacctcccgtctattcccgcagaccctgtccttgggcaaggccgccaaagccgacgtggtgccgcaaggcctttccgaagtcatccagacgctgctgaccaacatcgtggccaatccgatccaggccatcatcgatggcaactacatctgcatcctgatgtgggcctgcctgttcggactcgccatgaagtccatcgccaacgaaagctccaaagcgttcatggctaacgtggccgacgccgtgtcccaggtgatccgctgggtcatcaacctcgccccgttcggcatcatgggcctcgtgttcaccaacgtggccgacaacggcctgtccgcattcaccaagtacggcagcctgctgctcctgctcgtcggcaccatgctgctcatggtgctcgtgttcggcccgctcgtcatcttcatcttcctgcgccgcaacccgtacccgctggtctaccgctgcttcaaggaatccggtctgaccgcgttcttcacccgctcctccgctgcgaacatccccgtcaacatgcagctgtgcgagaagctcgggcttgacaaggacatgtactccgtgtccattccgctgggcgccaccatcaacatgaacggcgcggccatcaccatcaccatcatggccatggctgccgccaacacgctcggcatccagatctccctgccggcggccatcctgctgtccgtggtctcagcgctcggcgcatgcggcgcgtccggcgtggcaggcggctcgctgctgctcatcccgatggcctgctcgctgttcggcatcagcaacgacatcgccatgcaggtggtgggcgtcggcttcatcatcggcgtcatccaggattccgtggaaacctgcctgaactccgcgtccgatgtggagttcgcggccaccgccgaataccatgcctggctcaagcagggccgtcagctgccggccttcatgtattccaagaaggaacgcgccaagctcggcatcgaagcttgattgcgtaccggctcagccgccgatgcgatatcgcagggaaccgctttggaagttcgcttccggagcggttcttccgcattcggcgtatttgggtggatatggggagcctttccaggcttgtgcgtggcttccgcatgacccgtataatcttatggtggtaatcgcaggcgaaatacaaaacggaggtccgtgggcgtggtgctgaaatcggcgaaactggtgaagcagctcatcgccatctgctgcgcgggcgtcatggcggccagcgccgccgcatgcggggccaatacggacacacgcacacagatcaccgtatggtcgtgggagccgagcatgaaacaggtcatcgccggtttcgaaaaagacaatcccgacattcgcgtggtttggaagaacaccagcggttacgacaaactcaacaacgccatccaagacggttacggcattcccgacgtggtgcagctggaatattacgcattgcgccagtacgcggtcagcagccagctcgtgcccatcaccggcagaaccgaaggctatgccgatttctacacgcccggcacctgggcgtcggtgcagctcaacggacgggtgtacgggcttcccatggactccggcccgatggccttcttctataacaacagcgtgttcgaacaggttggcgtggacgcgtccaagatccgcacatgggacgactactacgaggcggcgaagaaactcaagaagatcggcgtgtacatcaccgccgattcgggcgacgcgagcttctacgacacgatgatctggcttgccggcggccgtccgttctccacgtcgaacgatggcaagaacgtgaccatcagactcaccgaagataaaggcacccgcgaattcaccgaattctggcagaagatgatcgatgagggtttggtggcaacaaacctcacgtcatggtcggatcgatggaaatcggccgtgggacaaggcaaagtcgcctcgctgttctccggcgcatggctgccttcgctgctcatgtccgacattcccggcgcggccggcctgtggcgcgtggcccagatgccgacgcccgacggcaaggccaccacatcggaaaacggcggttcggcccttgccgtgctgcaacgttcccgcaaacccgaagcctcataccgtttcatcgaatacgcctgccacaatgccaaaggcatcacaacccgcgtggatggcggcgcgttcccagccgacaaaaacaccctatccgactcgaaattcctcagcaagaccacggtgaccgacgaccgtggcatcgaagtgccctatttcggcgggcaggaatacaaccgcgtgctgtcccaggccgcggagaacgtgtcgaccggataccagtatctgccgttcgaagtgtatgcgcgcagcgacttccggtccacggtgggcaaggcctacaaatggtcgagcctgctgcgcaaagagcagaacaggctcaacatcatcgccgcaggcggtcaggtctccgacacctccaacatcggcgatgcgttgaagaacaccgaatcgtccgaccgcatcaaacttaagggcggcatagccctatggcagaaggacctgaaagaatacggagccaaccagggcttcaccatccaatagcgtctgtgtaattggtttaatcgattgcggcctgcggatagcgcattatccgcaggccgtcggttttcagattgccgggctatgatcgccggttcccgtcgctggctcttgaatcagcggacgttgcggtcgtagatgtgccgcatgcccttgaaaatcaggtccggatcgtaaatgtcgatcatgttcgtgtcgtcggcgaacacgcggctcaatccgcccgtcgccaccacacggaaatcctcgtcgatctccttatggaactgcgcgatcgtgcgttcgatgccgccgaggaagttgtagtacaggcccgcctgcatggccggtttcgtggacttcgccagaatcgacttcggacgggtgatctccacttccggcagctgcgccgtcccttcccacagtgcggccgcggcggtgcggataccggtggtgatcagtccggaaatcaccgacgcgtccgcggtgacgtagttgaacgtggtggccgtgccgaaatcagccaccagaatcggcccgccatactcgtaatacgcgcccgcgcagtcggcgatgcagtccgcgcccatgttctgcggattgtccatgcggatgttgagtcccgttttgatgcccggtcccacgatcatcggatcgatgtcgaggaacttcacgatgctcgcacggaacgaatgcatgaccttcggcaccacggacgaaatgatcacatcatcgacatccgccggcttgtagccgctcaaagccaggaactgcgtgatcatcagcccgtattcgtcggacgtgtggttcgccttcgtggtgatgcggtacgtgcccgcgatgcgcccatcgtcgatgaaaccgatcacgacgttcgtgttgccgatatccacagccatcagaagcatgttgcgctctccttcgcgttttgcggaagttccgttgaaatattgcgattattacgattgatacggttattgcgattcgaaaatgctgcggttagcgccgttcgccgtccgcacgcatggctgcgagcttgacaagaatacgtttcgcaagtgagtccttgcccatcttgctccatcgttcgatgcttggcctgtctgcggtttcgcccggcgtcagcaccgtcaccacgttcgtgtccgctgcgaaaccggcgccgggggtgcgcagattgttggccaccagcatgtcgcaatgcttgccgttaagcttcttcgccgcgttggcctcaaggtcgcgcgtttccatggcgaatccgcacaatgtctggtccggccgcttatgttcgccggcccaagccagaatatccggattcgaggtgagttcgagttcgatgccgctgcgcccgttcttcttgatcttgtcccgggcctgctcgaccgggcggaaatcgccgacggccgcggccatgacggtgatgtccgtgtccgagaaacggctcgtcaccgcgtcgaacatatcccgtgcggtcgtgacatcgaccacatccacgccatacggggcgtccaacgccaccggaccggacacaagcgtcacctgcgcgcccagatcgcgtgcctgttcggccaaggcataccccatcttgccggtggaatggttggtgaggaaccgcaccggatcaagcggctcctgcgtcgggccggcggtgacgagcacggcaagtcccttaagcggcagctcaccgtccggacgattcgcaagcagcagcgctttcaccgccgtttcgatgcgtgccggctcctccatacgccctttgccggcgtcgccgcaggccagcatgccgctttccggctccacaatcgtccaaccgagctcacggcaggtattgagattgcgttgcgtcacggcgttttcatacatatgcacgttcatggcggggcacaggatcttcggtcccttgtcgtacgcgagtatggtgctggtcagctggtcatcggcgatgccgcaggcgattttcgcgatgatatcggcgctcgccggagcgactgccagcagatccgcccacttcgcgtcggccacgtggctgatctgcagcggaccgtccggtccgggcgtcacgtcggccgtagcgccgggacgatgtccggcggcgaacatggacgtgcgtgtcggcgtgtgggtgagggaactgaacgtcaggggagtgacgaactcctgtgcggcggcggtcatcaccacacgcacctcatgcccctgcttgctccaatcggaggtgagatggcaggccttgaacgcggcgatgctgccggtgacccccaaaagaatatgcgccatggatcaaccgtccttctcgttgtgacctgccgcgactgcgtcaagtatataaccgggccgaagcctccgcgcgctttgcgggcgaatccgaacgggccgcgggtatggcggacggtagaatcaggccgtggtgatcgacctcacgcaggcggtcaaccgcaatcacaacacataatcgaaaatacgaagaggagaaatcccatgtcgtcacctaccggtgcgcacggcgaagccgacgcaaccaaacaggagaacgaacagcagccgcagtccacggcaagcaccgacgccactctgaacgcgcgtgcgaaatcgtcgaacggcgcgaaatcgcaaggcccgaagaagtggcttatcgcgttgatcgccatcatcgccgccgtcgcggtgatcgtcgccattgcagtgacgcgcggcaaaaacgatgacgcgaacacttccggcgtaactaaagccgacaccgtcaccatcgggctcaaactcgccccggtcagcctcgacatccgccaccagtccggatcggccatcgaacaggtgctgatcggcaacgtctacgaagcgctgctgtcgcgcgactccgacaacaaagtgcagccgggcctcgcgaaatcctgggacatttccaaggacggcaagacctacaccttccatctcaaccagaacatgaccttctccaacggcgacaagctcgacgctgacgacgtggcctggtccatcaaccagctcaaggagaagcagtactacaacgccaaccaggtggccagcctcgacaaggccgaagcggtggacgccaacacggtcaagctcaccctttccacccccgactccaacctgctgtggtatctgaccggacgtcctggcctcgtgttcgacaaaaacgccaaatacaacgcgaaaaccgaagcagtcggctccggcccgtatactgtcgaatccttcgactcggccagcaaaatggtgctcaaagccaatccgaaatattggggaaccgcgcacaagcccgccacccagaacgtggtgatccgcttcctcaccgacgacaacgcagccgtcaacgcgctgaaaagcggtgacgtcgacgtgctttccccggtgaacgccacgctcgccaaatcattggatgccagcacatacacggtgtccgcggccgacggcagcgacaagttcgtgcttgcgttcaactgcacgaacgacaaactcaaagacaagcgtgtccgtcaggccattcgatacggcatcaaccacaaggagatcatcgcctcacgtggaaatgtggattacgcgctcggcggtccgatcccgtccgtcgaccccggttacgaggacctgaccggcctgtacccgtacaacgtggacaaggccaaggaacttatgaaggaagccggttataccaccgacaaaccgttgcggctcaccctcacctacgccaacacgtacggcaccgaactgggcgaccagctcaagagccagctcgccaaaatcggcatcgatttgaagatcgactatgtggaattctccacatggctgcaggacgtgcacaccaacggcgactacgagctgtcattggtggaccacgccgaaagccacgacttctacaagtggaccacgccggactactactaccattacgacggcaagcaggcgcaggaactgtacgccaaggctttggaagccaccgacgaggccgacagcgcgaaatacctgaagcaggcggcgaaggccgtaagcgaggacacgccggcggactggctgttcggctaccgcgtgacggtggccgtcgacaagcacgtgcagggcttccccagcaagctcagccagacggtgctgccgttgtggcagatctccaagaataagtaagggaacggtatttccatgcgattcgtgggaaagcggctggcgctgttcgtagcggctttggtgggcctgtccgcgctggtgttcgtgatgctgcgcgtattgccgggagacgtcgccgcggtcatcgccggcacgaacgccacccccgaacgcattgcgtcgctgcgcgccgaattcggcttggacaagccgctcgtcgcacaatatggcgattggatggcgggcctgctgcatggcgacctcggcgtgtccgcagtcggcggacggccggtcgcgcggcaggtcgccatgcgcgccgccgtaacgttccctctgattgtgctgagcctgctgatcgcgctggcgatcggcctgccgcttggctgcgcggccgtcctgacacgcaatccgcggctgcgcggcctgtttcacggcattgcgatcgtgggcggcgcggtgcccgcattgtggggcggcctactgctgatcctgctgttctcccgtggcacgggactgttgggattgctgcccgcgcaaggcttccccgacaccggctgggccacgccgggaaaggccctgtcctgtctgctgatgccggcgctcaccaccggcatcacagccggcgcgtccatcatgcgctacacgcgtgccgcagtgggggatatggcctcatcgcaggcggtggacatggccatggcctgcggcatgacccgcaaacaggcggtattgcgcgtggcgttgcgtctggccactgcgcaactggtgtcggtggtcggcctgaccttcgcgcaaatgatcaccggcgtgatggtggtggaaaacctgttcgccctgccgggtcttggcgccatgctggtcaccgacgtcggcaaccgcgacctgatcgcagtgcaaagcgaactgttcctgctggctgcgttcttcctgctgctgggtctcgtggtcgatctgacgcaccgcgcgctcgacccgcggttgaagcattccggcgtcgtttcgggaaaggcggaagcatgaacgcatcgaaacccgcaccatcctcgcaaccggcgtcgtccgcgcaaactacgtcgagacccgtgcgatccgtcaccgacgtgacatccactgccaccatgaaaaccgtgctttcgaccatctgggccaaggccggcggcaaatacgcgctgatcgtcatcggagcatggctgctcgtatccgccctgtccctcgtatggacgccgtattcgctgctcgacaccaacggattcaacgcgtgggcctccccgtccgcagcgcacccgttgggcaccgacggcaccggtgccgacgtgctgagctggctgatggccggctcccgcacgaatctcatgatcgccgtgctcaccgtcatcgtcgccgccgcgatcggactgctgctggtcgccgccatggtatcgcgttccggtgcgctcgcgtccacatcggtggtggtggtcgacgcgctgatctccattccgacggtgctcatcgcattgattctttccgtgccgttcggcgcgtccgccgcggtggtcatcgccgcctgcggttgcgcgtacgggctgaacctggcacgtatcctacggccctccgcactgctcgccgcacgttcggcatacgtcgaatcggcattatggtcgggggcaagctccgtgcgcgtgttcttcacgcatatcgtgccgaacacgctgccggtattgtgcgtgcagttgtccatgagcgccggcacctcgctgctggcggaggcgggactcacgtatctgggcgtcggcgtcggagccggcgtgcccagttgggggcattcgctgtccacgtccgtgaaattcatcagcgtctatcccatggccgttctatggcccggcctggtcgtcaccatggtggtggtcgcgttgaacctgttcggcgacgcgttgcgcgacgcgatcgatccgctaaccaatcccgcgttgagggaggccgcatgagcgccgtcatacgtcatctgaacatcgccatcaacggcaagccgatcgtcgatgatgtcgatttggacatcgccgacggcgaacgtgtcggcttggtcggctcgtccggttccggcaaatcgatgatcgcccgcgccatgatgggtctgctgccggcgaccgcacaggtgacgggcagcgtcgaattgggtggtacgcagattgtcggcgcgtcggacgcagcggtcgccgacctgcgcggacggtacgtgggcatggtgttccagaatccgtccgccgcgttgaatccggtgatgaccgtggcgcaacaggtcggtcttccgctgtacctgcattacgatctgtcgcttaccgaacggtcggaacgcgtcacagcgatgcttgccaaggtcggcctcggcgaggacgtgctggcgaaatacccgcatgaactgtcgggcggccaacgccaacgcgtcggcatcgccacggcgctcgtcacctcgccacggctgatcatcgccgacgaaccgaccaccgcattggattcgatcacgcaacggcagatcgtggacctgctcacgtcgctggtggacgagtcgggcgcgtcgatgctgttcatcacgcacgatttcgcggtgctgaacagggccaccacgcgctgttacgtgcttgaaaacgggcggattgaggaatccggcgatacgaccgcgcttctggaccatccgcacaccgacgcgggacacaggctggtccagtcggcacgcgcattgtcgttgcacgcagggcaggatgtcgggcagaaacccgtgcggaatcccatgcacaaggaggtggaccatgactgacacagatgaggacatggtgctgtgcggccgcggcctcgacaaatggtatggcgcgaaacatgagcgccgtcaggtgctgttcggcgtggatgtggacgtgcgtgcgggggagtgcctcgccgtgatcggcggctccggatcgggcaagaccacgctgacccgcgtgctgctgggacttgaatccgcggacggcggcagcgtcgaatactgcggcgagccggttcgtggcgatgtggcgcgcaagttgcgcatgcagtccggattggtgttccaaagcccgttcgattcgttggatccgcgatggcgcatcggccgatccataggcgagccattgcgaatgcatcatccggattggccacgggaacgcgtcgcggaacgcgtggccgaagtgctggaaatggtgagcctcgatccgggaacgttcgccaaccgtttccctgtcgacctgtccggcgggcaggcgcagcgcgcggcgatcgcccgcgccatcgtggacgggccgaaggtgttgctcgccgacgagccgatgagcgccatcgacgtggccgcaagagtccggatccttgaatccttcgaagccatccgcaacgctgaacccgatatggcgatcatcatggtgtcccacgatctgggcgtggtgcaacacatcgcggaccgcattttggtcctgcatgacggccgcgtggccgagaccggcgcgacttccgaggtgctgggccatccgcaggacgagtacaccaagcgattggtgcaggccgcctcgctgtaggtgtcgctccgcatgcctcatccgtgcgcgccataccgtctcgcatattcgtggtgcgtctcttttctataacgatttgaccgattgcgtgtcggttgatattgttggttacatggttagttagttatgtaactaaccatgtaaccaacaggatggatggtccggcatgaccggatgttcatgatcgggggactgcgatgacgcatggaacatatcaaagccacgggatgcaacggccacggcgaatcgtgacaatactgactgttcttgctttgagcatatcgttgggtgcgtgcggcacggcaggagatcggaagcaagagcagtcgttacggggccaggcgtccgccatcagcggcgatgcggacgccaacgccgcggacgcgtcgtatcgggacgaaatcgcaaaaatcaagaactccggtagcactgaagccgcccagattctcgaggacggcaaaatcacggaagaggagttggtccagcttggttccagctacgcgcaatgcctgacctcgaaaggcatcacagtggacaccggcgaggcgcgataccccggtgggtcgatcagcccgtcctacggagacaacgcgcttgacaagcgcaacttgagcgaagatgagattgccgccaccaatgccgctgacgaagcctgccagaatgagacccaatacaagaacatcgtcgacctgtatctgagcctcaaggagaatcccgagaacgtcgataccgaccaactcgcgcgccagcagaacgacaagacactggcctgcctgaaaaaacacggcatcgtggacgactccgtgaccgccgacgcctacgacgagctggcgacgatgggcgaatccggcggaacgagcttcgatgacctgatcggcaaatacgccctcaaggacaatcccgcctacgacaaacgcaaagcggccatcatcgaacaatgtggggcattgtgatggcgggcggcaaaacacccgccagagcatggtcgcatgttcggaaccgacggatggatgcggatggaaagcggcggccggcgacgcgacgacgtcagccattggccatgtcggtcgtcgcgttgttggtagtcatcgcattggcggcaggcgtcggatgcggattcctgctggtccgaccggccataccccaatcgttgcgatcctcaacggcctccggttcgatcactgcggcgaaaagcctgttcgatgatgctcgagacgtcaccgtcacggtccataccggaacggggcgcaccgtggcctcgcccaaatcgggcaccatcaccgcctatggttgcgcgcccggacaaaccatcgattccggaacaagcttcattgcggtggatgaagtgccgctgctggcgttgcataccgccgttccgccgttccgcgacctgcagtccggtatgcgaggccgcgacgtggcggcgctgaacgccgagctgcgacggcttggatatgcggcccccgacggcgatgcgatgacctgggacacgattctcgcatacaatgcgctcgccgataccgtcggcgcggcacgactggtcaaggacaacgggtggacgctagccaaagacgcttacgtgtggttggatgggcaatccgtgacgatccgttcctgcgttgccggcatcggcgcatcaatcgacgtgaaatccgaactattgaccaccgactcgcaatcgcaatcggtatccgtaaccatgccgcaggacgaggtggtcgcaggagatcgggtgcttgacgtggacggtcgaatggtcgatatgccgcaacaaacgacggtgattaccgattcgtcgacgctggcggcattgctgggcagcgacgcttatcggcaggcggccggcacagctgagtcctccgagagcgcgtcggacggcgcgtcggatgtgaccttcaccctgcaatggctcctgaaaactccaatcgatgtatggtcgctgccacccaccgctttctacgcgcaacatgatgaacaagcctgcgtggtgtccgatggcaagcccgtcgcggtcaccgtgatcggctcccgtttgggacgctcaatggccacggtcgattccggcgcggcattgggcaaagtgcgcacgaatccgcaaggaggcaaaccatgccgatgagtgatcccgttgattccacgggtcctttgatgaagggggatgatgagcggacgccgggaaaactggtgacgttgtgcgatgtcggtcacacattcactggagacacttggctgttccgttcgttaaatgctgacctgcggcccgatcgcgtgtacgcgctggtggggccttccggttcgggcaaaagcacattattgtccatattggcgggatgggtgaaaccgtcggaaggatgcattcggtggcggaacatcgggaaaaccagctgggtgttccaaaatcctatcggagtggcgcgcagaagcgtgatcgaccatgtgatgctgccttatcttgcgcagggactgcctgcgtcgcaggcggaggcgcgtgcgtgcgagctgcttgcccagttcggtctggcggagcgcgcgttcagcgaataccgggatctgtccggaggagaggctcaacggctcatgctggcgcgtggcgtggcgtcgggcgccgatctgctgctggtcgatgagccgaccgcgcaactcgatgtacatacggcggatacggtgaacgcgaggttggacgcgttgtcaagacagggcatgatcgtggtggtcgccacgcatgatcatcgcacgcgcgatgccgccaccgatgtcatcgatttggaggattaccaatgaaaccgatgcggttgaaagcggtgctgcgtgagacttggcgcaacgtcgccactggcacgagccgatgcgcgcttatctcgctgctgctgtcgatatgcgcggtcgcatgcatgtgcgcagacctgacgcagatgacggggttgatcggcgacgcccggaaatggaaggaatcaggggcctccacctatgcgatcactttgcagagaggaatcgacggcgcggcctgcgaagggctgcgttccgcgaacggagtgctgggagccgccgccctccggcagtcgtccgaccgcgtgcgcatcgcgtcattgcccgcgaccgagattccgacatgcgaggcaagcgcacatgtcgcgcaggtattcgcggcgacagggatacggaagggcaattccggtgtgatcatgtcgacggctgtggcgcgcacgtatggcgcgcatgccggcgcggtgctgccgctcgtcggcggcacacgcatgcgcgtctccgcgacgttcgattggccaagcgacggaaggcaaccaacatacggctatgcgattatctcgcccggcaacgataccaaggcctatgacacctgtctggtccgtgcgtggccggtccctgacgatatcgaaagcctgctgcgcgtctccattcgcgctgatgccgaatccggcaccggcgccgctgcgagcgccacctctgccggggcgagtggaaacaacgaaacgccgcatgcgaaaatcagccggatcaataccatgctggggtcgcatatgcctggtccggcggatttcgatgcccgcatcacccggtatgcgccactgttgatgttcgtcaccgcaatggcgttgggattcgcatcggtttgcatgcgcagaatcgagatagcgagcgcgttgcatgcgggttgtccgaaaaccgcgatgctgctgcagttgtctttggagacgttggccacggtggcggcgtcttgcgtggcatgtctgccggttgtcgcgatcgtgccgctcatattgaccggatccggtgacgcgattccggttgtcacgatgctatgccgtattccgggcgccatgttggtcgggatgcttgccggcactgcggttgggggtatgacgattcgcgaacggcagttgttcgcctatttcaaggttcgcgcatgacgtgtgccgtgtccctgcgagatgctcccgtccgttcgttgccgcatcgcggcagaccaacggttagagtggatgacgttgatattgaaccgactaggcggctggaggcgtcggatgcgattcgatttttcgggaacgacgccattgttccggcaggtggccgaacaaatcagcgaagctatcgtctccggtgccttcgcggaaggcgagcaggtgcccagcaccaccgagatctcgtccacatatgcgattaaccccgccacggtgctcaaaggcatgaatctcctggtcgaccagggtctactggagaaaagacgcggtcttggcatgttcgtcaccacgggagcgcgggagaaggctcgtgacgccaaacgcgaggaactgctcaccacgcgggtcgtcgaactcgtcgcgcaggcaaaggcgcttggcatcagctgcgaacaactacagcgcatcatcggaaggacctatcgatgagtctggtcatcagcgatctgagcaagagccgtcatggaacgtccctgctcaacggagtgaatctggaattacggagcggtgcgatacatggtctgttcgggcgcaatggtgccggcaaaagcacattgctgaacatcatcgcgaaccgactcgtggccgatgccggcagtgtgtcgttcgacggcaaccgtatgacggatggcggcggcatgtgggaacgtctcatgctgatggacgagacttggccatatcctgtcgaatggcgtctgcgatcggtgttccgtctgatctcgcggcgatacggcggattcgatgatgtgttggcggggcgtatgatgcaggctttcgggctgcggcctgatgctcgtttcatgagactgtccaccggtcagcgtggcgcggcgaagctggttgccgcgctttgcgcgccgaccgatatcgtgttgcttgatgaagcgactgatggtcttgacgctgcggcccgtgacctgtgttaccgcttcgtgattgagtcgtatggcgacagacctcgcaccatgattatatccacccatctcataacggaggtggagggactggtcgaacatgccgtggtcctcgaccatgggcgggtgctggaatccttcgacatgaacgagttggcacaacgtgggcggatgctgtcggggccggtcggatcggtacggcggtacttggccgacaatggtttgcgtacgctgtcggaaaccgttctcggtggtctgctgactgtcggcgtgcgtggcgtgccatctgcaccgacaccggagaacgttgtcatgaggtctttcgatctcaatgagtatgtcatccagattaccggcatggacaaggggtatgcgtcatgatggatgaagtgaaaggcttgtcggccgggatgcggttcgcgctgacaaggcagcttgccgcgcgttgcgtcgtattgatggcatatgtgctggttggctatggcgtgccatggctgtgggggctggttctgggactggcgtccggaggatattacgtggtggaataccatgtgcttggtccgacgttggcgatgggggccgtcgtggctgcggtcctggcggcgagcggcttccgctccctgatatccatgggcgtgggcaggggcgtgtattgctggacccagatgctcgccaatctctgtttcgccttcgcctgctcggcggtggtgacgtttggcttcacgctcacgccgaaccgtgatgcggacatcctcatcacgttccgcgtcggcagagacctgcagtggctggcctgcacgcctccatccgacgcgttcggacgattgcgcttcctgaaccgcgatcggggcggttcctacgcgtatatgcggtccgggtcggattatgcggccaatccgatgatgctgttcctggcggtgttcctgttggtcgcctcggcggtgattctgggccaatgcgtcggggaactgctggcacgggtcaaccggtacgggacgatcgccttggtggcgtccgcatgcgtggcatgggcggcccgcccgtggctgatgaacaggtccgccaccgatgtcaatccggtgatatggaagctgctcgaggcgctgcatgggcgctggtgcctgatgtggcgggagggacaggcggcgcccgcggcgatgtacggcacatccaacgagcgtctcgtatacgatcaggcctacacgttctggccgatgatagcgctgttcgcaggcgtgatggtgttcggcaacctgttgtgctggctgttgatccgccaccgcgaggcgcgtgtcccgcagctggttccggtatggtggtgacgacgcctgacaggaaggcaacacgccgatgtccatggttgtggtaatgtttgagccatgttcaatttctcatgttgttgctgtcgctgaccaaccgcccgaggggcgcgtggttcatcgacgcataacttgagataggacattccagaacgttcggcgtggtcgccagaacttcgattttccggattcccgtaacgtatcggcatgatcgccaaccttcggcatacggcataccgtaaccgtatacggtaatcttcgcacaaacgcgaaaatcccaacaggtcctgtttcaaccgctgcacatgacgacgtggcttcccgggagcgcatcccaaccgaatccccgaaaccgcaaaaccccaaaggaaacgtcatgaccatccacaacagcaccgcagaactcatcggcaacaccccgctcatccgcctcaatcatgtgaccgaaggcatcaaggccaccatcgcggccaaagtcgaatacttcaaccccggcggctcgtccaaggaccgcatcgccgaacgcatcatcgacgcggccgaacgcagcggcgaactgaagcccggcggcgtgatcgtggaaccgacctccggcaacaccggtgtcggactcgcgctcgtggctttgcagcgcggataccgtgcgatcttcaccctgccggacaaggtttccgaagccaagcgtgcggtgctgcgcgcatacggcgccgaagtggtcgtaacccccaccgacgccggccccgacgacccccgctcctactaccaggtggcagaccgcctcgccaaggcgattcccggcggctaccgtcccaaccagtacgacaatccgaacggtcccgaaagccactatcacaccactggtccggaaatctgggaggccaccgaccacaaggtcacgcatttcgtggcgggcatcggcaccggcggcaccatctccggcaccggacactatctgaaggacgtgtccaacggcgcggtgcaggtcatcggcgccgatccggaaggctccatctactccgacccgaacgacgtgcaccaataccagatcgaaggcgtcggcgaggacttctacccgaaggccttcgaccggagccttcccgacgagatcgtgcaggtcaccgacgcggaagccttcgaaatgacccgacgcctcgccaacgaggaaggactgctcgtcggcggctcatccggcatggccgtgttctccgcgctgaaatacgcccgcgagcacgacctcgacgaaaaccagctcgtcgtggtgctgatgcccgattccggccgcagctacatggagaagatcttcaacgacgactggatgcgagccaacggattcgccgacgtcgtggaacgcaccaccaagcccagcctcgccgaacagtacctgtaaaagaccgtcaaacgactgtccggaagcccgatcgcacctttgaaaccaatgcccatcatccgaacgacccaaaccatccgatacttccaaggagttcccatcatgaccatctcgaccaacaccgaagccctcaacgccaccgctctcgccacccgcgccatccacgcaggccaggaacccgacccgaccaccggagccgtggtcacccccatctacatgacctccaccttcaagcaggacggcgtcggcggcctgcgcaacggctacgactacagccgttccatcaacccgacccgcaacagcttcgacgagcagctcgccgccgtggaaggcgcgaaatatgcgttaagcttctcctccggacttgccgccatcgacgtgctgctgcgctccactttgaagcccggcgacaacatcctgctcggcaacgacgtgtacggcggcacctaccgtctgctgtccaaggtgttcgtgccgtggggcatcggcctcgacgtggtggacatcaccgacacggccgccgtctcagccgcgctcgccaagaagcagtacgcgtacatctgggtggaaaccccgtccaacccgctgctcaacatcaccgacatcgccgccaccgcggccgtggcgcacgcgcacggcaccaaagtggtcgtggacaacaccttcgcatccccggtattgcagcatccgctcgcagacggcgccgacgtggtcgtctactccaccaccaagtacatcggcggccactctgacgtggtcggcggcgcggtggtcctgaacgacaaggaaacacgcgacgcggtggccttcctgcagaacgcggccggcgcggttccgtccccgttcgactcctggcttgacatccgaggactcaaaaccctcgacctgcgcgtcaagcagcacagccgcaacgccatgaaagtggcccagtggctcgaaacccgccccgaagtggaacgcgtatggtatccggggctcgaatcccacccgggccacgacatcgcggcacgccagatgcacggcggtttcggcggcatgatctccatccagatcgccgccggtttcgaagcggccaagaagttcgccggagccaccgaagtgttcaccctggccgaatccctgggcggtgtggaatccctgatcgagcatccgggcgccatgacccatgcctccgtggccggcaccacgctcgaagtgcccgccaacctgatccgcctgtccgtcggtcttgaggacgcggacgatctgatcgccgacctggagcaggcgttccgccagatctgaattccctatttccgatagaagcatgaaacggccggcatgggtaagacccgcgccggctgtttcgctctccgcggtcaacgcatggcattgctacacttggaaaccatgacgcaagctgttgattccgccgattccgtagacccccgcgcattggaggcgctgaaccgctatttcggctacgattcgttccgccctggacaatccggcatcgtctcggccatcctcgccggacgtgacgtgcttggcgtcatgcccaccggcgccggcaaatccatctgctatcagattcctgcagcgatcctgccgggcgtcgccatcgtcatttcgccgctgatctcactcatgcgcgaccaggtcgacgccctgaacgacgtgggccttccggccgcgttcatcaacaccactcagacgccggacgaacaggatctcgtcttcgcgcaggcgctctccggccagatcaaactgctgtacgtgacgccggaacgtttggaaaccgaacgattccgcaacttcgccgtccgtgtgccgatctcgctcgtcgccgtcgacgaagcgcactgcgtctcccaatgggggcaggacttccgttcctcatatcttggcatcggcgaattcatcgccggactgcccacacgtccaacggtcgccgcgttcaccgccaccgccaccgaacgcgtgcgccgcgacatcgtttcgattctgggcctgcacacaccgtccatcaccgtcaccggtttcgaccggccgaacctgtatttcgacgtcatcagcatgccacgcaaaggcaaagcatcctgggtggcgtcctacatcgccagccatccggacgaatccggcatcgtctactgcgccacgcgcaaggaaacggaagcgctcgccgaatcgcttaacagcgccgtcgccgaattgcgtgccgcagggggtgcggatgtgtcggatatcggcaccatcgccgtcgcctaccatggcggtatgagcgccgacgcacgagagaaggcgcaacgcgatttcgtcaccgaccgtgtgcccgtggtcgtggccaccaacgcgttcggcatgggcatcgacaaatccaacgtgcggttcgtcatccaccacaacatgcccgaatccatcgaagcgtactaccaggaggcgggtcgcgccggacgagacggcgaaccaagccgctgcacgctgttgtggaacgaatcggacatcgtcacccgccgccggctgctcgattcggattacgaaaacgaacgattgactcccgaagagcaggaggccgtacgcgcgtcgaaacgccggctgctcgacgtgatggtcggctactgccgtaccacggactgcctgcacgcgtacatgacccggtatttcggcgaaaccgcgggcgcggcggcgaaaacggacggcaaatgcgtgggcggttgcgccaactgcgagcacacattcgaaaccatcgacgtcaccgacatcgcccgagccgtcagccgttgcgtgcacgatgtgaaccagcatgtcggcagcggtaaaatcgtcaaggtgctgcgcggctcgaaggcacagaatctaagctatctcaaccccgaaagcctgccgtcgttcggcatgctcgacgaagtgccggaagcgcgcatccgcgatgtgctgagccagatggccaccgacggcttcctgacgatcgcggaaggacgcctgccgatcgtcggcttcggaccccgtgcggcggaaacggtcgcacccgaattccattacgacatcaagaagatcaaacgtgctgacgcccgtgcgcgtcgaacgcccgacgtgtccactcccgctgtcggatcgtacgtgccggatgacggcgacgaggcgctattccagaagctgcgtgcgctgcgactggacatcgcgcgcgaactcggcaaaccgccgtacatcgtgttctccgacaagacgttgcgtgacatggtacgggtcaagccgatcactgacgaccagttccttgccgtcaacggtgtgggggaaagcaagctcaaacagtacggcgaacggttcatggccgcgattcgggaggattccggcgacgaggcttgaaccggccataaccgacacgcatggcacgacggttgacgttgagcccgcgaaccgtgaatagtggaatgtgaacacaacaacgaaaggacagaacatggcggaagacaagccggtggtggaaagcttccaattggaccacaccaaagtaaaggcgccgtatgtgcgctacatcgatacggaaaccggcccccacggcgacgtgatctcgaactacgacctgcgattggtgcagccgaacgagaacgccattccgaccggcggactgcacaccatcgaacacaccatcgcggtgctgctgcgcgaacgcatccccggttacatcgactgctcgccgtttggatgccgcacaggcttccacctgctgacgtggggcgagcattccaccgaggatgtggctcgcgcattgaaggaatcgttggaattcatcgcctacgaggccacatgggacgacgtgccggcaaccaccatcgaaagctgcggcaactaccgcgaccacagcctgttcaccgccaaggaatggtgcaaggacatcctcgccaagggcatcagctccgacccgttcgaacgccgccttgtgtgagcgttaccatgcctgtgcggtgggcgtggtagtttggacggctggaatgcttgagagaggtatacagtcgaattgaggtgaaagggttgagcgaaaccacttccgaacgtcggttccgtcgtgccaccatggatgatctgcctgtcatgctgaaaatctaccagcatgcgcgtgagcttatggcggccaacgggaatcccacgcaatggggaaacacgttcccacgtgaggaagtgatccttgacgacattcgccagcagcgcaccatgctgctggtggacgaggctgacggcaaggagcgtgtgctcgcccagttcgccctgtgcacgggcgaggatcccacctacgcgcatatcgacggcgcctggctggacgacgactcgtatgtgaccgtccaccgcatcgcctcgtcgggaatcgtcaaaggcgcggccaaggactgcatcaactggtgcatcgaacattacggcaacgtgcgcgccgacacgcatccgaacaacaaggccatgcagcacgtgctcgaatcgaacggattcgcccgctgcggcctgatccaactgcttgaccgccccaccgataccacgcgtatcgcctaccagcgtcacgaatggtgattgcgcatacatagaaacatagaaaaaaggacgtctcccgtaaaactgcgggaaacgtccttttccatatgaagggatgattagaacagtcccggctcgttaagctgagaatgcttgcggctgtacgtgaaatacacgaccagtccaagcgcgaaccacacggcgaaacgcacccacgtctcccaattcaaaccgaagatcagaatcaggcagaagatgatggcgcagattggcgtgaacggcacgcccggcgcacggaagccacgatgcgcgtccggctgggtcttgcgcatccacaggatgccggccgacacgatgatgaacgcggacagcgtaccgatgttcaccagctcgaacagcacgttgatgttgatgaaaccgccggcgatggccgtcagaatgccgaagaaccacgtgcccttgaacggtgtgcggtacttcggatgcacttcgccgaagaacttcgggaacagtccgtcgcggctcatcgcatagcagatgcgggactggccgtacagctgcaccagcatgacggtggtcatgccgatcaacgcgccgaggttcacgatgaacgccagccagttgaggccggtctcgagaatcacgcccgccaccggagcgtcgatgaacttcgcgaactccttgtacggcaccacgccggtcatgatgagcgtcatgatgatgtacagcacggtggacacggccagcgaaatcaggatgccgcgcggcagcgtcttgttcggattgatggtctcctcggcggaggaggacacggcgtcgaagccgatgaagctgaagaacacgatcgacgcggccggcacgatgccgtacggttgcgtcgaacccggctggaacgtgtagatgccatacggggagaacggtttccagttggcgggattgatgtaccagacggtgcacacgatgaacagcacgatgatggccagcttgatcatcaccatgatgtcgttggtcttcttcgtctggttgatgccgatggacagcacccacgtgatgataagcacgatcacgaagccgggcagattgaaatacgtggtgactcccggcgtggtgccgtatgcggcggtcagctcgaccggcagatgcaggccgaagccttccaacagcttgttgaaatagcccgaccagccggcggacacggtggccgcctgcaacgcgtactccagaatcagatcccagccgatcacgaaggcgatcaactcgccgaacgccagatacgcgtacgaataggcggagccggaaaccggtgccatcgcggcgaactccgcatagcacaagcctgcgaagccgcagcagatcgcggcaagcaggaaggacacgcataatgcgggtcccgcggtgagcgcgcccttgccggtgagcacgaagatgccggtgccgatgatggcgccgatgcccagcatggtcaggtcgaaggttttcagtgttcgcttcagcggagtcgattcggagacaagttggtccaccgacttcttgcgaaatagatccatggtcgtcagattccctgtgattgtttcaaaaatgggctggaccggacggatttccgggactctggcacgccttaacgccagaaatcagaaaggccgcggcgatatgcgcaacagccttgtgtatggaaagtgtaaaaaacactgccggacaaaatcgtgaaaacatcgtgaatcgtctcaccatatgtccctgatgttccatacctgtcacatagcggcgcgacaatgggagccatgactttgagcgcaacacgtgaatgggatttctcctccgaacaaggcaaagcgaactacaaggccgcccagcggcggtatccggcgcaggccatcgtcgacctcgccgcactgcgcgacaacatgcgccacctggtgagtgtcgtcggcggaccgcattccggcaccgccgtcatgggcatcgtcaaagccgacgcgtacggacacggcctgatccccgccgcgcttgccgcgctcgcaggcggcgccacgtggctcggcaccgcgcaatcgcatgaagcgctgttgttgcgcaaggcgggcatcggccccgatcgctgccatattctgacatgggtctacagcggcgccgaagtgccgttcgacgagctgatcgacaacgacatcgacatttccgtcggctcgctcgccggcatcgacggtgtcgccgcggccgcacgcaggcttggcaagacggcgcgcgtgcatgtgaaggtcgattccggcttcggccgtaacggcttcacgcccgccggtttcgacgcggcgctcgccaaactggtgccgctcgccaaggaaggcgtgctgcacatcgtcggccagtggagccatctggcggtcgccgacgcaccggacgttccggaattcgttgcctccaccgacatgcaggtcgaaacgttcaaggacttcacccgtcgtatggaggcggccggcattccgccggaaatccgccacctcgccaacaccgcggcgacgctgtcccgtccggaaatccacttcgaactgacccgtccgggcatcggcctgtacggttacgaagccgatccggccatgggcacgccgtccacgtatagcctgaagcccgccatgaccctgcaggcgcagctcggcaccgtcaaggacgtggaagccggccatggcatctcctacggccgtacgtatctgactccgtccgacacctccaccgcgatcgtgccgctcggctatgcggacggcatccaccgctccgcctccggattcgacatggaaggcgccaagcacgtgaccaagcccggtggtccggtgcgcgtgatgaccgcggaaggcccgcgcctgtaccgtgtgtccggccgcgtgtgcatggaccagttcatcctcgacctgcacggttccgccgccgaactcggcattcacgaaggcgacaatgtggaactgttcggtccgggccgtggcgaggattacgccgaaccgaccgcggacgattggggtcgtgccgccgacaccatcagctacgagatcttcacctgcctgcgcaaccgcattccgcgcctgtacgagcatgccacggacgtattgtccgccggggacctcgccaagctcgacccggcaagcatcctgtaatcccgtaaaaagcggcggcagccgccgcacccataggaaggcggtgcatcatgacgagcgaaggatacagcgcgttcgacgaggagcgttgggctccggaaccacccaaatccagctcccgcaccgccttccaacgcgaccgcgcccgactcatccactcgtccgcattgcgcaggctcggcgcgaaaacgcagattctggtggccggcacggacgatttcgcacgtacacggcttacacacacgttggaggtcgcgcaaatcggtcgacagatcggcacttcgctcggttgcgatcccgacgtggtcgactgcgcctgccttgcgcacgacctcggccacccgccgttcggccataatggggaacgtgcgcttgccgaaatcgccggcaatatcggtggtttcgaaggcaatgcgcaaaccttgcgattattgacgcgcctcgaaccgaaaatactgtttcccgacggacgttccgcaggcgtcaatctgacgcgtgccgcgctcgatgcggccgtcaaatacccgtggacgcttgccgaagccgccgcgcatccgaaaggggagcgcagtgcgaaattctgcgtctatccggatgatacggacgtgttcgcctggctcaaacaacacgcgcccgacaccacccgccgtcccgtcgaatgccaggtgatggacctgtccgatgacatcgcctacagcgtgcatgacgtggaggacgccatcgccaccggcgcgttcaatccgggcgaactgcacgaaaacggagtgatcgacgcggtcgtcgaggacgcgcgcgcctggtatggtccgcaatgggacgccgacaaactggtggatgcgttcgcacgaatgcaccggcgcgacacgtttcccggctatttcgacggttcgcgccgcgcgctcgccgcattgaagaacatgaccagcgatctgatcggtcggttcgccggttccgtggaacatgccacaagagatacgtacggcaacgagcctttgacgcgatacaacggcgatttggtgattcccgaggaaaccagctacgaaatcgtggttttgaaaggcatcgccgtgcatttcgtcatggagcccggcgaacgtgagccgatgcacggcgaagaacagcgaatcgtcaaagacctggtcgacgtgttcatggcggacaatcccaaaccgtcaagcgcattggagaatgtgttcctcgacgattggcgtgaggccggcggcgacgacgaacgcctgcgcgtggccatcgaccaggtggcgagcctgaccgacacgtccgccctgactctccactcccttctctgctgacgcgtatacccccgtttcctgtgtggcgagtcaatgagattcataagtgccgcgtagcgccatgtatgttgtccgaccgtaggcttggccgaacggccttgagtgtgtcggatgacatacatggcgtggagcggctggctgtgtgcctaaggcaaagttgagtgtgtcgcgcgttgcatacgccgcgtagccataacctatggcatcgctggtaggctggaccgtatgccgggaatgatcaagaaggaagacatagaaaaggtccgcgccaccgccgacctgtatgacatcgtatccgcgaccgtcacgctcaaaccctccggaaccggcacatacgtaggcctatgccccttccatgacgagaaaacgccaagtttttccgtgcgcccggcgcttggcgtatggcattgcttcggctgcggtctcggcggcgacgtgttcggctacgtcgaacatcaggagaacatcgactttcgtgacgcggtggagctgctcgccgacaaataccatatcgaactgcattacgacaaagccgacaacgtgcccgcgcacaccggttcgaaacgcgcacgtctgctcgaagccaacgaggcggcgcaggaattcttcgtctcccagctgatgaccaaggaggcgctcgccgcgcgcaagctgttggacggtcgcaacttcagccaggccgactgccagcggttcggctgcggatatgccccccaaggatgggataacctggtgcggcaccttgccggcaaaggcttcacccagcaggagatgctcgacgcgggactcgcccgtcagggccagcgtggcgtatacgactatttccgtggccgcgtgacatggccgattcgcgattcgaccggccgtacgcttggcttcggcgcgcgcaagctgtacgaggatgacacgatcaacgcgaaatacatcaacacgcccgacacgcagctgtaccgcaaaacacaggtgctgtacggcatcgaccttgccaaatcggcgattgtgaagaaacgccaggcggtgatcgtcgaaggctataccgatgtgatggccatgcatctggccggcatcgacacggcggtcgccacgtgcggcaccgcattcggcgccgagcatgcgaagatcattcgccgattgatcgcggacgattcgttgggcgcggtcctgctgaaccgttgagcttcgtttgtttcccattgaaatgaacatggagggaccgtccgcatccaccggagggttcctccgtcttgttttccccgagaattccatacagtgctggtgaaggaagattttatggttacgaccaatgcgccgatcataacgctacgcgatgtgcgattcacctatgatggcggcgcgacatgggcgcttgacggtgtgagccttgacatccgccgtggcgaacgcatctgtctggccggaccgaacggttcgggcaaatccacgctgtcacgtgtcatcgccggactggtggctcccgatgagggatatgtcgcattgtcaggcaatgtggtgttcgacgagtccggcgcgcacgccgacgagtatcgaaccgcccgttgcggcataggcgcggtgttccagcatcccgaagaccaaatcgtcaccaccgtcaccgaagacgacgtggcgttcggaccggagaatcttgcgattgagcatgatgagatcggcctgcgcatctccggttcgctggacgccgtggatatgagcgactatcgcgcttccgatccgacgcgcatgagcggcggccaacaacaacgcatcgccatcgccggcatgctggcgatggattccgatgtgctcgtgctcgacgagccgaccgccatgctcgacccgcaagggcgcgccgacatcatgcgggtgctggacgaactccaggaccgcggcaccaccatcattctcgtcacgcaccatgcggacgagttggaacatgccgaccgtgtgattcagctggaagcaggccacatcgtaggcgatggccccgccgacgagcggcttcggatgccggttcaatcggtgggcctaccgaaacgcattgatgatgagcccgccgaaacgctcatcgaagcacgcgacatatcgtatcgttacgtggacgccgaacgtgacgtgttcaaccacctgtcgttcagcatcggcaaaggcgagacagtggcgttgatgggacgcaatggcgccggcaaaaccacattggcgcgcatgctgtgcgcgttggagaaacccacgacaggctcgatcgtcatcgacggcatcgccgtggccactgcgaaggcgaacggcggaacgaagcccctcaatcgcaaaaaccgtacgaggctgcgccgtacggtcggctacgtcatgcagcatccggaacggcagctgttcgccgacaccgtggccgaagacgtcgcatacgggccttccaacctgggattggatacgtccgaggcgatggaacgcgccatgcaggccatgcggctgctgcatatcgaacatctgcgagaccgttcgccgttcgacctgtcgggcggccagcagcgactggtggcgatcgccggcgtgattgcatgcgagccgaaagcgttgattctggacgagccgaccgcaggtcttgacgaggaggccgccgcacgcgtgcacgggctcatccacgagctcaaatcacgcggcgtgaccatactgctcatctcgcattcgcaggatgaagtggacgagcttgccgaccgtaccatcatattgggcaagccggcgaaacgtgcggactctaaggaatccacggaatccacagtgaaagccacctgcgaagaggagccggatgcggaaccatccgtggacgccgccggctcggacaccgcgaccgtgggggagcggcggaccctgttggaacgcctcgatccgcgcgtgggcatgctgtccgcattggcgctcatgttctccgcgttcgccatcggctcattctggcaattgctgcttgccgtggtgttcaccggcgtgatcgccgcggccggacgcatcaatgtaggccgattggccgcttccgtgcgtgtgttcctggcattgttcgttttctgcggcctgctgaacatcttcttcgtgcgcaccggcaccacggtggcgagcctcgggccgattcccatcaccgatgacggcatccgcatcgccatactctacgcatgtcggttcgccgtggtcatcgtcatcggagcgatgttccttgcctccaccacaccgaccgccatgaccgacgcgttcgaatcgctgctgtcaccgttcgccagattcggtctgcacacgcaggagacggcattggtgatgagcctcgccctgcgtttcctaccgacgcttggtgtggaaacgaaagcgatcatcgacgcgcagtcggcgcgcggcggcagcgtcgaaacaggttcgttcgtagtacgcatcaaagcgatggtggcggtcgtcgtgccggtcttcgccgcagccatccgccacgccgacaacctgagcctcgccttggacgcgcgctgctatgaggaaggtgcgacgcgcacgcattggcgtgtcatgcgcgtcaccggcatggacgtggccgtggcgatcgtggtgctcgtctatctcgtcgcactggtcgtgctgggcgtgctgttatgaccggtgcgttgcgggcggatgggcaaataccgtcctcacgctaggcttgagcgggtatttgtagataggaatggaacacatatggcacttaccaaaaagcaggtcaagcagctgcgcggcctggccaccaaactcaatccgctcatccaggtcggcaagaacgatctgagcgaaaacgccgtcaaacaggcggacgagaccatcgagaagcgcgagctcatcaaatgctccgtgctcgacggttccggtctgaccgccaaggaggccggcgaaggtctcgccgaacagcttggcgcggaactcgtgcaggtcatcggcaaccgtttcgtgctctaccgtcgttcccagcgtgacgacgtggagcacattcgtctcgtgcgcgaatagcgatccgaacgttatatgaagcggcccgccctccgaaaccaatcggaaggcgggccgcttcatatggaaataaacaatcggaagagagcgtgccggagaatcagctctcctgatcccattcgggcttccacgtgtactgcatgtcgtacgcgctggaccagaacatgtactcgttctcaacgccggtcacaaaaatatcgaccagctcctgcttgcgttcctcgctcacctcggcggcgagtttttcgatatgctcgatcagccaagccgaaccctgccagaactcgtcggtcttgtacatgtccacccagctcttgtactggttcacatcgagcgtgtcggcgaattcatgggcaagacgatatccgtaatccgcgtacacccaggcgcaggggagcacggccacgagaatgtcgaggatacccttgccataggcgatggaaaggatgttcgacgtgtacgcgcgagcgaacgccgactggcgcacgttgttcatctgctcgtcggtgatgccgtagctggccagatacgtgcggtgcacggtcgactccacattcaacgcgccgttctgcacgttgagcatgaacgccatgatctccggatcgtctgttttggccagtcccaaagcatgcactctggcgtagtcgttaagataacggaaatcctgcagcagatagaatgcgaacttctcgcgcggcagagtgccttcgcccagttcgcggatgaacggctgcctgtagccttcctcccatacgaggtcggcggctttgcgcagccgctgcgcgaatgggggaagattggttcgcgtgacgcccttcgaagcgtcgaacgcggaatcggaattggttacggaaatcacatcagccatatggccatgcctccctacgctggtgtcaaccatcaggttcaaagggttcggacgtccacgcccatctcaatccgtcatacggattcccctgcatacgcggttcattatgacaaacaagttcgtgccgtgcaaggttctgtccatatttgtcgcggattatgcccgtgctcggctccatatcgaacatggccgatgtgtggttgagggccggtgcaagaatggaacgtatgactgaaaagcaagttgcgaagaagaccatcgaaaagctggctatcgtcgtggtgacctacaagcgccagcagctgctcgccaccctgttcgaatccatcgagaagcttaccgtcgccccgtggcgcatcatcgtcgtggacaacgagcacagtgacaagacccatggcatggtcgaagaattcagcgccaagctcaccgcgcagtggggcaccaccgtggccgacctgtccggcaacgagaaccgcgtggtctacgcgccgcagaccgacaacctcggaggcgcgggcggtttctccgcaggcgtgaagaaggcgtacgagctgggtgccgaatggttctgggtcatggacgacgacgtcgccgtcatgccggaaggcatcgagcgcttggccaagtggaccgatcggcacgacgtgattcagggaagccgctacgactatgatggcggtccgttctactggcagtacgatttcatcgtcccgctcggcattccgaacccgatcgcaccggctgcgttcggcccggctggctatcgcgtgatggacacgttgtgcttcgaaggcggcctgttccgccgcaacatcgtcgagaagatcggtctgcccgacccgcgtttcttcatctattgggacgacacgatgtacggctatcgtgccagcaaggtcaccaatccgatcgtcgtgcccgacgtggtgctgcgccgtacgcgcgagatcggcaattgggacatcgccggcgtgcgccagctcaactccacttccgacatgaaccgctaccacatcatgcgcaaccgcggctacatggcccgatacttcatgacgtacggcgattaccgtccgctgttgttcggtctgggtacggtgctgaccgcggtcaaggaagtgattcgactgatgatggtggaccgcgagcatttcaagaccggcatcgttcagatcgccaagggatggtgggattcgcgcaagctgctgcatgatccggaatggcagccgatgccgccgctgaagtaacaccgtggcccacgcgtttcccaacgcgcggcgatcacgcgattgacgattcgtcccacgtcggagcctctaccgacgtgggacgaatcgtttgcaaaacaggcgatgaaatatttactcggttaagtattacaatttgtgcaatcgttctcaccatttgtgcatgtcgcgcgcgattttgggcatgttgcgagttaccataatacgtaccggttcgaatacacccataacataccttgatagagaggttgaagatgattgagactgcacaggcattcggcgttgacattggtggctccggcattaaggccgccccggttaacctcgagaagggcgagttcgccgaaccgcgtctgaagatcctcaccccggaggtgtccactccgaaggccgtcggcgaaatcgttcgccagcagctcgagcatttcgaggttccggagtccgctccggtcggcatcgccttcccggctccgattcatgtgggcgagaagcttggctacatggccaacctggaccagtcttgggtcggcgtggacgtcaccgaagtgttctccgaagcttgcggtcgtccggtcaccgtggtgaacgacgctgacgccgccggtcttgccgagcagcagttcggcgccgcgaagggccaggatggcctcgtcatcgccaccacactgggcactggcatcggcaccgcgctgattttcaacggcgagctcattccgaacaccgagctcggccatctggaactgctcaagggcaagggtgacgcggagaagtacgccgcatcctccatccgcgagaagctcgacatgggctacaagaagtgggcgaagcgcctgaccaagtactactccctcatggagttctacttcgacccgcagctgttcgtcgtcggcggtggcgtgtcccgcgtctccgagaagttcctgccgtacatcgacatcaagaccccgatcgtcgcagccaagctgcacaacgaggccggcatcatcggcgccgcatactacgcgagcaccaagcagaagtgatgtgttgaccgattaggttgtcaaaaggccgtccgatgaatcggacggcctttttcgttgttccatgtgccgcagatggaagacggcagtccatggagtagggtggagagcatgcgtttttcctcaagagtcgacatcagtgagctcaatcccatcgccaaggcggaagccaccgccaaaacagccggcagaccgctcggcaagctcaacgactccaatccgacacggcacgcgctggctccggatcttgtgccggacatctactccgccgacccgcgcggccaacgctacgcgcgtgaggcgctggccgcgttccttgacatgcaggaaatcggccattgctcgccggacgacctgtacatcctcagttcaacttccgaagcctactcgtggcttatcaaactgctgtgtgatgccggtgacgccgtgctcgcaccgaaacccggctatccgctcatcgaatcgatcgcacgcctcgaatgcgtcgacatgatcgaataccaacaacgattcgacggctcctggtacatcgacgtggccgaactgaaaaccgcgctggaaggcccggacggcaatcgcatccgcgcgctggtgctcatcaaccccaacaatccgaccggttcgtacgtcaaaccgtcggaacgcgaggcgatcgtccgcctgtgccgggaccacgacgtggccatcatcgccgacgaagtgttctacgattacgatttggaaccattcgaaggcaacgcacgactcgcgggggagcgtggcgcgctcacattcgcgttggacggtttttcgaaaatgctcgccgcaccgcatgccaaagtcggctggatccaggtatcaggtcccgccgaagacgtggcggaagccaagcgtcgtctcgacgtgatcgccgacgactatctgcccatgagcgagatcgtcgcaaaacaaattcccgcactgcttgaagcggcgccatcgcagaccgcgcgcgtgcaggaacgtgtgcgcggcaatctcaaagcactgcatgccatgctcgacgcggatgagcaaggtcttgtcagcgtattgcgtgccgaaggcggatggaacgtactgctgcgcgtgcccagcgtgctcgacgagaacgagctggtgctgcacatgatcgaacgccacggcgtatccggacagcccggctacttcttcgacatgacctccaacggctatctggccatctcactactgcccgaaccggacgatttccggcataacgtgcacgtggtgatcgacaccgtcaacgaactgatcggctgaacggactgccgagtccgaaatctcttctacgccctgtcgcccttcgccgcctcatacttcgaacgaaccaaatccgtgtaaaaatcgaccgcctcacgaggcgcgccgtcgaacaccacacgatggtcgtcgacaacgagcacgcggccgatcgcatattccggacggacgatcagatccgtgtcatgcgtggcgaacaccacctgcttgtcatagctgaacagggccttcgccacgcgcgccgacgccacctcgtccaatcccttggtcggctcgtcggcgacgatcgcagcgggggagaagctcaacgcggccgcgatcgccagcagatgccgcttctcgctatccaaagcggaggccggctcgcgggccacggaagccagatcgaaatgcgcgaacagattgccgatgatcgcctgacgttcgctttccggcaccttgtgcttcttcaacggcaggtcgatcgcctcacgaatcgaagccgccttgtagtaggcgttcggaatctcttcgcgccgcacgcggccgaccagatcctcgacatgcttcagatcgcgtttcacggcggggtcgtatgcggtaccgtccgcttcgatgcgggccgttccggacgtggcggtcaacgctccgtccagcaacttcagcagcgtggtcttgcctgcgccgttcaagccgattatcgccacacgcttgctgtcaggtgtgatatcaagcgtggtggcttccaagccgatattgccgtcctcgtacatgtgggcggcctggtcgagatggaacgtgacggacgaagccggtgtggaatgtttaccggcgaacagcgaatcgaagaaacccataccgccgattgtaacgaaccgcaggcgcaaccgcgcgcaggttcaccggcagttcatccgaatcgtccgtgcccgcatgcgtggcggacgccttgtaatcggcgaacaggctgccgaaatccaacagtcgcgtcacactgctggtttcggcatcgagtttgacgacttggtcctgcacggcgttgtcgtcgcggcccagttcggtggtgagcagcacgatgtcgcctttggcatccgacgtgcggcctgaggatggttgcgtggcggcgaaagcggtttcatggtcggcgacccccggaacataactcaaagcaacaatgatgacaatcactatgattgccgatgaaactcagagcaaaccggaaaaactgctatatgaatcaggaaagaaacctgaatttttactggatgtagcttatgtcggacgtcaacccaacatgaaccaggactgcacgtcgagatagagggcgggattgttgcgcaacatctcatcgtcacgcccgggcaggaacaacgacatcagcgcgacaaccagcgtgaacagcagcagcgcgaggaatccggcacgacatacccaacgcagacgcggcttgccgcaatcaagtacgatcagcaacgaaggcaacgcggccaaggcaaacagccatccgaaatcggcgatgtaccgccatcccaaaccagccatgcgggagtcaatcaccacaagcagcaatcccaatgccaggctggatgtcaacaacagccatgtgttcgtgcgcccggccttgcgcatacgccggtagaggaacgggcaggccagcgcggccaacgtcaacggagctatcgtgaataagccgccaggcattgcctcggtaaatccccaagtgggaagaggcgccggattgacggcgaggaacggaaacgcatccgtgaaccgcaacggcaggaacaggtaatatgcgacggtcagcgcaagattcgacaatggctgccgataactggtcatatccgtgaccgtcatctgatatgaggtgccgaagtcgagcggtgatccgaaccggaccacgttgtacgccagcagaggaacgatcacaatcaacgcgggaagcaatgcggccaacggcgcgcgcatcagacgccagaccgacatatggggaagggaggaatcattggaggcgtgacggaaaatcgactgaatctgcggccagaatattacgaaagccagcaacgccacgagaatgaactgcggacggcaccccagattggccgcaatgcacatcgagcctgcagccagatggggcaacgacaacgactgcgtgccatcaacctcacgaatccgatcgcctgacaccggcacccgcttggcggcgcccaaccacagccacaatcccaacacgctcagaaacagggaggcggcgatcggcaccgaatagaaattcgtccgataccacagatacaaaccattggaagccaacagcatgaacacgcacagcatactgaccgcagccaacggcgcattcggacgaattcgggatatcacacgaatcaccagcagacatccgaataccagaaaaccaagcatcagcagcggcacggccgcaccgcagggcatcatcagcccgccatcgacgaacaacgatgtgaccgcccgatacggcaggaacaacaacaacgcgggaaccacaccgaaatacgaataccagtgctcctgatagaacgcgtaatcccaatacactgggcttacgccatcggcaagcaaccgctgccgggtggccacatcatacggatccgccgcgtcacgcaacgcatccggcacatccaaatccaaccacgcgtgaccatcaagcagcgcccttgccacgtaatcgtactggtcgaaatcatacgtgtacgtgcctttcgtatggaagctcaacggagccgcctccaccagctgccacaccacaacggcacaagtgaccacaacaggcaccgccagcagcgcccccagccacgcacgctgcctcacactcgtcgtatccaacggcatccgccacaaccgcgaaccaggcctccacaccagtaccatcgccaacacggccaccatcacgccgatacgcaacggattcaacgcgaacggtacacgcacattcgcacgcaccgcatcaaacggaatcagcgaacccttcggctcgacaatccgcacgcacaccgaaccacctgcagccgccgcatgcacatacagcgaacgcggcgaagacaccgacaccgaactgaccgtaccggccctgcgattgacatcaggacggacacgaaccgtgcgcaacacctgctccgattgtctggctgccttatccaacgccttcgaagacaccgggtccatacgaacatattccgacgagccatccgcatcgacctgcatatatgcctgcgtcggatcggtgaccttcaacaacccctcgtcagtacgttcgagcccagggcccagcacgttgtacgcggcggcggaatcacccgatgcggtcaaggaacgccaaaacggcatattgcacaacacgcactcgaccgccaccatcaccgcgaaagcgactacaatggctgcgcacatacgacgacgtgcctgaaaacgctgcttcgaaaaagtcacgtcattattctaatagcttcatgtcgcattggattgaaagaatggcacacatgtctcaccgcacaccatcagacccggccagccaaccggaacataaccggaccatgctcgaacgcgtcaggcaaaatgtgcggcgactcgtcaaccaggccacgccgcgccacatccacgccaaccccttcggcaaggcgcttgacaagcccgacgacatcgtcgacgaactgacccgcaacgccatccggcttaatccgctcatcaaacgacacatcatcgacggattcgaaggcgtgcccggaggattccgcctcggatgggcccaactgccgcagacccacggccatgccttctccatcggattgttcaccgacagcgaccacttcgcccaaatcgcgctcgcggacggcaaagcgcgtgtcttcgccggcaccgatccggacatggacacgcaggaactcgaaccgcggttcgtcttcgtcaaagaggaaacccttacgttggcggacggtccaagactcggccatgcggccagccgcaatccgaaaacggtgcgcgccacgcaaggcggcgtcgtgggacgcatgccgggcggtcgcatgatgtggctcgcctcatggctcaaaaccggcagccgttacacgcttgagcaaatgcgcgccaacctgccagcgaatatgcggttcgacctcgaatatcgggacgccatcaccatcgccttcttcgccgcctacatgcttccacagatgaacggcctgctcgtcggcttcggttccggcaacattttccgcaggctcaaccgcgaagcgcccataggcgccatccgacggtccatcagagacaccatgagcgcccggtcgcatggcatgcgcgcctccggcctggaagactacttcgccgatctgatgcgcgaagcccacgcgctcgataccgatcaagggctcgaagctgtgcacggagcggaaccgctgcgcctgtacacatccagctattccggatgctacttcttcgcatgggattcctccctgccgttctcggcagtgctgtgcgccctcaacatcgagggcaacctcaaccgcttcgccgccgtcagctcatggctggaacgtaacgcacgcatcggcgctctccccacggaggacacggtgacgcgtgccgaagccgcgcagatcgacttcgccctgctggagaatccgacgctgatcgcgttgaaaccggacgaccggttcggcgcgatcctcgacccgaaccgggaagacggcatccaggccgccagccgactggcggatatcgcggccgacttccggcgtgaagtcgccgaatcaaccaaggacaacgtgttggaaggcgatttcggcgccgacggaggttccgaatgggtgtaccggcagaccatgtcccgtctgctgcgcagcctgcgtctgccataccgtttcgacgttgacttccggtgcgacctcagcgacggcgaagtcgcaatcggcttcacttctgctggagtgtccatgatgccgttcacccgatacgacgtatcgcgccgcgcgtggatcgacctgaccgacgtcgaacgcacgcgtatgagcgtcgattacaatctgcgcgtcggactcatgatggccgcgctgagcttcggagccgatccgaatgtcaaacgcgtgtcgatgcacatcgattcgattggtctggaagaggccgtagccgaacaggattccgccatcagcgagttgatgagcgaggcgttaagcgccttcgaacgcatccgtaccggagacatgaggccatccggatccaaagccgctccaaaggacggcgactaccatggcgatccggctcggcccgtcactccgagaaccaccgatatctcatccgaatcaatcgattccgacgattcggctggctcggatagcgttggcactggagacgatacggtggacggccagttcgaagacctgatgaaagacatcgacttcgacgaaatggcgttcgcggtaccggacggacgcgccgatgatgacgacgcctccatgcgggacgacgccagcgacaaaacggagtacgacacctacctcgatgatgatgacgacgatccgatggcgcagctgcgcaaaaacccgaccgtacgcaacttggtgaccgtcaccttcacccgcgacgagttcctgaagcggctcgacactgacggattggcccatccaaccgccacataccgcatgttcgacgccgaaatggacgtggacggcaaaggcgcgctcaaacccatcgatgcggccttcgaccttcgtgacagccgattctcaccggcgggaagccaagaagaacccgaactgtccgacattcgttttgatgacggcacggcgcagttgttcggctgtgagaacatgatgggcctgtccatccagcgtgtcgacctgttgcagcgcgccgtgggggagttccatcgtcttgcgcaaagcgacggactcgaatcggtggccaaagccaaacaggccatggacatcatcaattccatatccgatccggaattgaccgaattggcaccgcaggtcaccagcgcgctgatcgacggcgaagacacgcccgacttctcattcgaactggcacaatccctcgatgacgaacgtctgaaggcacgagacatgctgttctccggagacgtcgagcgggccatcgaatccgcccagtccacactcgaacgcatggaccggatcttcgctgaaaatccgggcgtgccgcggtacttcaattcatatgcggaacgcgtcatctacaaccgcatgttcgccaccgaaggcgaaagaacggtgctcattcccgacaacctgttctacatgcatatggagcttgccgacctgctcgcccaagtcaaaggcgtcgatgccgcgctgccgcatctgaacgccatggtgcgttacgcccccgcatacccgctgtcgcacctcaagctcgccgtgcagctggggcgtgccgaggactgggatccggcacgtgcggcatgcctcaacgcgctgaacgtcgcgcttgaccgggaagacgcctcattcgcctactatcgcctcgcctatgcggaatggatgtgcgaccacttcgaccttgccgccgcctcatacatcatgagcgaggagatcgcccccggacgtatcgccatgctcgaaagcgaactgcaggaactgatcggaagagcgctctggaaagggcggagctggcgcacagatagcgtgggcagtgccggaagagcggaatcaaggcctgcgacggaagcgaggagggcactcaggggaggagaaggcatgcggaaagcgggagcactaggcggcgcgaaaccaaacacgcgacactaggcacgggtggtggcgcgggctatgatgcgggattgggtggtgatgagctccggttccaacgtacggctgccgtcgatgcggttgatgatgcggctgaccgcggttggcgcgatccagtcgaggcaggaatccatggtggtcagcggcggctggaaatatgcggcttcctcgttgttgtcgaagccgatcacctgcacccggtcgggcaccgcgatgccgttcgctgccaaagtgaacagtgcgcccaacgcaagctggtcgttgaacgccacgatgccatcgaaggggatgccggagtcgacgatgcgctgcgtcatgcgcgcgcccgagccgatggtccaatcctggccgacgttgggcactagccgtgtgtccaattcgacgccttggtcggcacacgcttcgaatatgcctcgcatgcgcagctgcgcgttgccttccacggcgtcgcgcagctcgaggatatgctccggatcggttcgcgagccgatcaccgcaagattcgtggcaccgtggtcgaacaggtattgcgcggcgagacgcgcctcctggacgtcgtccggggtgacatggtccgccttgccatgcgtggaccgcgcgcccacgcagaccagcggataatccacgtccaggtcctcgggatcgagatcctcgacttcggagatggacaggatcatgccgtccgacaccgtggcattgaagtttcgcaacagcgcgcgggcaccctgcgcggatccttccgcatacgtggtgatgtacacggaatagccgtagatgcgggccgcgtcgatcacccggttggccagttcggccaaatatggcgcggtcaggctcggcaccgcgagcgtgatgaagccggttttgccgcgattgagattgcgggccgacacgttgacgcggtagccgagcctgtcgatgacgtcctgcactttttcgcgtgtggtgtcggccatgcggccggaatggttgatgacgttcgacgcggttttgagggagactccggcctcttgcgccacttcacgcagtgtgacgcgtttcctctcggacttgtccggcttcacttcggccatatctccccctaaccgcatccgtcatcgatattcgacttccgactttaccgccttaccacgagcacgccgttgcggcgcacggtgtacgagccgggcttttcctcccgatccgtctggaacaggatgaccggctcgccttcgatgccttgcaattcgaccgtcttcttgccacggggcaggtagaagtcgaaggtggcgtcggcggaggcgcgcacggtgtgcagcacgtcggcattctcctgcgacgaggccgcgagatatgcgcggaccagcttcgtcagatcggccacatccaggtcgcagccgacgaaatacgcttcgccggagccgtacggattacgggtgaccgcggccgtgccgtcgagctcccattcgtccgcttcctcgccggcgtacgtggcaagcacctgcgcgtgttcgccggtcacgttcacgtcgttctgccacaggcgggtcgtggtgccgtccagcgcggccgaatcgtcggcggacgacagtcggatctcgcccggctcgccttcggcttcggcgccgaggatgttgaattcctcgccgcggacgcccagcatcgagcgcaacaggccatcgcccgcgcccgggtatccgccgagccaagtgtggaaatgctcgtcgatcagtccggtcgcgtagccgaccaccacgcggccgccggcggccgcgaagtcggccaaccgctgcgtgtcggcggtgctcaggatcagcacggtcggcagcacgacggtcttgtacgagctccagtcgtaggcgagcggcacgatgtcggcgcgcgagcccgcgtccaggaacgcgcggtaccagtcacgcacgtcatgccagtggttgagtttcatgctcggcagggtctgggagcgggtggcccattccgattcggcgctgaagaggatcgccgtgtcggagtgcgccaattcggtgccctgcacgccggcgtcggcgagcgtgtgcaacgacgcgcccagctcgcacacctggcggaacagcttcgtgtcctcgccggcgtgcggaaccatggccgaatggaacgcttcggcaccgaacgcggacgcgcgccactggaagaagttgatggcgtcggcgcccatggccacatgggccagggagtcacgcacggtctcgcccttgcgcttgcgggtgttaagcggcttccactgcaccgccgaggtggagtgttccatgacgtaccacggcttgccgagcgcgagcgaatccatgagagcgtcggagcaggccagctcgtcgaggtgggattcgccctcgtggaagtagtggtcgttggatacgaagttcacttccttggcccaggcggcgtagtccatgcagcactggtcggtggagaccatgaagttcgtggtgaacggcttgtcggggcagatttcggcgatcgcgtcgcgttcggctttgtagaagtcgaggagcatgtcgttgccgaaccgttcgaagtcgagcttctggccggggttgaccatcgagtcggcgcccatgaaccgtgggatgagcacttcgtcgaagccgttcatctcctggccccagaaggtggtgccccacgcctgattgagcgcgtcgatggtgccgtacttgcggcggcaccatgcgcggaaggcctcgagcgcgttgtcggagtagtcctcgcggttgttccacccgtattcgttgcccatgtgccatgcggtcacatacgggttggtgccgtaccgttcggcgagcttgcggcacagggtcagcgcgtattccttgaacaccgggctggtcgggctccaggattggcgcgagccggcgttgaccggatggccgtacttgtcacgcggaaggacctccgggtggctttcgtacagccacagcggcgcggtcgccgtcgcggaggccaagtcgaccacgatgccggcattgccgagtttgtcgatgatgcggtcgagccagccgaaatcccaacgatcctcggtgggttggatgcgatcccagctgaagatggcgagggccacggtgttgacgccggcctgcttcatcaggcggatgtcgtcgtcccagatgtcctcggaccattggtcgggattgtagtcgccaccgaaggcgatgccgcggccatccgcggtcagcagttccggccattcgaagttgcgtcgcgcactcacgattatctcctttggtaattggcataaagccatggttttttgtatattacattcgttatttgcccaccggcatgtggtacaccggtgtagcatacacgtcggtgacgtcagcgacgcacgcatcggactgctccaggcgggccgccatcgacgatgttaccttcacgcggaccccgcgcctcagcggcgtgacgaccagcgtcagctttccaccagcggcatcgatggcatccgcgtaatcgcgcaatccgacctgccatgtctcgccgttgcagaaattatcggcgatcagcacatcgccgcagaacagccagccgatatcgccctggtatgcgatgttcagcatgacatcggcgacctgccgttgatcgcggaaaagccgtcccatgccagccggcaaagcgatttcgtaccgatcggcgtgcagtcttctcagacgcgcatacaccgatacgggctccaccggccgcggagagccgagcaagccttccggatatgcggcgatcccgttttcggcgcggggcgattccagcgtccacccatcgccgtcctcgtacagcaacgcgttgtcgtcgtcgacgaaggcgaggcctccgtccaacaccgtcatccgcccggcgagcgctcgtgtgacgcatacgatctccgccgcgtcccggaccatgaagcgttcgaaatccgccttgccgacggtgacgtcctggatgtcgccttcgaaatggaacgtcagctcatccatgccatcgggcttgaggaacacgaacgtgcggaacggtcggcccggcacccgcagcacggtgaccggctgcaggttggcgcggacgagccgcacgccgtccagatccatgttgaacggcaatatgcagttctccccctcggcgaggccgatgccggtgaaccgtatgcgctcaccggtacccgtcgtcacgtcgatttgctcaccgtgacggctcggcacgcgcgcatggtcctggaagttgtcgatggacacgaaaccccgttcgccatcgctgcgcacggcataccggagggtctcggagtcggacggatcgatgcggtcctgcccgtcctgcaacgagaccggcattccggcgagttccggcccgaaggctttgacgaactcgtgcagggtgcgcagccgccggtaggattcccgcacctgtccgaattcgccaaggggcgcttggaaatcataggagcgtttcggggtctgcccctcattgaggaatccggccgcgcccttcgggttggttccgccatggaacatgtagtagccgaggaaatcgcaccccgagccgagcttgatgttggccatcgcgtcgacggagcgcttcggcagcacgaaacggtaatcgtacgaattgaacatcccgccgcccatctcgcagcaggcgtacgggcggctgtccggatcgtacgggggatcgaagccgtcgcttgtgctggagccatgcagcctccggtatcggtactcgtcggtggcgggatgctccgtcatcccctcggcaccgacgccgtcgtagaacagccacggccggtacgcgtatccaccccacagcggcagcatgtcgtccggaaccggtgactgccagccggtgcaggtgaacatcggcgggtcgatgccttcctcgatcgcgatgtcgcgcagccgttccaggtagccggccccatcgtggccggacggcacccattcacggctgatgccggtggtcatctcccaaggagccgacgacgccatgtactcgttgtcgacctgggccgcgatgatcggcccgccatccttgaaatacaggccgcgcagctgctgcgcgatatgcgcgtagagaccgcgcaccgcatcgaggaagccggcgtcgagggaacggacctcatacgacttgccgtacagccagtcgggaagtccgccgttgcgcacctcgccatggcagaacggtcccagccgcacgatgacgtgcagtccgtgccgggcgcacaattccacgaatcggcgcacgttcctgttgccggagaaatcccactccccctcgcgctcctcatggtggttccagaacacgtaggtggatacgacgtcgatgcccgccgcggccatcttcgcgagttccgtgtcccaccgttcggcggcgatccgcgaatagtgcatctcgccggcgatggggatccatggcgatccgtcacgggtcaggaagcggttcgtggcgcccagggtcccgccatccggcccgcatgcggctgcggcgcggatgacggggatcccgtatgcgggcgtccgcgcgaacttgctggcttccgaaagatcaacctcatagcgcataacgctgctccttgtcgaattcccgcaagcaggaggaccggtcagcccttgaccgaaccggcgaccaggccggccacgatccaacgctggcagaagatgaagaacacgaacaccgggatgagcgcgatggtggtgaccgtcatgaacaacggccagttcgtcgtgaaggtgctgatcgcgttgaacacctgcagcacgatggtctgtttgttggtcgacgagatgtacacgctcggcgtcatgaagtcgttccacgtgcccatggtctggaacacgatgacggtggtcaggatcgggcggatcagcggcagcacgatcgtccagaagatgcggaacggaccggcgccgtcgatacgggcggcctcgatgatctcatacggcaggccgcgcatgtactgcacgatcaagaagtagcagaaggtcgcgccgcccgtgtaaagcacgatcaggccgagcagcgaatcgacgagacccacctgtgcctccatgcggtactgcggaatcagcagcgtctggccggggatgatgaaggacagcatgagcagcacgccgatcacggcggtgaacttgctcttcttcaggatcatgccgtatgcggcgagcgcgccgaacagcacctgcaggccgacgccgaccaccgtcacgatgatggtgttcttgaaggcgttgacaatgggcagatgcccgaatgcatacgtgtagttctcgaaattccatgtctttggtaacccaatcgggtccatggacatctcggcgctgcttttgaacgtgttgatgacgatgacgtacagcggcaccgcgcagatcagcgcgatagcgatgacgacgacggaacggatgatcgagccgatacgctcgcgttgctgcagagtcatgacagcctcttttctaccagattggtgattacctgctgcagggcgaccaacagcgcgcagcagatgaagaagatgacgcccagtgcggagcccagtccgtaccggctcgaaccgatgcccgtgaggatgatggactgggtcacggtgtaggtggagtagcccggaccgccgctggtgaggccatacggcagatcatagaccttcaaaccaccggtaagcagcatgaagatgctcacacccatggccggaaccatctggggcagtgtgatgttgaagaactgctggcgacggtttgcgccatcgacggcggcctgttcgtagatatcggcggggatagcctgcagatacgccagatacagcgtggcgtgccagccgatctgagcccataccgctacgaaaatcacacagaatttggcaagttcggaattcgacaaccacggaatcgcatcgatgccgatcttggcgagcagcgtgttgacgacgccggacttcagcggggagaagatgtactgccagaccaagccgagcacggccatggacggcaccgagaagaagaagaacagggaacgggcgaagttacggccgaagaacttgcggttgagcaccacagccagcggcagggcgatcacggtgatgagcacggtggtggccaccgtgtacagcagcgtgaagccgaggcccgcgagcagcgtcggatccttgaagcactgcacgtagttcgcgaaccccacgaacttcgcgtccgcgaaattgtaaccggagtaatcggtgaagctgaacaccaggctttgcaggaatgggatgaggatcaccacgatgaacaccaccatgatcggcagcaggaagcgtgccgaggcgaagttctccatgaagttgcggtgacgacgctgcttgagatgcaacgcctctacctgatcagcggaatgtggacgcgccgctgacgctgttgatactgacatgttggttgctttctacaaaacgtgagattggcaggtccaggcgtggcgcggacggaagggtccgcgccagcctgccgcgatggatgtctgttcgcgatggatcaggagagggtcttgagcttggaatcgaggttctccgcggcctgcgtagggctgatggagccgagggctacctgctgcagctgggtgaaggtctcggcgcgcagcgcggtggtgcccttgctccagtgggcggaattcaggtacacgttgccggtcttgatgtacaggtcgtaggcgtccttgaagtggtcgtccaccgtggcgttgaagcccttgacggacgggatcaggcccagctgcttctggtacagcttgaggccctcgtcggaggtcaggaaggtgaagaacttctccgcggccttgagcttgtctccggagatcttgttgttgatgccgaaggccggatcgatggagcccggcgcgtacggggtgtcacccttcttcagcatagggatctggccgaaaccgtagttgaggccggtctcattgaagctgtcgatgtcccacgagccggaaggatagaccgcaagacgtccggcggtgaattccgacttgacctggtcgccgctcaggccggacacgtcggagctcatcaggttctgcttgatcagcttgtcccattcgccgtagtacttgccatacacgttcttgaacgtgtccttaccggcgtcgatcttggcgtcgagcgcctcgccctgcttggcggattcagcgccgatccagccctcgacggcgttgcccagtccatccttcggctcaaggtatggggtgattcccgcggctttgagtttgccgcacatggtcaggaattcatcccacgtcgccgggatggagtcgtaaccgaccttcttcagcagatccttgttgtacacccaggcattggtccaggtgctcacgcccatggcgtatactttgccatccacgctataggccttttttgcggcatcgccgattttatccatgaagctttcattgctcaggtccttggcgtagttgcctttgaccagatcgctcaacgcctccggaggaacgatgtagacgtcggccaggtttccgccggagattcgagtctgcagcgtctgctggtagccactctgggaaccggtggtggtgctgtagtcgatcttgatgtccggattggccttttcgaacgcgtcgatgatcggctggtacttgtcctgcgaattgttcgagaagaacgacagcgtggtcttgccgtcggcggcgtttcctccaccgcacgcggccagcggaacaagcatcgccgcagcggccaccgccgcaatcatcctgatggatttcttctccatgatgtactcctccttgtgttccatcgttggcacccgctttacgtgcgttcattcgtcgaacccactccagctgcggtagatacacgtcaatatgtcttcaactgaccattcagttgattcgggatatttccttccctttttggtataactgtgtacctgttgaaacagtataggttttccggtgtaccatgtcaattcaaacaaggaaatttgcatcccatcgaccgctaccccctacaaaacatcggcgtgtcgtataccggcagcaccgtcgacagcggacgacgacccgcccgcaccatccggaggcgcgcagcccgaaagcgtattgcgggtgggcaggacgcatgtggacaagtcggtgtattacgggggattatttttccgatgaattccccagtattggttgggattgaaaagatgctgaaagtccacagataaaaaatcggcggccccaaggaaatatccttggaagccgccgatatgcttgcgtgcgtcgcgctacgggctcaagcgagtacacagcgtgctacgcagaccgtgagcaacgcagaccgcgcgctacacagaatcgcaagctacaaactcaggaacagctcgtggatgcgggtgtcgtcggtgagctcgggatggaacgccgtggcgaggatcttgccttggcgcaggccgaccacattgctatccaccgatgtttcgacggtggcggccggtccgacttcggccacgaacggcccgcggatgaacaccagcgggaaatccttgagcacgatgtcggccagggcgtcttgcggaacatgctcgcccggtgcgaccacgacggtggaatcgccggaagaggagccgaaatcggcggtggcggcgaacgagccaagctggcggccgtatgcgttgcgccgcacgacggcgtcaagcgcgccgaagtagacgttgtcgtcgttatcgagcttgcgggccagcagaatcatgccggcgcaggtaccgaacaccggtttgccggcggcgatatgctctgcaatcggctcgaacaggccggtggagcgcagcagcttgccctgcgtggtgctctcgccgccgggcagaatcacccggtcgatcgaatcgtcgaaatcctcggccgcgcgcagcagcttccacggcgcgccgaggcgatccagcatggcggcgtgctcggcgaacgcgccctgcacggcgaggatgccggtcacgccatgtttcacggcttcgacgccggccgattcttccttcgaaatgtattcaactgctacaaccattaccgttcctgtgctttcggatgtgccggctccgcggtgcttctcgctgcccgcggagccggcgtcacgcatgcgccgtgcgggccgtcattcgccgcgggcggccatgatggtctggatctcgtcctcgttgatgccgaccatggcctcgccgaggttctcggacaggcgcgcgagcagatcggcgtcctgccagttggcggtggcctgcacgatggcggctgcgcgcttggccgggtcgcccgacttgaagatgccggagccgacgaacacgccttccgcaccaagctccatcatcagggccgcgtcggccggggtggccacaccgccggcggcgaagttgacgaccggcaaacggccgttgtcgtgcacatacttggcgaggtcgtacggcacggccagctgcttggcagcctcgtacacctcatcgtcgcgcagggagacaagttcgcgaatctgcttgttcatggtgcgcatgtgacgcacggcctggatgacatcgccagtgcccggctcgcccttggtacgaatcatggacgcgccctccgcaatgcggcgcagcgcttcgccgaggttcttcgcaccgcacacgaacggcacgtcgaactggttcttgtcgatgtggtacacgtcgtcggcggggctgagcacttcggattcatcgatgtaatcgatttcaatggcctgcagaatgcgggcttcggcaacatggccgatacgcaccttcgccatgaccgggatggacacggcttcctgaatgcccttgatcatggccggatcgctcatgcgggaaacgccgccagcagcacgaatatcagccggaatgcgttcgagcgccatcaccgcgcatgcgcccgcgtcctgtgcgatcttcgcctgctccggggtggtgacgtccatgattacgccacccttgagcatctgtgccagattcttgttcagttcgttcctgttgttggccatcgccagcctttcgtcgaaaataatcgtttgctatcgatactaacgatttcccatttcgatttcacgcgaactgaatcttataacctaccaaaaagtcggttttgctaaatttgcaaccttattttcatgattgtttcattggcttatgatttcgattccgtcgacatttcgtcggtttcgtccgtttttcttgctttacctgcgaccatggctttcgattcgtccgcttccgtacgccgtcgcgcgcgctataggaaacacgaatgacatgcgattttcatacgaccacattgcggacgtgcgacgcgtccgtatgcggccgcatgggcatgggcacctcaccaggccccgcattacgccgattcacacactagttcgcacgcatcggctcgccgcatcagttcgcaatccgcacgcgccagctcacatgcgcacgatgcggtccgcgatgcgcatggtggaatcgcggtgcgagacgagcagcaccgcgctcccctgctgcgccaacgcgtcaatcgattgcagaatcacggattcgttgtaggcgtcgaggcgactcgtcggctcgtcgaacaacaccagcgacgcgttgcgcaggaagacgcgagccaggccgatgcgttgccgttcaccctctgaaagccgcccgcccaactcgccgacgggggtatcaaggccctgcgggagcgagtcgaccagttcaagcgcggaagccttggcgagcgcggcgcgcagcacgtcatcaccgacagaaggggtcgaccgggtggaaagcacggaatcagcggcattccacgaaacgggaggagcgggcggggtaaggagcgctctgccggaagtcgcggaatcgtccggatcgccagcattaccagccctatccgcatcgcccctgtcgcaggccatgagcaggttttcacggatagtgccgtcgaacaggtaggtttcctgccccatcatcgtttgcacgcgacggcgatgatgcgcgtcaatctgcggcagcggcacctcggacagtgcgaccaagccggattgcgggtcccagtaacgcataagcagtttcagcagcgtcgatttgccgcggccggacgggccttggacgccgaggatgccgtgttgcggaacgtcgagcgagacgtggttgaggattggctcggcggacgactcgggggcatccgcatcgcttccggaagttggaacctcgcccgaattgccgtagccgaacgtgacgtcgtgcatggacatgccatggtagcgcggcaggaaatcgccccgctcctccactgcgggggtttcgtccatcagcgcgaacaggcggcgggcggcggcaaacgtttgcgtgagattggccggcagcgcgctcaacgcgagcgtcggaccgaacgagctggccagcagcacgaaagcggcggtcaggcgggcggcgggcgcggaaaggacggtctggatggtcgcagcggcggtggaagcggcggaagcgatgggcatcgtcgtaccggacgtgaccatcgccagcaatgccgcgatggcagtgaacagtacgaccagcaccgcgccgaagcctgcgaaatcgccattcttggcactcagccgggcgcggcggctccagagcgagcgcgtgcgtgacgcgatgccggcaagccgcgcatggccttggccgaatcggatgatttcgtcgagaccgcgcatatcgtcgagcatttcgtcatcaagttgggcggattcgcggcgaatatccccaccgagaccgcctaccgccgtggcgaagagtttcggcagcacgatgccgacggtcaggtgcgcgatgaccagcgtgacagcgatcgcagggctcaacgtaagcaatgcgaccgtgtaaagcacggtggtcgcgatggcgatgacaaccggcgaaatggtgtgcgcaaagaagatttccagcagttcgacgtcggtggtgaccagcgcgatcaggtcgcctttgcctttgccggacagtttggcgggcgcgaggcgacgcagcgcggcaaacgttttcgaccggaacagcgcgagcaggcggaaagcgacattgtggttcatgtattgctcggcgtagcgcatgccgccgcggatcagtgcacagataatcatggctgcgattgccgcaggaaggctgagattccagacttttgcgccagctgcggcaaacagcgcggcgacgccgaaaaccggcaggaacgtggcggcgaggtggccgaggatgccgcacgcgcaggcgatggccatgggtttgcgcagtgggccgacttcgcgcagcaagcgggcgatgacctgggttgttggcatatccgatttggcgccactggcgttcgattcggcggaaccagacatccgagacacggcaaacgcaccagacgcatgagtcatacgcgatacgcgcggcgcgacgcgaccagacaatcccacccgttccacgctttcctgcgcccggaacagcttggcatacgtgccgtccgcggccatgagatcgccatgcgcgccctgctcgacgacgacacccccatcaaacactacgacatggtccgcgtcggccgcgttcgccatgcggtgcgtgaccatcagcacggttgcgccggcgtcggcgagcgcgcgaatcgtttgcaaaatcaacgtttcgctgtccgcgtcgacgctgctggtcgcctcgtcgaaaatatagacggccgacctgcgcaacagtacacgggcgatcgcaatgcgctgtttctgcccgccggacagattcgcgccgtcctgcgtgatcggcatatcgagtcctcgcgattgcgcgcgcacgaaatcgtcgatatgcgcggcttccagcgtctgccacagctcgttgtcggtggcgtcggcgcgggccatgagcaggttgtcgcgcagggtgccggcgaacaggtggctgtgcgcggagacgatggagatttcgcgggtgagcgatgctgcggtgaggtcgcggatttggtgcgatttcagggtttcactgtcatccggcgccgcactgcttaacatagcgcccagcacttcgtcccgcattccggatggcatttcggacagcagcacatcgccttcatatccgacaagcgtgccggcaagcagctggacggctgtggatttcccggaaccggatggcccgacgatcgcagtgacttcgccgggcagcgcacggagggccacgttgcgcaaggcgtagcgcgtttcgcgcgcgtcacccgcgccgccgccctcatcaacgctgtccgcatccgcgttccgcatatcggaatgcgatgtggacgatatacgacggggactcgcaacaccggcacccgcagacccggcagcgtcaggccccgcaccagcagtacccccagcatccacatccgcgtccgcataccggtacgaaacaccacgaaactccacgccgacaccacgcccggaagccccgaattccggcagttccttgctgccatgctccggttcgggcgcgtcgagcagcgcgaaaatacgtttcgtggacgtcatgccgttcatcgcaacgtggaaatacgagccgagctgtcgcagcggaatgaagaaatcggcggctagcagaatcgtcagcaataccgcggcgatcggcgtcaaaccaagcggcagcacgccggacagcgcgaaaacgccagacggcgagagcgagccggatacaaatcgccatatcgcaacgccgatgccggcggccgcgccaccgtacgccacggcatccatcgccgtgagcgaacgcagttggatctgcagcacgttcatggtcatcacgcggaactgttcggccttctcgtccatgactcgtgcggcgcgctcgtccgcgtcgaaggttttcagcgtctcaagtccctgcagattgtcgaggaacgcggcgcccatatccgtgtatttgccccagtatttcttgaatacgcgggcagcacgcatcgccaccatgccgacgatgagcacgatgagcggcgcgcaggcgagcagcgtcgcggcggtgggcaggtcgatcggcgcaagcacggcgaacagcgtgatgggggcgagcacggcgtagcacagttgcggcaggaacagttcgaagaagctttggatttgttcgatgccttcgcccgcggactgcaccacgccggcggtgcgcacgcgctgcgcgtaggacgggccgagcgcgagcatcttattgaacagtttctcacgcagcgcgagtttgacgcgttcggcggcctcgctaccgaaacgtgcggcggcgcgaatggtgacgaatcgcacgaccgcggcaataagaataatggcgatgcagggcgcggtggcggacggtacgggcgcgaacagcggttgcagcatacgcaccacagccacgacgaaggcgatgttggccacgaggcccagccattggcaggcgactttcgccgcgatcaatcgaccgacgccgtcagccaaggaaaacagccgcttgtcgaacatcatgccccttttccaatcgtttgcaatcccgccatccgctccaagcgtatcgggcataccgacgaaaggcaatgacggaacggcaatcgcagaaaatcgtcggaaaaatctagaaaaccatcagaactcgcaagcaaatgcacaacagcaaaaccacagaaaaccaagggaacggcgaaaagtgaggcggctgaatgttcgccgttgagcaaacagcctaggcgcaaggggtagttgcgccaaacttgagtgtacacggaacatgttgtggttcgcaacgtcactccgcccagttttgccgcattttccaccgttttcgcccgtaagggccacccctctcgaacccgtcgcgcaacccgttggataccctgcgatcgaacgcgtcaaaccttttttcgagatgacgcatccgtgtaccaatcccccgttccgttgacgtttcgtgccactttgtcagttcaaacaaacccgtcgccatatttcttgttgtttcttacaatgcggacttacgtcaccgtaacttacgatatgcgaggcgcgacaccggacgcgaaaagcacgtcaccgatcaccgcaatcgcagcgatcgcatatatcgcaaaacccacgaaaaccgcggaaacgcaagaaaagagaacacttcatgctcaccgagtacacgaccccgggcgcatccgtcgaagtacgcgacgacgaatccatctactccctgcttaccgaacgcatcaagcgcaccggcgaagacaccgtgatcgcggaacgcaaaaccgctccgggccagtggaccaaggtgacgaccggcgaattccacaagaacgtactctccgcggccaaaggcctgatcgcgttcggcatcggcaagggggatgccgtcaccctcttctccaccacccgttacgagtggggcgtgcttgatttcgcactggccgcaatcggcgcggtcaatgtgccgatctatgacaccgattccgcggcgcaggccgaacgcattctcaacgattccaacgtgaagctcgccatcgccgacgatcgcgaacgcttcgaccgtcttgattccgtgattggccgctgcccgtctctgaagcatattctgatgctcgacgccaatgccatgggcgcgctggagggattgggcgtcaccgtgtccgacgaagagctggacgagcgtatcacgtcggtgcgtgccgacgatctggccaccatcgtgtacacgtccggttccacgggggcaccgaagggtgccgagctgtcgcatcgcaatttcgtgtcgatcacgcgtgccggcagccttgcgctgcacgagatgattcttgaagaccatccgcgtctgctgctgttcctgccgctcgcccactgcttcgcgcgcttcatccagtacgcgtcgatcgcttccgataacggcgtggtcggctatctgccggacaccaagacgctgctgccggatgtgcgttcgttcgagccgacgtacctgctgggcgtgccgcgcgtgttcgagaaggtgtacaacgcggcttcccgcaaggccggcatgggttggaagggccgcctgttcctcaaggccgccgaatccgcgcgcgactggtcgcgcatgcagcaggctggcgagaaaccgaccatgaagcagaccgccgaacacctgtcgtatgaggcgtccgtataccacaccgtgcgtggcgcgttgggcccgcgtatccgttatgtggcgtgcggtggcgctccgctggacgtgtcgctggcgcatttcttcaatggcatcggcctgccgatgatccagggctacggtatgacggaaaccgcagcgccgtttgccgcgacccgcgtcacggacaatgcgatcggtaccgtcggccagcctgcgccgggatcgtccgtgcgtatttccgacgatggcgagctgcaggtcaagggaccgaacgtgttcatgggttaccacaatctgccggagaaaacggccgaggtgttcaccgaggacggttggctgcgcaccggcgatcttgcgtcgatcgacgatgagggtcgtattacgattacgggccgcaagaaggacatcatcatcaccgccggcggcaagaacgtgtcgccgattccgatggagcaggagattgcgaagtgtccgattgtggagcatgccgtggtggtgggcgataatcgtccgttcatcggcgcgctggtcacgctcgatccggaaggattggcggcctggctgccgtccgtgggcctgtccgcggatacgccgcttgaccgcgtggcggctaccgccgccgttcatgacgagattcagaagtatgtggacaaggcgaacgcgacggtttcgcgcgccgaatccgtgcgtaagttcgtggtgctggatgcgcagttcacgcaggagaacaagtgcctgacgccgtcgctgaaggtggtgcgtccggcagtgaaccgcgtgttcgccgacgtgatcgaccagcagctgtacgccggcaagcgctgagccgcacataggtaaacaaaaacagcacggcggggaacgctgcgtacaaaagtacgtcaacttccccgccgtgctgttttttaagcgcaccccgtatcgctgagataacgcgtgcggtaacagtgcggcaggaaacgccggcgtacgaaggtacgtcaagtttcctgccgtgctgttaacgctccgttatttcagtgacggttgttgaggcggtggtacatttcgctcagctccagctccttctcgaactggcgggcgttggtgttctcgtcgatgacggcgagttcgacgccggcgatgcgggcgaagtcctcccaagcctcacggccaacggacgtggtcatgcaggtgtggtgggagccaccggcggtgatccagcactgcacggcggtcttcaggtccggcttcggcttccacacggcgcgggcgcacggcaggttcttcagggagccctgcggttcgacgatggtgacctcgtccatgagcaggcggaagcgttcgcgctcgtcggccatggagaccacgacggcgtcggccggcttgccggagaacaccagacggaccgggtcggacttgccgccgatgcccagcgggtagatggccagcttcggcttttcgatagtgccgatggacggggagacttccagcatgtgggagcccatgtcgaactcgttgcccggcacgaagttgtaggagtagtcctccatcagggaggcgccaccctcaaggccgtagcccatcacggcgccgatgcgcaccagcacggaggtcttccaatcgccttcggcggagaagccccagccgtactcggacgggaagcgctgcgggccgacgcccggcagctgcggcagggtgccgaggtcttcgaagttgtcgacgccggcggtgcaaccgttctcacgcatcatgttgaccatggcggcctcttccttggctgcgatgaacagctcatcgtagcgggaatcaagcagctcgggggccacgtcgtacttggccttgtagtcttcgatgaggtccttgacctggctgtccttgaccttctcgtaggcggcgacgaggtcgttgacggcccaggtgttgatggaggcgccgaacacgcgctcggcttcggtcttgtcgccttcggtgacggccacgttgcgcatgttgtcgccccaacgcatgaccttcatgttctgggaggcatcccagccggcgcaggcgcgggcccaggtgccgaccttctcggcgacttccggatcggtgtagtggccgacgacgatcttgcgcggaatgcccagacgggagacgatgtagccgaactcacggtcgccgtgtgcggcctggttcaggttcatgaagtccatgtcgatggtctcccacggaatctccttgtggtgctgggtggccagctgcagcagcggcttagtgagcacttcgaggccgcggatccacatcttggccggggagaaggtgtggcaccaggtgatcacgccgatgacgttcgggttggcggaggcttcggtcatgaaggccttgacgccgtcggaggacttcagggtaggcttgagcacgatcttggccgggatcttgccggtcgcgttgaggaagtcgaccatctcgccggtctgctgggccacctggcgcagcgcctcctcgccgtagaggtcctgcgatccgacgccgaaccagatttccttgccttcaaatgggttttccattgccatgttggattattccttacttcgttgttgggtttgtcgtttcggtttccgctacgtcagtgctggccgtagacgttggtgtagcggtcgttaaggctatcgatgtcttcctgggagatcgggatgatgtctccgagctgcttggcggcccacatggtgtgcgccacctcttcggtcatggcggcggccttgacggcggcttccgcgtccttgccgatggtgaacggaccatggttctgcatgagcacggccggggacttcggatacttcttcagggtttcgaccacgccttcgccgatggcttcggagccgatgaggcggaacggtccgaccggcaccgggccaccgaactcgtcgcccatcatggtcaggccgcacgggatgttctggccggtggccgcccatgcggtggcgtaggtggagtgggtgtgcaccacgccgtacacgtcgggcatgtggcggtagatgtacgcgtgggacgcggtgtcggagctcggcgcttcggcgccgtcgaccacgttgccgtcgaggtcgcacacgaccatcgagcttggggtgaggtactcgtagcgcagtccggacggcttgatgaccatcaggtcggcggtgtgcaggcgctgcgagacgttgcctgcggtccacaccaccagattccacttgatgagctgctcgtgcagggtggcgaccacttcgcgcacctgcttgacttcagctcgtacttccgggccgtaatcagccaacgttgccatattgtgttcctttcgtcaggcttgctgttgttgcgatggacggttatttggtttccagcgggatgctttcgatggcggcatgttcgatcggcagccccttgcggaagcggtcgaagaaggcttcgaagccggccacgtcgttggcgtccggcgcttccgtggtggaggccgcgtcggcgaagacgcgggcgtcgaggtagtcggcgagcggctggtcggcgtgccacagatagtcggcgagcacggccataccccacgctccgccttcggcggcggtggccatgaccttgatcggggtgtcgaatgcggcggcgaggatcttctgcgcgaccttcggcgtggtgaagatgccaccgtggccgacgagcgagtcgacggcgacgccttcgtccttggtcatcacatccatgccgattttgaccggcgagaaggcgctgaacagctgggttctcatgaagttgccgaggctcatgcgcgcctccgggctgcgggcgaacagcggtcggccttccggcaggccagccaggaattcgccggagcggaacggatagttgagcagaccaccgcagtcggcgtcgacatcgtccgcgatcgcggcgcggaacagcgtgccgtacagcgtgccggcatcgaccggctggccgatcgcggcggcgaactgtccgaacaggccgacccaggcgttgagatcggaagtgaagttgttggcgtggctcatgccggccaggtcgccggctggggtggtgacgaggtcgacttccggatgcaggcgcgccagcttgtgctcaagcacgaccatggcgaagatcgaagtgccggcggagacgttgccggtgcgcacgcgcacggagttggtggcgaccatgccggtgcccgcgtcgccttccggcggggcgaggacgacgcccggctgaagggtgccggtcgggtcgagcagtttggcgccttcggcggtgagcgtgccggccggagtgcccgccacgagcggacggggcagcaggttctcaagcttccacggctgcgcggcgacttcctcgatcgcgtcgaatcgcttgatgaactcggtttcgtaggtatgggtggccgggtcaatggggaacatgccggaggcgtcgcccacgccgagcaccttctcgccggtgagcttccagtgcacgtagccggcgagtgtggtgatgtagtccaccttggagacgtgctcctcgtggttgagcaccgcctggtagaggtgtgccacggaccagcgttccggaatgttgtactggaacagctcggaaagcttctcgtgggcttcgtgggtgttggtgttctgccaggtgcggaacggcacgagcagttcgccggacttgtcgaaggcgaggtagccgtgcatcatggcggagaagccgatgtgccccacgtgggtcagccgttcgccataggcggtttcgacgtcgccggccatccgggcgtatgcggtctgcaaacccttccagatttcctcctgggtgtagctccacagcccgtcctcgagatggctggcccactcatagtcgcccgccgcgatggtgtggtaggcgtcatcgatgagcaccgccttgatgcgggtggagccgaactcgatgcccaggctcgtcttgcctgcgcggatcttctcggcggtcactgcgacctgctcttgcgtcatagttcacgaactccttgcgtccgagcgcctcgcaaccactctgtcaactgaatgttagcgctcactgttaacgctcactattgtaggcacaaacccgtgacgcaccaaatccgacgtgtcatcggagcaatgaatatataaacaaatcgagaagaagcagcgccttagcgacggcggacaggacccagggagctgcggttgaccatctgcgccgacaccagtccgacaccatgctgcgatgatccgaaggagttctcctcccccgcgcccagcaagtacagcgtctcacgcatggcggcgacacccagctgctcgaagccgggacggaccgtggtcagcggcgggaacatattgtccatggcaggcatgtcgtcgaaacccaccaggctcacatcctgcggaacgcgcacgccatgctcatgcagcgcgcgggccacacccacggcctggctgtcgttggcgcagaccatgcatgtcggcagattgccgccggtgcggccgatgttgtcgaggatgtggttcatcttgccgtacgcttcggaggattcccaggtctcgcactgcaccgtcacggaattgaccgcattggccgcgcatagcttgttccatgccagcaggcgcgtcgccgcgtcgcgccactccttgggaccggcgaaatacagcaccgaacggtgcccgtattccacgacgagatgcatcacgtcggccatcgcggaccattggtccatgccgacgacggatacgcggcggcggtcggcggacttcatcagccgcaggccgtcctgcacgccgatgccaccgtgcgtggatgtgacgatcacacgaggctgcgcgatccgcgtccggcatgccgcggagaacatgacatcggtgggcgtgaggaagatgaacgcatcgacgttcatctcgtcgaaggtgcggcacaggtcgtcgaattcctcctgcgagcacagcgcctcatgcaccatgctcaccgtcacgaacaggccatgctggcgggccatcgtctcaatcgcggaaatcgtggagatcgggccatagaaatgctggccgccggcgatcaggccgatggtgcgggaccggtgcgaggcgagcgcgcgggcggagttgctgggacggtatccgagctggtcgatggccctctgcaccttctcacgggtggcgtcggaaacgtccggcgaatggttgatgacgcgcgagaccgtctggtggctcacaccagccagcttcgccacttcgaacatcgaaggacgcctattgcccgcattgcgtttgtctgccatgccccatcgcctttcgcacacaactgttggtacgttcgcctattgtacacgcaacttcagttagcgctaacagccgtcatgttccaaggatgcggcacactgcgcgcaggctaccgcacggccgccaaagcacgcagacgtgccgcgaagttaggccaatcggtgcgcatggcagtcaacagcttgcggttgggcacgtcatcgatcggcacccattcgatctccatgctttcgtcgtcgttggccttggggtcgacgcggtgccccggcctttcgaaggcgaacaccgtggtgtacgaccatgggccgtggtcctcacagtacgagccgaccacgtcgatgtcctccggcgtgatgttggcttcctcgtacgattcgcgcagtgcgccctcgatcgggctttcgccatcggcggtggcgccgccgggaatgccccacgtgccgccttccgcgctccataccgcgcggtgctgcatgacgatgtgcgtcacctcaccggtcgtctcgctgcggcgggccaagagcacgccggacgcgccgttcgtaccccaatgcttgcggccgcaggcgcagtcgacccagccgtctcccggctggtgcacgttctccttgggcggcagcggcttcgcggcacccgttttcgcatcatattcggcgtccggcgcgaggtcggagcgcgtgacgttccacagatcggtccattcgacgcccaattgcgccgccagacggcgcgccaacggcaggctcaggccgatgatgccgtgcggatcgccttcgatcgagtcgatgaacgcgccgccgaaaccttccaaagtgaacgatccggccacttccagcggctcgccggtggcgatgtagcgttcgatatccaggtcggaatattcgcagaagtgcagggtcgctttgctggcgccgcgcaccatgcggcccgacgcgaagtcgatgaggcaatggccggtccacagctcgccggtggcaccgcgcatggcacgcagccgttcgcgcgctacctcttcgctatgcggcttgccgtagcattcgccgtccagcaggaacatggaatcgcagccgagaatcagcgggccggccttcgaacgggtcaggcttggacggccatccacgaaatcggcgatcggctcggcgacggtgggaatggcgatgccggagaaatcgcgggtcttcgtctcgtcggcggactgcgcgctgtccgtgcgtgcgtctgtgcccgccgaggatgcgtcgcgatcgtctaccgcccggagcgggaagccgaccacgcgctccccgcgcgcgtgcgccgcggtatcggcgatgttgcgatacgcctggtgcacggcctcggccttcgccgtggcgagaatcatcacacgctgttcgacgctcaggtcgttcacggtgacgccaagcgcggccgcctcgcgttcaagcgcggcaggttcgtcgacgtgcgagacacggatggtcgggcagatgccggcggagaacagcacgtcacggcgtggacgggactgggaggcgagaatcagcgggatgctcatgcgcgttccacctgcacacccttggtgtcgaccgcgagatgcagcacacgccaatggccggatgccagctcttcggcggcgatctgttcaagctcctcgtgggcgtcgccatggtgcagcaccagcacgcatgggccggcgccagacacggtggaggcgaagccgtgggagcgcatcttctcgatcagcgcccaggacggctccatcagcgaggcgcggtacggctgatgcagacggtcctgcgtggccgcgaacagcagtgcgttggcgttctgacgcgagccggaggccagcatcgcggggttcatggcggccggcagcaggctcacacgggagacgttgtgcacggcgtccttgaacggaatctcagtcggcaacgcctgacgggccttttcggtggacagctcgtagtccggcacgaacacggccgcggtcagatcgtccgccacgcggtaattgatggtgtggaagccgttgtgcatcggctcgccgcctggaatcggcacggatccgacaccttccgcggtctccatgtcccaggacatggtcaggccgccgtacacggccggggccacgttgtccggatggccttcgatggcagcggccagctcgaacacggcgtcgcggttgaggtcgtcgtcctgcgcgaaggctgccgcggcggcgatgccggcgacgatagcctcggcggaggaacccatgcctcgcgcctgagggatgttgttgtgcgcctgcagaatgaatccgacgcgtcccagaccgaaggtctggcatgcgcggcggaacgtggagaccaccaagtgcgtctcgtcacgaggcagggtgtcctcgccctcgccttcgatcatcacctgcgccgcggtgttcaccgggtcggcgctcagcgtgaattcaagctcgtcatgatagtccaaggccaaaccgaccgtatcgaaaccggagccaagattggcgctggtggccggaaccttcacacgcaccttgcgggtaactggagtcatctctcgtcgtccttcgtcacatcttcattacaaatcaagcaccgtataccgtggcagtgccagagtcaaatttcagggggaaccgcacccgtgcatcgcattcgggcccatgacggcggcttggcatggcttgcatgccaagccgccgtcatgggcccgaatcgcatccgatatcagttcagcacgcgcaggatcgacgactctccgcacacgcaatccagctcgcacacgtccttgacggtttcgcgcagagtgagctcatcggtcatgtgggtgaccagacgcagctgctgcagctcgccgtcatagcccggatccttcagcgtcggcttcagatcctggttcacgccgttgatggacacgccatggtcggcgaacttggctgcgatcgcggcgagcacgcccggattgtcgtgaatcacgaagcggaccgcgaactcggccttggacgcctcgatcggagccttcttcagatccttgtacagcgggatggacggaccggtgcagccctgtgcgatatggcgggcttcggtgaccacgtcgccgacgaccgcggaggcggtcggagcgccgccggcgccgcggccgtagaacatgaggtcgtccgcggcttcggccttgacgaacacggcgttgaaggagccgtgcacggaggccagcggatgggtgttggagatcagtgccgggtagacgcgcgcggacacgccggcatcggtgttctccacgacggcgagcagcttgatcaccttgttttccgcggtggcggcggcgatgtcgtcggcggtgatcttggtgatgccctcgacggagacgtcgtcgatggtgacggaggtgtggaagccgagggtggccatgatcgcggccttgttggccgcgtcgtagccctcgatgtcgccggtcggatcggcttcggcgtagcccttggcctgcgcgtccttgagcacgtcatcgaagtcgaggcccttggtggtcatctcgtcgaggatgtagttggtggtgccgttgacgatgccgagcatgctcgtcaccttgtctccgacgagggattcgcgcagcggcttgaggaacgggatggcgccgcccacggaggcttcaaagtagatgtcgacgcccttggcttcggcggccgcgtagatctccggaccatacttggccagcagcgccttgttggcggtgaccacggaggcgccggattcgatggcggcgagcacgaacttgcgtgccacgccggtgccgccgatcagctcgatgacgatgtcggaattggtggccacgctcatggtgtcggtggtcacgatggccttgtcgatccacgggaacggattggtttccgccgggtcaaggcaggcgacgccggtcagctcgatcggtcgtccgatacgtgcggcaagctcgtccttctgctcgaccagcaggcgtgcagtctgggaaccgacggtacctgcgcccagcaatccaacgcgaatcggcgcaacatcttcctgtgccaaggcatcctcccttgaatgtgaagtattggtgtgaccttgcttattgtacggtctcaatatgacgtaaggccgcggaatatcaagaaaatggacggtttccgaagctttccccgcaaggaagcccgaaaaccgtccataccgtgagacgcaatcgtggactattcgctgacgtcccagctcagcagatcgtcgatcgtctgccggcggatcatgacgtgtgcgccggcctcgccgacgccgaccacggcgggaatcagcgcctggttgtagttgctggccatcgtgcggccgtacgcgccggtgacgggcacggcgagaatgtccccgcgcctgatgtcggccggcagacgcacctcgttgacgacgatgtcgcccgattcgcagtgcatgccgaccacgcgacacagcttggtctcgtcggatcccttgcgattcgcgattctcgcggtgtagtcggagccgtacagcgccggacggatgttgtcggacatgccgccgtccacggacacgtacacacgttccgtcaccggattgccgcccttgtctttggcttcaccgttcagctgcaccggcttgacggtgcccacgcggtacagcgtgacgccggtgggggccaccgtccagcggcctggctcgaaggagatgaccggggccggcatgccgagcgcgcggttcacggtgctgaccgcgtcggcgagcctgccgagctccacgtcgatgtccatggaatcctcaccgtcggtgtaggccacggaatagccaccgcccagatcaacctccggcagggtgtacgcatcggtggcgtagaaggtcttgcgcagcagcatcatgcgcttggccgcctggatgaaagcgtccgcgtcatggatgttggagccgatatgcgagtgcacgccgaccagttcgagcacgtcctggcggcggtagatgtccttgagcacggcgagcgccgggccgtcggccaccatggtcatggcgtcggcgagcttgcggtcgccttcggagaccttctcgtggctcagatcgtacgggtatttgatgtcgtattggagcttgcgttccgcgtggccggcatgggcggcttgatcggcggcatccgcagcgttctcccccaatcgtgcgttcgaccctgccggcgtcacgtcggtcaggtcgtcgagcacagcaagcttgcccgcgtcggctctggcgggcagcagggccacgccgaacttctggtcctcgtgggcggtggacacgaattcgtggccgccggcgtggatgccggaggtgacgcgcagcatgacgcgggcgcgcttgccgagccgcttggcgatcgcggcgatgcgtgccggctcatccggctcgtcgatcacgattttgttgaagccctgttcgatggccagctcgatttccgcatcggacttgttgttgccgtgcagcacgaggcggcggcctgggacgcccgcggcgagcgcgatgcgcatctcgcccatggagcaggtgtcgatgagcatgccggattcggtgacgatgcggcagatttccttgctcagcagcgctttgccggcgaagctgacgtgggtgacggtgttgttgaacgcgtgggacgcggcatgcacgaatttcgtggcgcgggcgcgcacgtcatcggtgtcgatgacgtagagcggcgaaccgaattcgtcgagcaggcttgcggcggtacgaccgtggaaggtgatctcgccttcgtcgttcacggccgagccggccggccagattgggcttacaggcatggtttgcgtatctccctttttcgtggattcgcttcacatcttgtccggagcggtgacgccgagcaggtcgaggccttcggcgatgaccgtcttgacggcgtcgttgagcttgagtcgcgcggcggcgcgggccggttccggagccttggcgatgcggatggcgtcggcctgttccccgcgggcctccggatcggtgagttccatcggcacgacgcgctccacgttgtaccacttgtggtaggtggcggcgaggtcctccaggtagtgggccacgcggtgcggggcgcgcaggtcgcccgcttcgcgcagcagggcgggccactgggcgagcgcggcgagcacttcgccgtcggcggtggtgtcgagcaggctcacgtcggcgccttcgtaggtgatgccggcggcggccgcgttgcggtccacgttgcaggagcgggcgtgcgcgtactgcacgtagtacaccggattctcgttggaatgcgaggacagcaggttcaggtcgatgtccaccggggagttgtagtcggtgcgggccagcgaatagcgggaggcgtccacgccgatggcgtcggtcaggtcgtcgatggtgacgacgttgccggcgcgcttcgacatgcgcacggccttgccgtccttcatgacgttgacgagctggccgatgaggatctgcatgttctcgcccggcttgtcaccgaaggcctcgcacatggccatcatgcggccgatgtagccgtggtggtcggcgccgagcatgtaaatcgccacgtcggccgggttggtctcgcggtggcgcttgttgcggtagtaggcgatgtcggcggcgaagtacgcgtagttgccgtcggacttgatgatcacgcggtccttgtcgtcaccgtgcttggtggattcgaaccaggtggcgccgtccttttcgtaaatgtcgccgcgggcgcgcagatcggcgatggcctggtccacttcgccgtcggaatacaggctgttctcgtggaaccacacgtcgaaattgacgcggaagttcttcatggaacgctggatttcgtcgaacatcatcggcacggcgcgcttgcggaactcctcgcgctgttcggaatcgccttcgccgagcgggttgccgtcctggtcggcgccgccgtcgacgcgcggcaggctcagcacgtccacgccgtccgcgttggcttcgtcgatgacacgcttggcgatttcgtcgatgtacgcgcccttgtagccgtcgatcggggtttcctcgccgtgggccgcggcgacgagcgacttggcgaagcggttgatctgctcgccgtggtcgttgaagtagtattcgcgcaccaccttggcgccgttggcctcaagcacgcgggccatggagtcgccgacggccgcccaacgggtgccgccgatgtggatcgggccggtcgggttggcggatacgaattcgaggttcagggtcttgccggacaggtggtcgttcttgccgtagtcgctgccggcttcgagcacggtgtccaccactgcggccgcggatgcggagtcgagcgtgatattgatgaagccggggccggccacttccacggacttgatgccgtcggcattggtcagttcggcggcgaacagttcggcgagatcacgcggcttcatgccggccttcttggccagctgcatggccgcgttggacgcccaatcgccatgtgcgcggtccttcgggcgcatcacggcgaacttggcctgcggcggaatcagatcggcggtcagggtgcctgccttgccttcggagacaagggtgttggcaatgttgaaaatcagttcactaagggcttctggactcattcttccaagaataccgggcacgctgacagaatcagtcttcctgtccatcctcacgatggggttgcgatacgtcctgcggaacgctttgcaaggcgttctgagcatcgtcctgcccgccatgccgtttcgtacgccacgccacggacgcgtagtagcccgtgtagcacagcgccacgaacggaatcatgtacagcagcgtggagcgctgcgacggatcgcaaatcaccagaaccagcgcgccgacgcacatcacaatcgcgacgatcggcacgaacgggtagccaggcgcgcggtacttgagctcgccaaccgtatgtccctgcgcgagccattggtggcggaatcgcaagtggcagacggagaccgacgcccacaccaccagtgtggccaggccggagaccgcgaccagcgcgaggtagacggtcgaagcggccaccacggaggacagcagcgccagcagcgagccggccatgctgaacatcaccgcgaaaacgggcacgccgtggaagttcgttttggcgagcttgcgcggaatcataccctcctgcgcgagcgaccacaccatgcgcgagcacacgtacaggccggaattcgcggcggacagcaccgccgtgagcaccacgaagttcatgatgtcgccggcgaacggcatgccgatcgattggaagacaagcacgaacgggctcgcgtcgacgccggacttgtgccacgggatcagcgcggccatgacggcgatcgagccgatgaagaagatcgccagacgcagcacggtggtgtgcacggccttcggaatcgccttggacggatccttcgtctcgccggcggcgacgccgaccacttcggtgccggagaaggcgaacaccaccgtcagcagggtggagaagatcggcagcacgccgttgggcagccatccgtcgctgtagaagttctcgaacatgggcgcatggctatagccggcgattggaatcgcgccgaacatggcgagcaggccgatgacgatgaacgcgacgatggcgaacactttgatggaggcgaaccagaattccgattcgccgtagagccgcaccgacaggatgttgagcaggaacacgacagcgatgaagacggccgaccagatccatgcgggcgaatgcgggaaccagcgttgcatcagcaagccagcggccgtgaattcggaggcgagcgccaccgcccaattcagccagtagagcacggcgatggtgaacgcggtgccggggccgatgaaacgcttcgcatacaggtggaagctgccggcgtacggcatggccacagacagctcgccgaggctcagcatgatgaagtagacgagcacggagccgatgacgtaagcgatgatcgcgccgagcgggcccgcctgatggatggtgtagccggagcttaaaaacaggcctgtgccgatcacgccgccgagcgagatcatggtcaggtggcgcgtttccatcttgcgttccaggccgccctgttcgacgtcgggcttttcttgcgattgcgccatgcttgcttccggctcctcttacgtttggttgggtacggcacatagtttggctggccgaacaatcgcaaatactatacgtcagactcacggcaacgtgcgatggtcgtccatagttcgcggaagtgtgcagaagcccgcggaagtccgtaaaaaagcgtcagcccgcatgctggaaaagcgtgcaggccgtttgatcgcaggtagcggtaggcaatcgcagtaatcgcaatgcttgcgatacctacgaaacgtgcgaaatgctcagagcgcggcgatggcgtcgatctcgacgagcgcgcccttcggaatgtcgttgccgccaaaggccacgcgggccggcttgacggagccgatgaaggtctgcgcgtacacgtcgtcgacctcgtggaagtcctcgacgttcttcatgtagatggtggcgcggaccacattctcgatgccggagccggcggtgtcgaggatgtgcttgatgttcttcagcgcctgcgcggcctgctcgcccgcactctcgccggccagttcgccggtggccgggtcgatgcccagctggccggagacgaacacgaatccgttggccttcacggcctggctgtaggcgccgagtgctgccggggcttcggaggtggccactgcttccagcttttcgctcatactgttctcctttgtcgtaaggtatgttgccgcaaggtatgtaaacgcgcgccaagtatgtgccaatatgcccgtacatgcgctatttgcgtcgcacctgaaatcatacttttccgatgggtggaagcgggaaaaaccgttcacagaacgatatggccggagttggcaccacacggcgcagcaggcacgaaaacggcggaatcgcaaggaaaaccgcggaaaaatacaacaaacgagcaacaaaaaggctccagccgttcgactggagccttgcccggtgggcttgatggggatcgaacccacgaccttctgttccggagacagacgctctatccgctgagctacaaacccatgcaacgcactactgtacacggtctgcgcccgtttgcgacacgattcggcgaaaaacgtgacacagaccttgcaatcgttgggaaagtcagtacgcgcgctcaatgcatcagagcgctcggcgcaaccagcacgcgctgcacgctcagtacatgagggtggcgaggcgacgacgtgcgcgcttcagacgctcgtcggtcggctcgggaatcgtgaagtattcgagcagacgctggcgcaccggctcgatgtcggccttgtggcccgccgccacgaaatcaagcagacggtcgaacgcgtcctggatctgcccgccgatcatgtcgatgtcggcgacggcaagctgcgcgtccacatcgtccggcttgtcggcggcagcggcacgcaccacgcgcacgtccgcattggcggaacgggccagcagcagcgccttcgcacgttcgcgggcggcgcgcgtatcgttcggatcggcttccaaaaccttctcgtacgcggcggcggcaccggcgtaatcgccctgctgtgccagcatgtacgcttcctgatgttccggcggcacctgatcctgcacactgccggcggatgcggaattggccgcgtcggaatccggatcgcccgaatacggagcggtgccggtcacgccggcctgctgcgcggcggcgataagcttcggcacgaccacgtctgtgatctgctgcagttcctcgtcggacggaaggccctgcagaatcggcatcggacggccgccgatcaacgcgaacagcgccggcgcgccctgaatctggaacgcctgtgcgatggagggattggatgcgatgtcgatgcgggacagctggatctggccgttgagcttgttcaccgcgtcacccaatgcgcgtgccatggcgaacagacggtcgtcggtcggcacccacaggaacagcagaatcgggaacgtggcggaggtctgcaccatggcctggaacgtgttctccgtggtgtcgatgacatatccgccagccgccggagcgccgcccgcctgccccggcccggccttcacctgatgcttgagcgcttccagatcaacggctcccgccaatgaaacacccggatggaacgcttgctgctctgccatacttgcctccaaaaacacgaaatcgttgctggcaccaactataggtgccaacaacgatttcccggttttcattcccacggatgcgcgataggcggaaaaccgccgacgatgcgcgtccaaggacccgtcgttttacagcgcttcgaccttcaccggctggcgttcggaaccgaccgcggtgattttctgcccggaattcgccggcggaacatacagcgcgatgacgttcacatagctcgtcttcatggtgctggtggccttgccattgccgaacagcgccttttccgcgtcagaggccggctgcgattcacggccagcgccggcggaacgagtccattcggagttgatctgcgccaccaccagatcgccgccgtccgcggaacgcatgacgctgatggctccattgaccggttcgaaggtctgctgctgcgtgccttcgttaagctccatggccttctgcacctgggcagtcagatcggcaagcttcgatcgcagatcatcatccgcgaatttgctggcgtacttgccgttcgccccgttctgcagcaggtccgcatacgcgtccaccgccgctttcggcgtcatgaccagaccggtgtccgtaggcgttccctgcgcgctgccggttttggagatttcgaaactcggcatcttcacgccggagaacagtcgcgccacaccccacaacttgtagttctggcgtgcggaatcctgcctgaacaccagcagacgcttggactgctggtccttggttgtggacgtgatggagaacacggaccgtggccagccggcatccgtggagatcacggcctgggccagatccgtggggatggtggtcttacggtcaagattgcccgtggctttcgctacgttcagctcgctggtgcggatgtccagttccggaccttcgagaatcgtcggcaacgtatcagtgtcacggttctgattgcactggtcgagcgttttgagaatcctcgtgcggaccttttgctcctgcttggcgctcaagttcggcgcatcctgccgggtggtggctttcggggtcggcagctggccttcgcaaccgcacatgccgacggccattcccagcgcgagcatggccgcgataatcgcctgactacgcttcctcatcactggtcctcctcttggccgtcttcctgcgtttccgtctgaacctcctcttgggcaagacgagcgaaatacgcggcaagctcatcctgcgagatcacggaagtcgcctcgtcgtcaacagacgattcgcccgccgtcgattcaaatacggtcgattcggacacagtcggctggctttccgcaatcgtgttctgctggtcggcgaccaggttacgtgccacaggatcgacgatgacgggctgttgcgtttcctcgaacgacgacgtacgaccgccggtgcgatgttccgcatggcgacgcctgccgtgacgcgacctgctccgtgccctgttgctggcggcggtttcggcgttcttcacccaagccgaaacctcgttctcatcgccttcgttgacgccaacgccttcgaccatggcgaaagcgcgcttgttgcggcgcttatgcggcggcatggcgaatacggaagcggaaagcacggcgagaatcgccagcagtccgccggcaagatacaacggcatggcgaaattcggcaggttacgacggtcccaattcagagtgaccgtatcccccttgcggttgccgaaatcaatcaacgccacaacatcctcggcgttattgctgttcgatcctttgacctgcatatcaacggcaccgtcattgcacttgatggtgcgccacatgtcggagtccttgaaagccacctggttctgggaattgtccgcggttccctgcgcggagaccttcatggtggaaagcgtcgtccaatcggacagaccggagacgcgcatgtacttgcttcccgcaatccatccggcaacgtcgcgcgcggaacctatggcgatgcacacattggatttcttgtcacgggatttggccgaaatattgacgcggctgtctaccagctgcagcacgttcggatcggtgaccacgtattccgaaccgttcaccggagcggcggcggtgatctcgttgtccggtttccagacggttgaattcaacacgccaaacacgacgcatgcgatggcaagcaagccgaaaataggcgtgacgatgccacgcatgatcttcgcatgccgggtagggcccgtctcgatctgcggcttctcttgttcttcctgcaatacagtcatagcttttccattctacagtgtccgtttgcacaagcctgaaaaaaacatgaaaatcatgctttgccgctatggttggccctatgcgtaaatcacttctttccaaggccgtcacggcagtctgcgcaacggtcatgtgcctgggcgtcactgcgtgcggcggtaattccagcgcgaaatccgacaaatcgaactcggattcctcctcatcttccgaaaaaatcggcatgcaccagatcgccggcgtgaccgccaagggcgagctcggcaagaagccgaccgtctcgttcaaaacgccgatgacggtcgaggacaacagctacgtggtgctgcagaagggcgacggagcccagatcgaggacggcgaccgcgtctgctcgcagggcatcgccatcagcgtcaaggatggttccgaactggccagcacgtgggagaagaacacccccgactgctccaccgtagtcacctcggataccagccagatgaccgagaactactacaagatcttcaagagcctcaagctcaattccaccgtggcgttcggcgtgaacgactcgaattcctccggcacctcgtatctcatggtactcacgctggtgtccaagtcgtccaagtcgaaggacctgaagaaggccaccggcgagaaggtcgccgacattccggccgacctgccgaaagtgacgctcgccaaggacggcaagccgtcgatcgacatgaatggctataagggctccgattccttgatttcccaggacctcatcaagggcaagggcgctgtggtcaaggatacgcagtccgtggtggcgcactacaccggctggctgcttgacggcacgcagttcgattcctcgtgggaccgcggacagtcctccgccttctcgcttgacagcgtgatcaagggctggaagcagggtctggcaggccacacggtcggttcccaggtactgctggtggtgccgccgagcctcggctacggaaacaaggatcaggagaagattccggcgaattccacgctggtcttcgtgatcgacattctcgccgcctactgatccagccggtctaaccgcaaaaagcctcccacccgggaggctttttcattagaagagtcgtagagagtcgtcttcggtgcccttcatctcctcataatcgagaatcaggcatttgaaaccgcggtcctgcgcgagcacgcgggcctgcggggtgatggtctgcgcggcgaagatgccgtgcacgggggccagcagcgggtcgcggttgagcagatcgcagtagcgggtgagctgttcgacgccgtcgatgccgccgttgcgcttgatttcgatggccacgtgctcgccgttgccgtcaatcgccatgatgtcgaccggtccgatggctgtcgggtattcgcggcgcacgagcttcgcgcctttgccgatgcgttcgatctgttcggccaggtacttctgcagatggtcttcgacgccgtccttgatgaggcccggatcctcgccgaggtcgtacgattcgtccgaatagatgtgctgcaacgtcacttccagcacgtcgttcgatttgtcggccgacgcgcggatcaccttttgcggcacttcagtatcaacgtcgtcatcggcgtggtcgggggtgatgtccctgatgctgcatggcgcggacatccagttgagcggcttgtatgagccgagttcggagaagatcagcaggctgttgtccgccttgatgagcagcacgcgcttggcgagcggcagggaggcgttcaatcgtccggaatattcggcagagcagtcagcaacaataattcgcacgaggcactaccctaccatgcgcgtcgccgtacgtacggcatacgtattcgcggcggcggaaagccacgtaaaagacaaaagcggcccggtaatcgcaatacaaaaacatattgcgattaccgggccaccttacgtcaagcggaaacggcttattcggcgcgcttcacgttggttccacgctcgaccgcgacggtgagcttgttcgaatcgaaggagatgaagccgtcagtcacctcgaaggagaggcgattgccttcaggatccaccacaacgatggttccttccttgatcacggtcagcacaggctcgtggtcgggcaggatgcccattccgccttcggaggcgggaatggtaacggacttcgccgtgccgtgccacacagggtggtcagcggcgacgatgttcacctgcaatgtcgatccggccatcacgcaccgtattccttctgcatgtcgtgccacttcttctcgaggtcgtcgatgccgccgataccggagaatgcctgctccggaacgtcgtcatacacgccgtcgcagatgcgggtgaatgcttcgatggtctcgtccgccggaacgtaggagcccggacggccggtgaacttctcggcgacgtagaagttctggccaaggaactgctcgatcttacgggcgcggttcacagtggtcttatcttcttcgccgagctcatcgataccgatcagggcgatgatgtcctgcagctccttgttacgctgcagaatcgccttgacgcggttggcgcactcgtagtgagcctggcccacataacgcggatcaaggattcgcgaagtggagctcagcgggtcgactgccgggtagatgcccttggaggcgatgtcacgggacagctcggtggttgcgtccaggtgggcgaaggtcgtcgcaggggccgggtcggtgtaatcatcggccggcacgtagatggcctgcagcgaggtgatggagtggccacgggtcgacgtgatgcgctcctgcagcgcgcccatctcatcggccaggttcggctggtagcccactgcggacggcatacggccgagcagggtggatacctcggaaccagcctgggtgaagcggaagatgttgtcgatgaacagcagcacgtcctggttctgtacgtcacggaagtactctgccatggtcagtgcggtcagcggcacgcgcagacgggtacccggctgctcatccatctggccgaagaccagtgcggtcttctcaagtacgccagcttcgtccatttcgccgatcagatcgttaccctcacgggtacgttcgccgacgcctgcgaacacggacacaccgccgtggttctgggccacacgctgaatcatttcctgaatcagcacggtcttgccgacgcctgcgccaccgaacagaccgatcttgccaccctgcacatacggggtcagcaaatcgatgaccttgataccggtttcgaacatctgggtcttggactccagctggtcgaatgccggcgggttgcggtggataggccaacgttcggtgaccgtgacggtctcgtcggccttcttgttgaggatgttgccggacacgtcgaatacgtggcccttggtgacatcgccaaccggcacggagatcgggccgccggtgtcatacacggtggcgccacgcacgaggccgtcagtcggcttcagagcgacggtacgcacggtggaatcgccaagatgctgttcaacctcaagggtgatcttcttggtggtctcgccctcttcgtggacaccggtgttggccagttcaacggtaagtgcattgtaaatgtcgggcaggtggcccaccgggaattcgacgtcgataaccgaaccctggatacgcgtaacgcgtccagcggtcggctctgcagccgtctcgggagccgctgtggtctgattctcagccatatgcgttcctactcttccttcttgttcagcgcatcagcgctgccgatgatttcggtaagttcctgggtaatcgatgcctgacgcgaagcgttgagcttgcgagtcagttcatcgatcaggctgcgggcgttgtctgtagccgtgtgcatggcgttctgtcggcttgcagtctcggatgccgctgcggtgagcaggcattcatggatacgggactggatgtacttcggcagaatcgcgtcgagtacttcgtcaacgcttggctcgaacgcatacagaggagtcgcagcatcggcatcggattccggcacaggaccggattccggctgttccggaagcacgagctcaacgggtagcatgcgcagcacacgcaccttctgaaccaccatattcacgaactcggtgaacacaatgtagagttcggagactccaccttggtccgccggcttcatataagcgtccaacagtgccttcgagatggactctgcgacttccacgccgggctggtcggtatcgccttcccaagtgccggcaaccggacggttgcggtacttgtaatacgtcacaccgcgacgaccatacacatacagttccggctgcttgcccttctcgtcgagtcgggccaacagcgattccgtttcgcggatgatcgaggaggtgtacggacctgccataccacgatccgaggtgagagcgaggacagccacgcgagggttgtcctcgttctttttcacgatcggatggtcgatatgggtatgggccaccagcgcttgcacggcgtcgaaaatcgcatcggtatacggcttcgcgttcaaggccacgtcacgtgccttggcgatgtgcgaagacgcgatcatctcctgcgcgttgaagattttctccagcgacgcggtggaggcgatcctagatttcaatgcgagttgcgagcccatgaatcacttctctcctgcgacgatcttttcctgctcgaccggagtggtgtgcttctcgtcaggcttcttctcgaccagcggcttgcccgcgctggtcacgaaggtctcacggaacgcttccacggccttgtcgagggcagcctcggtgtcggcggtgaagtcttcggtctcgcgaatggtcttgaggatatcggtgttgtgatccagataatccagcatgcccttttcgaacggcaacacgtcgctgattggcaggtcatccatcttgccatgggtgccggcccacacggacacgacttcctgttccatcgaatacggggagaactgcggctgcttcaggagctcggtcaggtgggcaccacggttcagctgagccttcgaagccgcatccagatcggaagcgaacatggcgaaggattccagcgaacggtactgcgccagcgagatcttcagcgtgccggagaccttcttcaaggccttcgtctgggcagcgccaccgactcgggacacggagatgccgacgtccacagcaggacgctggttcgcgttgaacaggtcggactgcaggaagatctggccatcggtgatggaaatcacgttggtcggaatgtaggcggacacatcgttcgccttggtctcgacgatcggcaggccggtcatcgagccgccgccgaggtcatcggaaaccttggcgcaacgttcgagcagacgggagtgcaggtagaacacatcgcccgggtaagcctcacgccccggcggacgacgcagcagcagggaaatcgagcggtaagcctcggcctgcttcgacagatcgtcgaagacgatgagcacgtgcttgccgttgtacatccagtgctgtccgatggcggaaccggtgtacggtgcgatgtacttgaagcctgcggaatcggaagccggggaggccacgatggtcgtgtactccatggcgccggcctcttccagggactgcttcaccgatgcgatggtggagcccttctggccgacggccacgtagatgcagcggacctgcttcttcgggtctccggattcccagttgcgcttctggttgatgatcgtatcgattgcgatagcggtcttaccggtctgacggtcgccgatgatgagctgacgctggccacggccgatcggcgtcatcgcgtcgatggccttcaggccggtggacagaggctcgtcaaccggatgacgatgcataacgtcaggtgcctgggcctcgagaatacgacggccttcggtcttgatctcgccaagaccgtcaatcgggttgcctagcgggtccacgacgcggccaaggtagccgtcgccgacgggcacggagagcacttcgccggtacgacgcacttcctggccttcctcgataccggtgaaatcgccgaggataaccacgccgatctcgcgggcgtcaaggttgaacgccaggccaagcgtgccgtcttcgaaggtcagcagctcattggccatgcaaccaggcagtcccgtcacgtgcgcaatgccgtcgccagcggtcgcgacataaccgacttcctgggtcggcgtgtccgacggcttgtacgactcgacgaactcatcgagcgccttgcgtatcgtggtgggatcaatggtaagttctgccatgatcactccttattgttgtttttaaattcagtcaagtcttgtttcaggcttgttcaccgtgtggcgtgccgtcaggcggtcgccttcaccgtgcgctgaagatgttgcagctgtgcgaccaccgtgttgtcggtgacctcgtcgcccacctggatgcgcataccacccaggacggtcggatcgaccaccgagttaatgtgcaccggatggccggtcttcgccgaatagatggcgacgagcttcttgacctgctccttgctcagtggcgttgccgtggtgacggtgaccatcgattcgcccatatgacgggagaacttgttgatcaaccactggatggtctgcagatagcggcgattgcgcagattgcaggtcgcatgctcggccagacgcttggtcaccacattgaagtcggcattgccgatcaggctgtacagcagcttgatacgggcttcggcggggacggttgcgtcatacagcttgctgcgtacgaccggaaggttgagcagtgcggaatgcagctgggcaagctcgatggagacctgcagagtagcattcgtgtggtccgcgtagtacatcatgccatccacaccgaaatcctcggtggcgttggcgatgtcggacacgcggctccaacggcgggccaccagatcggacatgatttccatcgtcaacggatgggcctcatctccaatgagggtcttgactaccgcaaccttgtcttcgactgggcgcgacgggtcggtgagggcacgttcaagctggatgttgtggtcgagcgcgttggtgatcgtgaacagttcgttcccgatgcgccatgcgtcctcgccgctgtcacgcagcctgggggccagcgagtcacgcgaaacgcggtctgcgatacgcgatgcttctcctcgcattggtcacctccctttcttgaaggtttcgatcacttcttgtcgctgtccagatcggcgatcatctggtcgatcatcgtcgactgcacgtcgtcgctctccagcttgctgcccaggatcttgccggccagtgccgttgccagcacgccgacctcacccttcaggctcaccagagcctgctgctgctgggattcgatggaacgctgggcggtggcggtgatctgcgccgcatcagcctcggcacgggtacgtgcgtcggcgatgatgtgcgatgcctccgcgcgagcgtcgtcgcggatcttggaagcctcgacgcgtgcgttgctcagctgggcatcgtacttcgccttggcttcgtcggcatccttctgggcctgttcggccttggcgatgccgccttcgatcttggctgcgcgctcatcgaacacggcctggaacttcggcaggaagaacttgtagaagaacacggcgacgatgatcagaatgaccaacgaccagaaaatgtcgtagcttttcggaaggaacagttccatctcgctagctgcggtcaccatagtgtcttcctcctttcacgttcgtttgcgtcttcggtgtttaccttggggatcaagtcttacttgatgaaggcgagcacgaagccgagcagtgccagcacctcaacgaatgccaggcccaggaacatgagggtctgcagacggctgccgagctcaggctggcgagcggtgccttcgatggtcttgccgatcaggatgcccagaccgatgccagggccgatggcggcgaggccgtagccaacgacgttcaggttgccggcaacctcagcgagggtaacgatatccatgattgtttcctttctggttattgcttgacaagaagcaacacttaaaaagccggcggtcagtcgatctccggatagctcatattgatgtatgcggtggtcaggatggcgaagatgtaagcctgcaggcaggcgaccagcgcctcgaacaggaacatgaacatgccagccgcgaaggtgatgatgccgaacggcatcatcagcttgttcaccacatcaacgaggaagaactgcgtggccgagaggcacaacgcaaggatcaggtggcccgaaaccatgttggcgaacagtcggatcgtcaacgagaacgggcggataatcagcagctcaagcagctgaatcggggacagcagaatatagatcggggccggaacgcccttcgggaagatctcgtccctcaggaagtggccaaggcccttttcacggatgccggcaatccagtactggcagaagcaccacatggcgaacaccagaggcagcgtgatggacgcgcttgccgcgatgttgaagcccgggatgatgccgcacagattgaagaccagcaacgtgcagaacacggtggtgatcatcggcacgtaacgcttgccacgcagctcgcccatcacctgatagacgatgttgtcgcggacaaactcgatcagccattcgactgcgccctgccaacggccagggatgagctttgcacggcttgccgtaattccgagaaccagcagcatgatgacggtcgcaaggatacgaacgaggatgatgcggttgatggcgaacggcgtgccttgaaaaacaaacggatcgggaaggaagtcattgatgctcggcatctctggaccatcggcgatggccagcatgccctctcccaatgcactaatcattcacgcctcctgctcttgtgtcagctgtcagtttagcccaacagccgagtcgaatgtgacgttccggttaccaaaaccgcaacgtccttcgggaatatgttagcgcgcccgtaaacgcgttcgcatacaagccccgaatggctgcaaaggattatcagcccgtggctagacaacatgccgcaccgggagctttcccctactaccgtatagcgaaaaccggcgtttcgcacgttgcggggactattagacacaaccacggccgttgtcgattcggcctatttcacccccattcacaccaaaatagacatcgtttgcaacactgcttgataaaacgttttacttaaaaaatcacaccataatatatgacggcgaaaatgaaacgatgtcgcagcaggcaacaaaaaccgcgcaaaaaagcccacgacaccgcgtaaaagcggcaatcgtgggacaatcgccaatacttgtcagcagtcgccgatcttcgtgaaatcagccgcggatgacgccgtagccgtcatgcgagaatggcgtgaacgcgtcgacgcgcggcgagcctggctcatgacggatcgaccgatcggtgccaagccttttctccgcacggagcctcggcacttcggccagatcgtacggcgtggtctgatagacccagttgagccagttgcgccacagcaggttggcgtgggcgcgccaggcgaacagcggttcgagcttcggatcgtcgtgcgggaaatagttttcggggaacggcacgttggtcatgcccttcttcatatccctctcgtattcctcggcgagcgtgtacttgccatactcccaatggccgagcgcgaacacttcggagaagtcgcgcgtggcgatgagccccgggccggacttcggaccccacgtgagcacctgcagctcgggattatgggcgatatcaccctcgttgacccccgccaggcgggaatgcggttgcaggcagatctcgtcgaaaccgttggtgaggaagcagtattcgtcctgcagatactgggggaacactccaaagagcttctccggcagcaactccttgcgcacgccgtaccgatagttgagcgcgcccatcgcgccccagcacaggtacatggtggagaagacgtgggtggatgcccagtcgagaatctgcttgaactcgtcccagtagtcgacctgctcgaaatcgaggtgttcgacgggcgctcccgtcaccacaagaccgtcgtaatagttgtctttgaacgcgtcgagcgtctcgtagaacttcaccagatggtcggcgctcacgtgcgtggcctcgtgggtggaggtcttcatgaagtcgacctcgacctgcagcgggctcttggagatcagacgcagcagttgcgtttcggtctcgatcttcttcggcatgaggttcaggatcaccagcttgagcggacgcacacgctggcgctccgcttcgggcttttcaagcgcgaagatgcgctcggagtcgagaatgtctctggccggaaggccgctgggaatcttgataggcatgtttcctattatggtgcggacccggatatggcgtattcggcggttttcatcgacggtccgcagcgttatacgaaaaacggataacgcgttatcggatatgcgatttcactagcagcgcaatatgcgacacgccgatttgacttattagccaacatccgtaaagtagttagagctgcctcaatgaaggcaagccgacgcggggtggagcagctcggtagctcgctgggctcataacccagaggtccatggttcaaatccatgccccgctaccaattgaaaccggaaaccttttggtttccggttttttgttttccccaggacgtttcgctccttttatataaagtccccatacatatcgaacgcaaccggcacacacaacgtatggtcatgccgccgcagccttcataatcgaacataatcgcaaaccatgtattaaaacgctttaccaaaagtatttgaagaaagtacttgtagccgcatcgccgtaatcgttacgaaaaagggaaatcacaaaaagaacacaactacctctataatcggctatatgaatgaagcaacatcatcaagcgcgacaccgcgcacaaaggcaacagcaaagacaacagccaaggcagcggccacaaagacaacgaggacagccgcgaaatcaaccgcaaagacgacaaccaaaaaaccaaccaccaagcgcacttccaagccgaaaaccgcaacgaagcgaaccgtcggcgaaactccagcacctatcatcaaccgcaccagcccggaacagttcggccgcgtaaacgttcttgacatcactccgtccgccgaaaacggcctgtacccggctcgcgtggagcttggcgaggcattcaaggtcaccgcgcaggtgttcatcgaaggccgcaccaaggccggtgccaccgtgtccgtgcgcaacacgcgcggcaccgagaaggcccgcttccccatgacctgcaccaaccccggcctggaccgctgggaagcgatggtcaagatcggcgaccacagcgacctgaagccgtgggaagatagctatgccgacgtcaagaagcagctcggcgaatggcacatcgtggtcgaaggctgggaagatacgtacgcttcctggctgcacgacgcgcaaatcaaggtcgaggtcggcgacgatgtggagaacgcgctggaatccggcgcgcagctgctggaacgttgggctggcgcacgcgattccaagctgaccgccgacgacaagaagacgctgcgcgaagcggcgaagaccgttgccgacaagtcgctcgacgcgaccgcgcgtcttgccgcagcgaccaccgacgcaatcgcaagcctgcatgaaaccaatccgctgcgcgacggcctgagcgcgtcgaatccgcagcgcttccgcgtggagcgtccgaagtcgagcttcgccgcatggtaccagttcttcccgcgttccgaaggcgcgtatttcgacgccgacggcaagatcgtgcagggcacgctgaagacggcgctgtccggcctcgaccgcgcgaaggccgaaggcttcgacatcgtgtacctgccgccgatcttcccgattggcgtgaccaaccgcaagggccgcaacaacacgctgattgccggaccgcacgatccgggctccccgttcggcatcggctccgagctgggcggccacgacaccgtcgacccgctgctcggcaccatggacgatttcaaggcgttctgcgcgcacgcgcatgagctggggctggaagtggcactcgacttcgcgctgcagtgctcgcctgaccacccgtgggtcaagcagcatccgaactggttccgcaccaagccggacggaacgatcgcattcgccgagaatccgccgaagaagtaccaggacatctatccgatcgatttcaacgccgacatggaaggcatcgaagcggaaaccgaacgcatcatggacctgtggatcaaggccggcgtgacgatcttccgcgtggacaacccgcataccaagccggtgcgtttctggcaggacgtgatcgccgccgtgacgaagaagcatccggagacgctgttcctggccgaggcgttcacccgtccgggcatgatgcgcgcgctgagctatgccggcttcacgcagtcgcactgctacttcccgtggcgcaacaccaaggaggagcttgaggagtatttggaggagaccaacggcgacggtggtttctaccagcacaacaccttctggccgtccacgccggacatcatgaccgcctacctgcgcgacaacggtatcgccggtcacgcggtgcgcgcggtgctcgccgcgatgggctctccgagctggggcatctacaacggctatgagctgatcgagaacaagcagcgtccgggattcgaagagcagatcgacaacgagaagtacgaagtcaaggtgcgcgattgggacgaggccgacaagtacggcatctccgagctgctcacctcgctcaacaaaatccgttccgagcatccggcatgccgcagctaccacaacctgcacgtcctgccgagcgacgatgcgggcgtggtggcgttcctgcgccagaccccggccgagcttaccggtaccggcaagccggatacggtgatcgtggtggtgaacctcgacggccacaacacgcaccagtccatcgtgcacatcgaactgcccgacttcggtttcgccaccgacaagccgctcaaggtgcgcgacgagctgaccggacgcgagttcgagtggagctgggacaactacgtctcgctggcaccgtgggccgacgtggcgcacgtgctgacggtggtcgaggactgagtgagtttgggtgctaggcactctgcctagcacccagccagcacaaaacacatagatcaagggcgggttgaagacgtttctcacgttttcaacccggctttgtgcactccgtaggtggtttttttgattccgtaggtgctctccggtcaatccacgcaaacagaatggctgaaatcaagcctttttgccgcagggataccagagccaaccacctacggaagagcaaaaccacctacggaattgttcttccaacgttccaaggcaggatagtcaatcacaatcggccaaaaagatgttgaccagcgagcgcatcacgccttatctccccagcactgagcaccattcatataggtatccggaaaatggtgccgacatggcgtgaaagcgggtatcctaagtaacgaactactgctgatcatatcgatcaaggagaaaacaatggcagaaaccttcaacgtcgtggtggagatcccgcgcggttccaagaacaagtacgaagtggaccacgagaccggtcgcgtgttcctggaccgcaccctgttcacctccatgggctacccggatgactacggctacatcgacggcaccctgggcgaggacggcgatccgctcgacgctctcgtcatgatcccgaactccgtgttcccgggctgcgtggtggaatgccgcgccgtcggcctgtaccacatggtcgacgaggccggcggagacgacaaggtgctgtgcgtgccggctgacgtccgcttcgacgacatcaaggatgtcgaagatgtttccgagtaccacaaggctgaaatcaagcacttcttcgagcagtacaaggctctggagccgggcaaggaagtcctgccgggcgattactggaccggtgccgctaaggccgaggaggaaatcgtcgcagcccgcaagcgcctcgctgatagcgagaagtgatcgcttctcccctttttatgtcaaagcccactgcccccgacagtgggctttttctcttttccagccagtggaggccaggtgccgttgcggggagtccaacggaccaaagcgtccgatttcttcgtaccgcggtatagtggtctcttgtaattttcggcatgcgaacagtattcgctgaattcaaagcccgcgggacaccatcgatccgcgtgcggcagttctgtgtcggtactcctaggcgtaggcggaacgcaatccgtcgaggcccatcccgtggggagaccggcgggatgaaccttttcaccagctatgctcattcagattctgctcattggcgtgtccgtgtccatggacgcgttcgctgtctccattggcaaaggcctgaccgtcaagaagcttcgcggcgtcgatgcgttcaaaaccgccctgtggttcggcggattccaggcgcttttccctctgctcggctatttcgcggccagcacgttcagcaaatacgtgaccgccgtggaccattggatcattttcggcctgctcgccctaatcggcggcaatatggtacgcgaggcgttcgaagaggacgaggagaacgccaaggaaacccctgaattcgattggaagcacatgctgccgctcgccgtggcctgcagcatcgacgcattcgcggtcggcgtgagcttcgcgttcatgacgctcaacatctggctgtcggtggtcatcatcggcatcaccaccggcctgttctccgccgccggcctgtatatcggccgcgcgttcggctcgcggtggcagaagcccgcgcagatcgccggcggcatcgtgctgattcttatcggcgtgaaggtgctgttcgagcatctcggattcctcggttgactgccaatccaacataataaaagcccgtaatcattgcgattacgggctttgtcattagaacagccgtttacagcacgacgatggcgagcgccgccagaccgactgcgagaccggtcagcatgaccggcagcagtgcgaggccgatccacggcgaacgcgcatccggctcggggtcggcgtcgcggtgccagaagtacgagcacacggtgagcgccacggccaccaataccgtcacgatcgcggcgacgacccatgtcgtggtcacgttgctgaacatgtccaccgtggctccggaggcagcggacatggcggcggccttggaatgcgttgtcggcaggagcaccggcaggaagcaccagcccgcgctggcgatcatggcgacgccttcgaccacgctgtgcgacagcgagcggatcaggtgcgtgcggttttcgcgggccatctgccggccgaaggatacgatgatcagcacgatcagcagtccgcccacgccggcgatccacgcttcctccatggagaagcttttgccgccatccaggccggcggggaagatcacattgcccagcatcacggtcgtggcgcagatcgccgacagcaggcctgcgatcgcggcgatcacatggccggcgacgccgtcgcggaacggactgaacaccaccagcagcacgaccatcgccagcgaggcgatgatcgtgaacggaaccgcggccggtttggcggcgtcgccgtacatcatgccgggaaccaatgcgagcgccaccagcaccacgtatgcgatgatctgaatcgccaggaccttggcaaaagcgactttccgcgtggcttcctgggcggtggccttctcagcggtcatctcggacccccttttcatattgtggtcattccgtatgcaatatgaataaatgtagccgtaagtgtccacatacttcggttacaatcgaggaaacgccgataacacataccgagtgtacaatcgcggcatcagttatagggaacatgagggagctgacgtgacggatcttacgcttatgacgttcgctagcgacccggccaccgttcttccctcgctggcgttgctgtcccaccgcgtgcgcgttctgccgatggatgcagcgagcttggtgaagatgccggagaacaccattctgtttcttgatgcgcgtgacgatttggccaccgcgaaaacgctgtgccgtctgattcacgcgtcgggactgtccacgccgattgtgctgattctcaccgagggtggtttcaccgtggtgaattcgcagtggggcatcgccgatgtggtggtggcctccgcttcccccgccgaagtggaggggcgtctgcgtctggtgtccgaacggggcaatgcgccggccagcacggccgctagcaccggcgagcagggcgtgcagaacgaggatggcctgatccgttccggcgatctggtggtggataccaacggttatacggccagcctgcatggccatccgatcgacttggcgtacaaggagttcgagctgctcaagtatctggtgcagcatccgggccgcgtgttcacgcgtgcgcagctgctgcaggaggtgtggggctacgactattacggcggcacccgcactgtggacgtgcatatccgtcgtctgcgcgccaagctgggtggcgagtacgagcatctcatcggcaccgtgcgcaacgtcggctatcgtttcgatccgccggaagaggatgagcatgaggccgcggccaaggatgcggctcacggcgaatccggcgaaagctgactttttcttgcgatcattccgttgatgttcgacgggttccgtttgttttcgttggcctttcgctgatttcccgttgttttttcgatggattttcgctgtttttgccgattgcgacgtttccgcaggtttcccgcgttcgtccgcatgcgaggggtaggctggaggcatgcctcgggaatcgaagaaggcgcggatcgcgcgcatgcatcaggaatacgagcagttgtgcgtggagattcccgatccgaaatgcgcgttgaacttcaattctcctttcgaactgctggtggctacggtgttgagcgcgcagaccaccgacaagcgcgtgaacatggtcacgccggaactgttcggcgaatatcccggtccggcggagcttgccgccgcgaatcccgagcacgtcgaggacatcatccgcaccatcggcttcttccgtacgaaagcgcgcaatatcatcgggctgtcgcatgagttgtgcgtgcgattcgggggcgaggtgccggccgatatggcttcgctggtcagcctgccgggcgtgggccgcaaaaccgcgaacgtggtgttgggcaacgcgttcggcgtgcccggttttcctgtggacacgcatgtgattcgtgtgactgggcgattgcggtggcggtccgactgggcgagcccctcccctgacccggtggccatcgaacgtgaggtcaccgcctgcttccctcccgaagaatggaccgatctgtctcaccgtttgatattgcatggccgtgccatctgccatgcgcgaaaaccggattgcgccgactgccccctcaacgacacgtgtccgggcgcgttcgccgcgtgattccgacgcatgccagccgccgcgccggtactccgtcgaatcgcacccggccatcgggcgtgtagcacgcgtcaactagactcgggtgcatggatgaaaacgggcggaaacgtaatctgaaagccgaggcgacgcgctggctgatcttcttcggcgtcgcgatcgtgctcagtgtgctgctgtggctgggactgtcgctgacaggccgcaagaatcccatcacatccttcggcacgctcgtctccgactcgtcggtgaccgtcggcatcgaaggcaatgcgccgaaatcgcttgacatccgcaccgaacaaggcaccgccgtgaagcaagcgctgctcggcaacgtatacgaaacgctggtgtcacgtagcgaaaccaacaagctgcagccgggaatcgccagctcctggcaggcttccgacgatggtctcacgtacacgttcacgttgaacggcggcatgacgttcgccaatgggcacaaactcgactcgtccgacgtggtctggtcgctgcagaacgccgtcaacaaccattacgcggaagccgaccagcttggtgatctgaaggaaatcaccaatcccaatgcgaatacggcggtcatcacgctcgccaagccgaatccgcggctgttgcgcgcgctggccggccgtgcaggcgtcgtgtacgacgcggaaagcaaaaccaactatgcgaaatcggcggtcggatcgggaccattcaccgtgtcaaccgcggaccaatcgcaaatcgtgctgcaacgcaacgactcgtattggggcaaaaaagccgcatcatcgcaagtgacgctctactactacgccaacgaggaatccatggccgatgccatgaaagccggcaaaatcagcatggcgctgccgctgagcgcttcaaccgcctcggaactgggcaaaaccaacggtattaccgcggacagcggcatcagcttcgacaaggtgatgctcgcgttcaacaacgacaacaacagccccttctccgacgagcagatccgcaagatgacgcgatacgccatcgatgcgaagaccatcgccaagaacgcgcccgacgcgtacgcgccgctgggagggccgatcagcccgctggaagacgggtatgaggacctgagcggcctgtacccctacaacctcgaacaggggcaacggatgcgcacgtatttcggagtgaactacatcgcgccaatcgacattctggtgccgaaggaatacgaaagcatcggcaacgacgtgaaaaccgccatcgaaaacctcaatatcaacaccaatctggaagtgctcgattccgccgcggacgtgacggaacgcatgaacgccggcacctataacatcgcgctgaccaccatgagcgacgaaggtgacgcaagcgtcttcgacaacggccagtccgtgttccatttcgagaacggcgacgcgcagcaggcttacgccaatgccatggccgcgaccaacgacaacgattatcaggcccgcatgcgcgattacgcgcgcgccgtcagcgaaaacgcggccagcgactggctgtacacacgcaagaactcccttgccgtttccgatgggctgcaggggtatccgaagaatctgaccgaccgtctgctgccgttgaacagattgacgctgcactgatttttccacggttttttatgtggattttccgcgatttgcctgcgattccggcattcggttcgataggcgctgatacgacggcagttgtcacattcgctttctagactagcgactatgactgaaagccaagataacaccatcaacgcgaacctcacgccgctgcccgacaaggtcggcgtggacggtctcgaagacaagtggcgcggagtctgggacgagagcggagtctacaagttccagggcacccgcgaccgtaaggccgtttattccatcgataccccgccgcccaccgtttcgggccacctgcacgtcggccacgtgttctcctacacgcacaccgatgtgatcgcacgtttcaagcgcatgaacggctacgacgtgttctacccgatgggctgggacgacaacggcctgccgaccgaacgccgtgtgcagaactattacggcgtgcgcgtggatacgtccctgaagtacgatccgaatttcgtgccgccgttcgagggtacggacggcaagaagatcgacgcgaaggaccaggtgccgatctcccgtaagaacttcatcgagctgtgcgagaagctcaccgcccaggacgaaaagcagttcgaggcgctgtggcgttccctcggcctgtccatcgactggtcgcagacctaccacaccatcggcgagcatccgcagcgcgtggcccagaaggcgttcctgcgcaacctggcccgtggcgaagcgtatcagaaggacgctccgggtctgtgggacgtgacgttccagaccgcggtggcccaggccgaactggaatcgcgcgaatatccgggcttctaccacaaggtggcgttccgtttcgaagacggcaccccgatctacatcgagaccacccgtccggaactgctggccgcctgcggcgcgctgatcgcgcatccggacgacgagcgttacaagcagtatttcggccagtacgtctactccccgctgttccatgtgaaggtgccgattctggcgcataaggcggcggaaatggacaagggcgccggcatcgccatgtgctgtacgttcggcgacgtgaccgacgtcgaatggtggcgcgatctgaacctgccgctgcgttccatcatccagcgcaacgggcgcatcgtcatggacaccccggattggatcgaagacgaggaaggcaagcgtatcttccaggagaccgcgggcaagaccacgttctccgcacgtaaggtcatcgtcgacgagctgcgcgctgccggcgatctggacggcgagccgaccccgaccaagcgtatgacgaacttctacgagaagggcgacaagccgctcgaaatcgtcacctcccgccagtggtacctgaagaacggcggcaccgacgagaagctgaacgccgagctcatcgcgcgcggcaaggagctgaacttccaccccgatttcatgcgcgtgcgctacgagaactgggtgcacggcctcaacggcgactggctgatctcccgccagcgcttcttcggcgttccgttcccgctgtggtacccggtgaaggaggatggcaccccggattacgatcatccgatcaccccgagcgaggaccgtctgccgatcgatccgaccgacgatgtgccggaaggctacaccgaggaccagcgtgacgtgccgggcggcttcaccgccgagccggacatcatggatacttgggccacctcgtcgctcaccccgcagatcgtgacccgctgggaggaaccgggcgaggagaaccaggcgatcttcaatgccaccttcccgatggatctgcgtccgcagggccaggacatcatccgcacttggctgttctccaccatggatcgcgcgcatctcgagaacaagtgcctgccgtggtccaacaccacgctgtcgggctggatcctcgatccggaccacaagaagatgtcgaagtccaagggcaacgtggtcgtgccggacaagccgatcaagcagttcggcgccgacgcggtgcgttactgggccgccgccgcccgtctgggtctggatgccacgtacgacgaaggccagatgaagatcggccgccgtcttgccatcaagctgctcaacgccaccaagttcgctctggccatcggacgtgaggacgagaaccatcacgtgggcgctccggcagtcgccgcatggaacccggccgacgtgaccgagccgatcgaccgttccgcgatgtccaagatggccgccgtggtccgcgaagccaccgacgatctcaacaactacgagcattccaaggctctggaagtcatcgagaactacttctggcagttctgcgacgactacatcgagctggtcaagaaccgtgcttatggcaccgccgattccaccggcaacgtgccgagcgaggccgcggtgaagtccgcacgcaccacgctgggcctgggtcttgatgcgttcgcgcgcctgctggccccgtacctgccgtatgccaccgaagaggtgtggagctggatgcatgagggcgaaggctccgtgcaccgcgcagcatggcctgtggccgacgtgtacgcggccgccgccggcgacgcatccgccgatctgcttgctcatgccggtgaggctctggccgcgctgcgtggcatcaagtcgaaggccaaggtttcgatgaagaccccgatcttgtctgtgacgcttgccgttgccaacgatgtgcgcgggtccatcgaggccgcgctgggcgatatcgccgaagctggtcgcgtgaccggaccaatcgccttcaccgcaccggctgccgccgagggtgaggacgaggccgccgatgtgacggtcgccgaaagcgagctaggcgaaccgccggccaagaaaccgaagaagtgagtctctgaggtgagccgccagcggcttttgtagcgcagccgctcacttcacccacatacgaagggcctttcctttgtatgaaggagaggcccctcgtatatcccgtcactgtctgcaactaaccgtgcccccttttgctcatattcagtcaaaatcgcgggaaaaatgctttcgtgagcgaaaaggggtataaatcgcaggcaaaacggtcgaaatcatatccccttttgctcacgcccgtgcagaatcgccctaaatcgcaagacgtgcgcgcatagaaccgtccttatcccgttctcggctgttctcagcgtacattcctgcccctgcgcacaaacccgtacgcgaaaaatggtttttatgggcgtaatctcaacgaaggcacaagcggaggcggaaatcgcaatcaaaaaccccgaaacgtaccacgtaagcgacggagcactatcggatttagcgcatcgcacaaaccgcgtgctctacagcaccggaacggacaggaggtactgcgggccagcggacgaatttccggaaccgttcccacccaatccagcctgcagcgcatcgtcgaaaacttccgcagcggcggccaattcgaccgtctcgtcaatcaaatcgccattatccggcgtgaaaccggttttcgtcaagccatagccggcaaccggcaacgaactggacatcgaatcggcggaagaagaggaatcggaaccgctgttcttcgaagagccgtccactcccccgactttcgccacattcttcgacgtggtgtccgctgcggcgccgaacgacgggcgtagtccgcccgcgtagctcatcacatcatccatgctgatggcgttcttgtcatcgaccaagctggtcgaatcggcggtgttgttcttcgcctgcgcgcgttcggccttgcgttgcgcacgggaccgccgtttctcggctttcgcgcacaacgattggctggcggaggcggaacgcaacgtgtccagcacagaagcgtcatcggcagcgcccgattcggacgtgtcgtcatccgaatccagctggtcggcgaatcgcagcacgatctggtggaatgcgctggcctgtccggtgtgctcgctggcgtccgccaacgcggtcatcgccgcggacaccttgtcggacgcggttttgagcttctcattgtctttgatgccggcacgcacgtcggcgatcgcctgggtttcgtagctgccagccgtgcctgcggtggcgcccagttccttaagccgagccgtgtatgcgtcggtgaaatccatcgaatacgggatcatggccgcggacagctgcgattggccggcactgtagtctttggagccgcgctgttgttcctcaccggcgcgcttggtgagctcgttcaccaagccggatgtgccacgctgttcgatggtgcgaatcacctcgtcgacggcgtcggccgcgccgatatgccggtatgcggcgctcacgtcgttgacggcgttggccaggtctgccacggatttagctacggaggtatcgccgttcagttcggacgcggtgccgagaatggcgggaagctgtgtggcgttgccgatcgaaccggacagatgcgtggtgtatgagcccacgtacgcgtcgatgtagccgtcgaacgcctgatcgtgcgctttggaacgtacggcgatggtctgtttggcaagcgctttctcgttgtctctgagctgttccagttgggcgatgagcttgcggttgcgttgcgagccgacgttggtcagaccgtccaccaaggtggttgcgcgcttggtcaggtcaggcagtgattgctgaacgttgccttccaccgcggcgatggacagtgagctcatggtgaagtgcttcgccgtcacgtaggcgttgaaggtcaggtcctcgcccggtttgccgaccgcagccaccagggtcgaggtgttgtcggatgagacgagcacgccgtcatcggcggtcacgtcactgccgacgcgtccgggaatggtgaaggcgacgattggcgtcagattggcggtcacgtcgggtttcgtggcatgcagggcgatgcgtatgccgatcatgccggaagcgccggaaacgtcggaaacgcttacgtcgggcccgttgagggtgaaggaggcggatattttccacggcaatgcgacaacgcctttgggaacgcgtttcgacgtggaggatccgctgttggtcaggaaaaggcggcctggtttgtcgatggaggtgtaggcgctcatcacgtcatcatgcgatgcatcggccgcgtactgcccattctgttgcaaggccgatatcgcgtcgttcacgccgactgccgcgacgggagcggcggtgatgacggcgaccgcgatcgccgcggcaagcgggcgtcgggcaccggatggacggttcgcggtggcgtggcgcatgccggacctctcaatcgcaatcgaaacaactttccaaggcatttaatgtagtgcccggcatgcccgtcggcaatggacgttcgcgcggggagcgcggaaaacggacggctcaggcgaaaacgtcgagtacgcccgggtctcccccgttttcggcgatgcgcttgtggcggcgcttggcctcggtcaccacgaattcgcggtacatttcggcgatttccggatccagtccggcttcgtcggcaatgcgatgcagacgctcgatctgggcatgttcacgctggtaatcggccggcgcgaagcccgcacgcgccttgagcacacccacctgcgacgtgtatttgaaccgttccgccagcagcgagacgatggcagtgtcgacgttgtctatcgattggcgcagcgaggcgattttagccaccacatcggccacttcggggttgttctgcgcggtgcgcgcgtcgatgatggtttcggattcggtttcttcttctggccgaagccagtcatgttcgctgtcgctcatgggtataagcctaccgcgcaccctaccgcggcatctgccgaacagcggtcacttcgcgaagtaacgctgcagcacgatggtggtttcggtgctgaccgacaccgtgcgatggatgaggttcaacagctcttcgagcttgctgggcgattcgacgcgaacggtgagcatgaagctgggcgaaccggcgacggaatcgcaggacatgatgccgtcgatgtttttgagcttgtctggaatctcggcttcctgggagtaatcgatgggcgtgaccgcgatgtaggcgttcaccgcaaggccgcggcgctcgtcgtcgataaccgccttgtagccgcggatcacgccgcgacgctcaagcttctgcacgcgcgactgcacggcggacacggacaggcctgtcgcctcggaaaggtgggacagcgtggctcggccatccttttcaagcatgtcgaggattacgccatcggtcgcgtcgagctggctcgcaaccgtacgtgcgtctaccggaccattgtcactgttggtcattcataccccttttccaacaatccactgcaccggccgcaatcgaccgtccccactgcagttccatgttctttttcttccttaccatacccactaccgcgcacataccgtcgcggaatcgccgcagtttatccggacggcgcaacgctgtcatgaaatatctttgttttatttagctcatacccccatatcgaccatatatattttccccatttatcttttctcgtcgtatttttacctattttttaattgacaacgttgtccaagaagtggtcaatttcacgaaattcgtcgaaacgtacgcataggaaaggggctacacggcgattgccatgcagcccctcaaaccttcagattcgcttgcagccgacgactcagttgccgttggtggcgttgccgctctgctggatgagcgacgccatgaaatcgcggttggtcgctgtcttcttcaggcgtggcacgagcgtctggtaggcctgttccggctcgaggccgcccagcaggcgacgcagacggtagatgatcggcagttcctgaggatcggtgatgagctcctcgcggcgggtgccggaggcgttcacatcgatggccgggaacaggcgcttgtcggcgagctcacggctcaggcgcaattccatgttgccggtgcccttgaattcctcgaagatcacctcgtccatcttggaaccggtttccaccagcgcggaggagatgatggtcagggagccgccgttttcgatgttgcgggcggcgccgaagaacttcttcggcgggtacagcgcctgcgcgtccacaccaccggacaggatgcggccggaggccggcgcggcgatgttgtaggcgcgggccagacgggtcatggagtcgagcagcaccaccacgtcctggccgagctccacgagacgcttggcgcgttcgatggccagttcggcgacggtggtgtggtcggaggccggacggtcgaaggtggaggagatgacctcgccctgcaccgtgcgttccatgtcggtgacttcctccggacgttcgtccacgaggacgaccatcaggtggacttccggattgttggtggcgatcgcgttggcgatgttctgcagggtgatggtcttgccggccttcggcggggacacgatcaggccacgctggcccttgccaatcggcgccacgatgtcgatgaggcggccggtgagcttgttcggcgtggtctcctgcttcaggcgttcctgcggatacagcggggtgagcttgctgaactgcggacgatgctgcgcttcctcgacgctcatgccgttgatggagtcgatggactgcagcggcacgaacttctgacgctggttgcgacgttcgccttcacgcggggcgcggatggagccgtgcacggcgtcgcccttgcgcaggccgtacttcttgacctggcccatggagacatacacgtcgttcggtcccggcaggtagccggacgtacgcacgaacgcgtaggagtcgagcacgtcgacgatgccggcgaccggcacgaggtcttccttcggctcgtcgcgatgctggtcgcggtcggcgcgatccatacgatcgttgcgctggtcgcggtcggcgttgcggtccatgcggtcggcgcgatcgttacggtcgttgcgatcattgcgatcgcccctgccgcgacgctcgtcacgctcgtcgtaatcgcggtcacggccacgcatacggcggccacggcgatcgttgcgtccacggctgtgacggtattcgttgtcttcggtctcgtcgcgacgcttatcatcgtcggcgtcttcctgcgacggcagcgtggcgaggatgtcgtcaaggtcgcgcacgacgtcttcgctcttcggcccgtccgccacgcgacggcggcgacgcggctcgaaatcgtccctacggtcgtcatcacgacggcgacggcggtcatcctgcttcggagcggcatcgtcaaggcccagttcggcgagcaggtcggcgccggcttcggcgtcacgatggcgacgacgcttcggcgcttcatcgttcggcttcaacgcgtccaccgctgccacggcatccgcgacttcggaggattccgcggacttggcctgcttggcacggacggggcgttcctcctgcttggcttcatcggccttcttgtcctttgccgatttgacctcagcgtctgcggcgggagcggactttggcgcgcgcacggtgacgccggccggagcctggccgccggaacgggcggcttgaagtgttgcgatcagttcggtcttgcgcatggtggagacaccacgaagtcccatctgcttggcgagctccttgagctcgggcagtttcatatcatcgagattagggcttgttgccactggtagttgcctttccttggcttccacaggcatgcgcccgcgacagctgtaaaaaagaattgcggaaaatttccgtcgaatgaaaagtccgccgcgaaacatcgcggttttcgaactgtcctaaccatacaacgcaacccagaccaacgcaaagcgagcacgcgcggtccgcccgtgcggttcgcgcaccgcgcaatcgcaataaaaatcgcaatgaaaaagcccatgccaaaaagcatgggcttgatcaaagttacgctgcgaaaaataaataacgcgcgcgaagacgcccgtctgaggccgaaggcgtacaaaggtacgtcgagcgccggagaaagggcgtatgcgcacgcgttatttatttttctacttttcttcgtggtaggacttgtcagtgttgaccgaccacacgttgtctttcgacgtttcgccgctcttgatgtccttgacggcttcgatggcggtggccatggagtggtccatgttgttgtaacggtgctgtccgttacggccaacgcagtacaggttgccgaaggagtcgaggtagtcgacgagttcgggcatgcggtcgtaggtgtcgaagtaggccgggtaagccttcttgacgcgttcgcggtgggagtcgagcacgtcctgcgggccgttgatgacctgcatgcgggtgagctcctggatggcgaacttggtggcttcctcgtcggtcatgttccagaaggagtcgccttcctcgcagaagtattcgaggccgatccacacggtgttgtcgacgtccttgaccaggtacgggctccagttgttgaagatctgcagacggccgaccttgtagcccggatcctgcacataaatccagcaatccggcacgatcggcgggttgccgagggtcggaatgtcggtggtgttggtcaggcgcaggtgcttgacgagcaggccgacggtgacgaagtcgcggtacggcaggccgttggcgatttcggtcatgtccttcggagccggctggtcggaggcgtccacagcgttgacaaggtccttgaccggcatggaggaaatgaagtcgtccgcggccatttcggtgcggttgccttcggaatcctcgtacacgacggatgcgatcttgccgtccttctggcgaatttccaccacattggcgtcggtgatgaccttcacgccggcggcttcgcagttggattcgacggtttcccacagctggcccgggccgagcttcggataccagaattcctcgatgagggaggtttcgacttcggagttgtcgcgcttcttcggcaggagcttctggaaggcgttcttcagcacgcccatgatgctcaggcccttgacgcgctgcgcaccccagtcggcggagatttcggacgggtgacggccccacagcttctcggtgtagccctcgaagaacatggagtagagcttacggccgaaacggttgatgtagaagttctccaggttggtttccggcagcttgtgcaccatggacttcaggtagctgaagccggcgaccatggtgagcttgaagcccatggccttcagggtgttggcgctcagggaaatcgggtagtcgaggaagtggcggttccagtagatgcgggacacgcggtggcgcttgagcatcaccttgtcttcgatttccggatccgggccgcccggctccatatcatgctcgcggtggagcttcttgtcatcatagctgggtgcgccctgcagcggcagaacgtccttccaccagtccatgatgcggtcgtccttcgagaagaagcggtggccgccgatatccatacgattgccgtcatgcttgacggtgcgggagatgccgccgaattcgcgggtggcttccagcacggtcacgtcgtactgttcggagccaccgtccttgacgagctcccaagcggcagtcaggccggcagggccgccaccgatgatgaccacggattgcttttgcgtcactttgaagtctccttacaaacaaaatcgaagatattctacccgaaggtagggaaacgcacagcgcacctgtgcgcatgcacacaaaatcaccgccaagtccgacagcaatcgccctgatagaaggaaaaccagccgtacggcttccgccgaagactggttttccgtaggtctgctacatgctgtcgggaatgtcgatgtcggttttctgcacttcctcgacgttcacgtccttgaacgtgacgatgcgcacgttcttgacgaaacggctggaacggtagacgtcccacacccacgcgtcggtcagccgcacgtcgaagtagacgtcctggccggcggaacgcacgttgaaatcgaccttgttggccagatagaagcggcgctcggtctccacaacgtaggtgaacagtttgatgacgtcgcggtattccttgtatagggacagctcggcgtcggtttcgtagttgtcgaggtcctcggcgctcatcgtctgccttccgtgtcgcgcttgcggccacgtccaagcgtgcgccaccaagcatccttcgaggttttgcgctcatccgagctgtacggccagttgttgtcggcatcgccggccttctggtccgtcttcgccgttccggatgcttcgttcggctgcgattcctgcgatggcgcggcagacgtctcgtcggcggaggtctgcgccgtgtctccactctggcctgccgctgcggcatcgtccgcatcgcccttatgtacggagttgagttggatggcgatcgagtgttcgcgggcgctcaacgcctccttgacgcccggattgtcttcgatcacgtgcatgccgaacgcgtcgagcgagcggatcgggtcgaattcgtcgacgagcgtgtccatgacgatgaggtcctggtaacggttctccgacgcgttccacagggcatcgcgcgaacggccggacggcacgaagccgagcgactggtagacggatacggaacgcgtgttctgttccggcacggccacccaaatgcggtgcatgccgaggcccgccggttccggcgcgaagccgtacgtcatcacgcggggcatgatgtctcgcgagtagccgcggccgcggtagtccttgccgagcaccacttggatgcgggcggaacgtgcccagccgtcgatgtcgatgaggaagatcatgccgatcacgttgtcggaagaggcctcgtcaagctcgccgtcgccgtcatggtcggcttcggtgacgatggaccatgcgatggtacgacgagattccggatcccccacgccggattcgttcgatttttcgccattggaccatgccacggaacgacgcacccacgcgttcacagcgccacgttcggccacgcggtccttgccggtgatgccggatgcgccgacgtacgcctcaatgacctccatgcgtgcgatgtcgtcgatggtagcggggcgcaagtgcaccatctcgcccttgatgggcggaatgacgatgcgttccggcagctccctcgcccgctggtccgtcgtctgttccttcgctgtggtttcagcgtactctgacatgattatcgttccctatgtttctcggcgcggtccctcgccgcacccataccgacggtattgtacccgactgaacgccagctgggagttttgttaggcaaaatccccgtgaaaactcccccagccgacgcgtgaatcgtacgaaaaggcatgtaaaagcagataaaaagcaacaaaatgcagaaaggcgtgcgtttttacgattcctctcatcgcaaaaacgcacgcctttcgatgccatcaatcaggcaacgttcggcaatcgccggaatgtcacttgatcttgcccatcacgatcttggtgacggccttcgcgtcggcctggccgcgggtggcgcgcatgacggcgccgataatcgcgcccatcggcttcatgttgccgctcttgagcttctcgacgatgtccgggttggccgcgagtgcctcgtcgacggccttttcgagcgcgccgtcgtcggaaacgacctggaagccgtgcttcttgacgacctcgttcggagtgccgtcgccggcgagcacgcctgcgacggtctgcttggcgagcttgtcgttgagcttgccgtcggcgatgagcttctcgacctcggcgacgtcggccggggtgatcggcagctcttcaaggctcacgcccttgttgttggcttcgcgggacagctcgcccagccaccacttcttggcgcccgaggcggaagcgccggccttgacggtgtcctcgagcaggtccagagcgtcggcgttgagcacgtcgcgcatctccagatcgttgaagccccactcgcccttcaggcggttgcggcgctcacgaggcatttccggcatctgggccttcatctcctcgatgtgctccttggtgatgtgcagcatcaccagatccggatccgggaagtagcggtagtcgtcggcgtcggacttcacgcggccgccggcggtggtctgcgaggcctcgtcccagtgacgggtctcctgcagaatctcgccgccttcggaaaggatggcggcctggcggcggatctcgtactggatggtcttctcgatgccacggaacgagttcacgttcttggtttcggaacgggtgccgaacggatcggacgggctgttgcgcagcgacacgttcacgtcggcgcgcatgttgccctgctccatgcgggcatgggagatgttcagcgcacgcacgatgtcgcggatggcgcgcatgtaggcgcctgcgatttcgggggcgcggtctcctgcgccttcgatcggcttggtcacgatttcgatcagcggcacgccggcgcggttgtagtcgaccagcgagtggtcggcgccttcgatacgtccgtcagcgccaccgacgtgggtgttcttgccggcgtcgtcttcgatgtgggcgcgctcgatcggcacacggaagatggtgccgtcctcaagctccacgtcgaggtagccgttgccgttggtcggcttgtcatactgcgagatctggtaatcgcgcggcatgtccgggtagaagtagttcttacgggcgaactggctccattcggcgatttcgcagtgcagggcgagacccagcttgatcgcgtaatcgacggcggtcttgttgaccaccggcagggagcccggcaggccgaggctcaccggggtgagctgggtgttcggctcgccgccgaagtggacttcggccgggcagaacagcttcgtggtggtggacagctccacgtgggtttccagaccgatgaccgggtcgaacttcttgacggcatcggcgtacttcatcaacttttcagccattttgttttctttcctccgatgcttcctacttgtccagtccgtcgagccacggggtcttcagggactgccagaccgggccgttccagctttcctcgagggccgcttcgagagcggcggcgggcttgtacatgacctcgtcgcgctgctgcggggcgaggaactggaagccgaccggcaggccgtcgtcgctcaggccggccgggatgctcattgccggcacgccggcgaggttggccggaatggtggtgatgtcgatggcgtacatggccatcgggtcctcggtcttctcgccgaacttgaaggcggtgaccgggctggtcgggccgacgagcacgtcgaccttttcgaaggccttcttgaagtcgtcgatgatcagggtgcggactttctgcgcggagccgtaccaggcatcgtagtagccggcggacagggcgtaggtgccgaggatgatacgacgcttgacttcgtcgccgaagccggcctcacgggtgtaggccatcatgttggcggcggtctgcggaacgcctgccggcggcatgacgcgcaggccgtagcgcatgccatcgtaacgggccaggttggagctgacctcggacggcatgatgatgtagtaggcgccgagggagtacggcaggtgcggcagggacacttcgatgacctccgcgcccatctcctcaagcttcttgacgccttcgttgaagcgggccatgacgcccggctggaagccttcgccgccgagctccttgatcaggccgaccttgagtcccttcagatcgcgcttcatgccttcgcgggcggcggcgaccatcggacgcgggccttccggaatggaggtggaatcgcgcttgtcgtgtccgccgatcacttcctgcagcagggccgagtcgagcaccgtacgggagcacgggccgatctggtcgagcgaggaggccatggcgatcgcgccgaaacgggagacgccgccgtaggtcggcttgacgccgacggtaccggtcagcgaacccggctggcggatggagccgccggtgtcggtgcccagggcgagcggagcttcgaatgcggccactgcggctgcggaaccgccgccggaaccgcccggcacgcgctcggtatcccacggattgtgggtggtctggtaggcggagtgctcggtggaggagccttgcgcgaattcatcgaggttggtcttgcccaacagcggcatgcccgcggccttgagcttctcgatgacggtggcgtcgtacggcggcacccagccttcgaggatcttggatgcggcggtggtttcgatgcccttggtgacgatcatgtccttgatggcgatcggcacgccggcgagctccggcagctgcgccttgtcctcatcggacttggcgtcgaaagcgtcggcctgctcgagggcctgatcggcggagaccttcaggaaggccttgacactcggctcggccgcttcgatgacggcgaggtgggcttcgaccagctcacggctggaaacttccttggccttgatcttggccgccatctcggcggcggaaagcttgacgagttcggtggtgctcatatcactcctgtcccagaatgcgcggtgcgacgaacatgccggcctcggagaccggggcgcctgcggtggcttcggcctgggtcagcggggtctcggggacgtccggacgcaggtaggcttccagcgggaccgggttcgcagtcggttccacgtcgtcggtggcgacttcctggaccttgttgatggattcggcgatgacgttcagatcgccctgcagacgggtgatttcctcgtccgtgagtgcgattcgggccagatcgcccaaatgcacgatttcttctttggtgaaagtaggcatgaccctaacagtaacgcgtctgtgtgacgagcgtgtgccctatttcgtgccccgttcgcaacccggccgcgactggccgccatccgttcgacggccgttccgtcgcctggtcggcgagcacgcatccgctattgcggcaaagcgacgcttaacggcttttcttgccgcgtgccgatggcgcgatcaggcttgcggcgcggcgtgctgggcgatccaggcgtgcatggagaccgcggcggcggcgccggcgttgatggaacggaccgagccgaattgggagatgtagaccacgtcatcggccagttcgagcgctttttcggacaggcccgggccttccgcgccgaaaagcatgaggcagcgttcggggaaatggtaggtttccatgggcaccgcgccgggaatgatgtcgagcgcgatgacgcgggcggcttgcagttctgctattttcgcgtccaaggcttccagttgggccatggtttcgcttgtgttcggggcagtgccggaagcgccgtccgtcgcggctgcggagccacgcatatggaaggcgatggcggcggcttgcgattgggcggcggcgatttcgccggcgatgcgcagtttccaacattcgacaagttccgttatggatggatggttttcgacgtgctggtacagctccgtcatgagcgcgcccttgcgattccatttgtgcgggccgacgatgtgcacgcggcgcgcttggaacgcgttggcggtgcgcaccatggagccgatgttgaaatcgtgggtccagttctccacggcgacttcgaaatcgtggcgcccgcgggagtccaggtcggctttgatggccgcgaccgtccagtagcggtagcggtcgagcacgttgcggcggtcgccttcgtcgagcagggtggagtcgaagcggatgtcgtaattgggggatgacgcatcgtccgggcgtggttcgcctggatgggtttgcgaccacggtcctacgccgacctcgcggaacgtcggttcgccggatgcctgtgcggcaacatcgatgggattgggatcgtgcacgttctccccttcataggaacagcaatacaaatatgtcaaaggcccgcgcatccgtatgcatcatcatgcttgtcatcgcacattcgacgacgtcaacggcagatatgtttgcggtcggtcggcgggaaactcggtgttcagtggagttcggattccttgaacacttcgacgaacggcagttcggattcctccgaagtgaccgggttgatgaccttgatggtcgggtcgaccatgtcgacaccgccgatcagcgaggtaacggccagcactttggcgccttcgttctccaccacggagaagtcgaggctcagctcgttgccgttgcgcagggtgaccagcgatgaggtctgcacatacgatttttcagacagccaggagtcgatcagcaccacgcgtttgccggcaatcgacggacccttgatggacggatagacgaagtccatgacgaaaccgtccaaatcctcaccacgggaggcggcggcctggatcatggcggagaccagcggcacggccgcggcggtcaatgcgccgaccgcgtcgaaatcgtcgacggaatagccggcttcctccaacgtgtcgagcaggatatggccgacgatggaggctccacgatggtcgaacagcacggaggagagttccgagaaaggcttgtccttcatttcggcctgcagcagcgtcttgagctggtcgcgaggttcgagcatggcgaaatcgacggtggattccgtcgaagcggaaacagactggcccgcagcggaatcatgcgtcggaaccggtgtcgtcttgcggaaagtgttctcttcggtcatggttccagcctatcctttcggctcgtcattcaccgcgcggtatgggtgatttatgagcgataaacatggtcattcggcgttggtctcgggagcggacaactcacggatatcccctttttcgggcgcgatcatgtcgacggtgccgatgaccttgctctggtcgacgcgttgcagtttgcgcgcggtgaccagcacgcgcgattcgagcgacgcggcgaacgagttgtatgcgccgaccgttttggtgatggcggaacccagtttggtggcccgctcccccaatactgcaaaccgttcgtacagctctcgggacaggtcgaacagcattttcgcgtcatcggtcaggctttgctgctgccatgcgtatgccacggatttgagcaccgcccatagggtgatcggcgaggtcagcgcgactttctgcgcgaatgcgtcgtccatcagtgtcgggtcggtttccaatgcggcctgcagcaacgattcgttggggatgaacgcgatcacgaaatccggagcatcgctgaacgcgttccaataggctttgtctcccagggtcttcacatggtctcgtaccgctttggcatgggaatgcagcagctcgttcttgcgggccagttcctccggtgaggcggtgtctggaatctcgcatgcgcgctggtagtcggcgtatggcgctttcgcgtcgatcggaatggttttgccgcccggcatgtgaatgaccatgtccggccgctgcgtacgcccctcggcatcggtgaccaccacttgggtatcgaaatcgacatgttccagcagaccggccgattccacgatgttgcgcaactgtgcttcgccccacgcgccacgcaccttgttgttgcgcaaagcagacgacagggcgctcgtctcacggtccaatcgcgcctgctgttcaccaaggcccttgagctgctcgccgagcgcacccatctcatgcttgcgcccctcttcaatctgcgcgaccttcgcctgcaacgcgtcaaggttcttctgcacaggagccaacgcggacagcactttgctttgctcctgcagcttcttctcgccttcggcctgccgacgttccgcctcctcggcggctcgccgccgctcacgttccacacgcaattcctcggcacgttgagcttgcaccaattgcgatttgagatacgtcagctgctggccgagcccttccgcctgcgtacggtactgcaccaccgccgcgttaagttcgctgataccctgacgatccgcctcgatctgcgccttcgcctcgttcaggtcggattccttcgcgccacgggccatatcctgccctttggcacggcccgcgaaaaagcccgcagccgctccgagcgcggccacgatcaccagcaatatcactacaaacacaggattatcgaacatacgttcgatggtatcacgtcgttaggaacacatcaatccacgcatccacattcattcgcaagaccgaccgcatgccacacaaccgtgcactatgctgaaatcagccgaacgcgaaatgcatcagcccaacacgaagggacattatgggattcgatctgtttttggcggccgtgtcgattgtggccgcatccatcgccacctgggcgttgttgcggctgtttccaagctcggacgcacgccaggcgattccgctgcggacggacggcggatttgccgacccatcccacacaaccgacggcggagtgacgatagacggcaaagtgacggcagacggcgaatcggcatccgacatcgacggacaacccaccgaccacctcggcaagcgcctcgtcatcgcgcttatcctgaccattccaacgttcgtcatcacattactggcgctggccaaaatcgccatgccgggatggctgacgaatccgtggccgcacgccatcgtcatcacgccggtcatgttctattgcgcggcgccgattcaccaccgcggcctgcccgcattgcagcggcgacgtccaaacggcgattcgctggtttcgcttggcatggcgattgtttacgcgtacagcctgctgctgtgcgtggtgtcgtggattttcccggccggctcgcgcgatccgtatttcgcgttcgtcggcgtggtcgcgacgctttcgctggctggcacgcttgtccggcaacacgcgatgaccgcgcagcagacggcagaaacagaaaaggcgcaatcggcacagtcaacagaatcaacagaatcggcgcgatctcaagcgaaatcccctgagccaacgcaagaaaaaagcgcggaagaattactcttccgcgctgtggtaggtcatgcgatccgcgcacgtgtgctgcagatcaccacgtcggtgacgatggtggtcgcggtgtggacgtgcgcgttgtggctggcgttcggcatgcaaccgaagctggcgatcgccatactgctcggttcgaccgtgctgtcggtcgcaggcctggtattgcaggcttacgaccgacaagtaaccaatcgataatcgtcactcagccgggttcgggacgtcggcggaatcgtccgtcttctcctcgcccatatcctccagctggtccgcggcccacgcggacagctccaggtggtcgccgccggtctggtccaccagcacggtgtcgccgtcgtgcacttcgccggccagcagcatgcgggcaagctggtcgccgacttcggtctgcaccaggcgacgcagcggacgtgcgccgtacgccggatcgtaaccggtgttggcaagccattcgcgcgccgaatcggtcacgtcgagcgtgatgcggcggtcggtcagacgtgcggacacctgcgcgacctggatgtccacgatgccgccgagctcctcgcgggtcagcgggtggaacatgaccagttcgtccagacggttgatgaattccggcttgaactgcatgtgcacggcgtccatcacggccttcttcttggcgtccgcgtccatgtcgggattgacgaggaactgcgagcccaggttggaggtcatgatcagaatcgtgttcttgaagtccacggtcctgccctggccgtcggtcaggcgaccgtcgtcaagcacctgcagcagcacgtcgaagacttccggattggccttctccacctcgtcgaacagcaccaccgaatacggacggcgacgcacggcttcggtaagctggccaccctcttcgtagccgatgtagcccggcgcggcgccgatcaggcgggacacggaggccttctccatgtattcgctcatgtcgatgcgcaccatggccttctcgtcatcgaacaggaagtcggcgagcgccttggcgagttcggtcttgcccacgccggtggggccgaggaacaggaacgagccggtcggacggttcgggtcggagatgccggcacgcgagcgacgcacggcgtcggaaaccgcttggatggcttccttctggccgatcacgcgcttgccgaggtactcctccatgtgcaggagcttctcgttttcgccctgcataagacggcccacggggatgccggtccagtcggagacgatttcggcgatggagtcggcgtcgacgcggtcggggaccatcggcacgtcggcgttggcattgtcggctccgcccgattccgcctcgttcttctcggcttgggcgatttccttctggatggccgggatttcgccgtagttgatggctgacgatttcgccaggtcgccttcgcgctcgtacttttcggcttgcgtacgcagctcgtcgagcttcttgcgcaggtcgccgatacggttgtggccgttcttttcggcgtcccaacgcgctttcagcccgttgagcttttcgcttttgtcggcgatttcctggttcaaatcggcgagacggtccttggcgctgtcgtccagttccgcttcggccttttccgcggccttgtcgttcttcggattgcccagcaggtacgacttctccatcttgagacggtccacctggcggcgcagttcgtcgatttcctcaggcgaggagtcgagttccatgcgcaggtgcgctgcggcctcgtccaccagatcgatggccttgtccggcagctggcgtccggaaatgtagcggttcgacagggttgccgccgcgaccagcgcgtcgtcgccgatggtcaccttgtggtgggcctcatacttcggcgcgatgccgcgcaggatggcgacggtgtcctccacgctcggctcgccgacgaacacctgctggaaacgacgttcgagcgccggatccttttcgatgttctcacggtattcgtccagtgtggtggcgccgatcaggcgcagttcgccacgggccagcatgggcttgagcatattgcccgcgtccatggagccttcggccgcgcccgcgccgacgatggtgtggatctcgtcgatgaaggtgatgatctgcccgtcggccttcttgatctcctcaagcacgctcttcagacgttcctcgaattcgccacggtacttggaaccagccaccatggagcccaggtcaagcgagataagcttcttgttctgcagggtggtcggcacgtcgccggcgacgatgcgctgcgccaggccttcgacgacggcggttttgccgacgccaggctcgccgatcagcacaggattgttcttggtacggcgggacaggatctggatgacgcggcggatttcctggtcgcggccgatcaccgggtcgagcttgccttccttcgcggcggccgtcaaatcggtggagtacttctccaaagctttatacgagccttccgcgtcggcgctggtcaccttgcggtcgctgccgcgcgcggcggtcagggcgttacgcagcttatccgcggtaagaccgttcttttccaagatgtccgcgctttgattcggtttcgcggccgcgattgcgaccagcatgaggtcgacggtgacgtactcgtctcccctccgttgcatttctttttcggcttgcgatagcaccgccgacagctgcctgctgacgtccggctgcgttgtggtcgatccgctggcgctcggcagcgattgcatcgcccgatgcacttcggcgctcacgttttgcgcgttgccgcctgccgcttcgatgagcgcgcgggccatgctgttttcctgacgcagcatcgcgtccagcaggtgcagggtgtctacctgcggattgcccagcgccgccgcgttctgaacggcgtccgaaagcgcttcctgcgccatctgcgtgaacttctgttccatatcatcctccatggttcgcgcccggccgcccggccttcgctaccgggccggcgttcggacgcatatgtcgttgtctgatatgctcaaccgacttcatcgccattatattcccaaaacttgagtcccacacactcaactttttgcgtttctcaaaaccgtctttcgacacaggacggcagtcaccgacaatcaccagcgctcaccggcaatcgcaatacatacgaaaaaggcgggcagcaacgtaacgaaatcacgaaacgttgcaaacccgcctaatccaaagtccgccagcaagccgaaaatcagccgcgcaccaccacgttgcgcagatcgccgatgccctcgacgtgcacgatcgcctcgtcacccggatccagatgacccgacgcgttcggcgtacccgtcataatcacatcgcccggcagcagcgtggtgaaactcgtaatcgccgcgatctgctcaggaatgccgtgaatcagattcgccgtggtacccgacgccatcggcacatcctcaccgttgagcgtgaaggaaatcttcgcatccttccaatccacatcgtcacgcgtcacaatccacggacccaacgggcacgccgtatcaaaacccttcgcgcgcgtccacgtcggatcaagaccctgcagatcacgcaacgtcacatcattcacgcacgtgaaacccagcacataatccatggcctgctccaccggcacattcttggcgatacgacccatcaccacagccaactccggctcgaaattcatatcgttcgaacacggcggaatcacgatcggatcatcggggccgatcacggacgtgctcggcttggtgaagatcaccatatcctccggcgcatgcttgatatcggaatgaccggcctcatgcatgaactgcgcatgcgcctcataattcttcgccaaaccgtacaccttcgacggaatcaccggagccagcagacgaatgccgtcaccatccaccggatagcgctcgccggtcggctcgacggcctggccggacagcggatagccgttcaaggccacgagatagtccttgccgtcgttcttgtcggtctgaacgaaggcgtactgcggtacatcattatgcgtaaaacgtgcgattctcatacccgcaagtctacccgctcgccacgcccgccgttctcgacatgcgtcgctttgcggacgatgccgattgctcgcattttttacgatttttgcgattatttgcgatgcagttccgcccgcaacgccgccacctcgcgttccagctcgtcgatgcggcgcacctgctgggcgatgagcaggtcgcgcacgtcacctcccgacagaatcgggacttcggctgcgttgcgcggcgcgggcagcgtcgcattgctttgcgtttccgtcgtttgcgttggctgcaccggctgcgataccgcagatcgagcaacctccgcagattccgccgacggcgccacatccgccgacgccgatggcaccactccaccattcccatcaaccgataccagccggtccgtgcccatacggcaggcaatcttgcgccagcgcgcgaaacaacgttcgatgcgcttatagccgatcagcgatgggtcgagtccggcttcgcggaacagttcgaccggcgattcgcccgcatggtaccggcgcatgcagttgtgtttgaacgattccgtgtaggtgatgcgtcgcgacgtcgcttcggccaccaccggcagcgagcgcagatattcgacttcttccggactgaacgctcccccaccgttgcacatgatgttccctttcggcttggcgtgcggcggctcccttccaccgcacggcagtcgaatggcctccgtcatgccattcccctgttcggcttgcgattcggtttgcgatgcgcgcttgcgatacgtgtttgcgatacgtgtttgcgatacgtgtttgcgatgcaaggccgcaatccgattcgttgttcgcttcgtgttccatcataccggtacgaatggcgtttttccaaccatttcaggcggtactaaaccctaaatcgcccgtattcgtcacaacaaaagcgggtgaaccgttgatcgctcaacgactcacccgcccgaacaagccccgttgcctgtctgctggcccgctcagaccaccatcggcgtatcggattcgcggaagcgcagcacgagcgccagtccggctgcggcacggcgacgttacgcgcggcacgcatcacggttttgcgattgaaggtgaagcgatcgcgcatgatgtgttcgtcggcgtcggcatcgtctttggcagcatcattcttgtcgttatcgttgccgttttgagccgacgcggcatccttgtcggcgtcattcttaccgttcttgtcggcatcgtcggcatcttcagcagtgttgccatcgttgtcagcatcgtccgcatcgccggttttgccgtcatcggctgtcgcgcccgcatcgccattcgccacagcatccgtgcgattttcgccggcatggtcgtttcgatcgccgtcttgagccggtgcagcaccatttgcaggtacgtcagcgttctcagccgtcggctgcctaaccgcctgccgttcctgctccttctgctcattcggctgttccgtcttatcgcacggctgccgctgttccggcatcgtctccgacggttgttccggttgcgattgcgactgcagttgcgattgcgcttgttcgttcgatggctgatgcgattcaccgtcgtccgtaaggcattgtgcgtcgtcatcgtccgttgcggactgtccggcaacatcttgcccggcaatgtcggcaacgtccgatccgactgcgttttcagcatcggattgttgtgtcgattccggctggctcgctgcggattcggcggccacgttgccgccatccgtcaccgtttcgtcggcgaacgcggtcgcgccggctcccgtggtgccggccagcatcgcaatcgtgacaagcaatgcggtgaattttcccatccgcgcgccacaccggcttatgaagccggcaagcgggtccttcatccacttcatgacatgtccatctctcatggcgctgtggcgaattgcctatgcgcctccatgccttgaaccttatggatgaacgttttgaaacccgtcccctccattgatgggttcggggaacgtgcggacccgcgaaaatcgcggccttcccccttatcctttacgcggccaggtggaagcgtgccgcatgattcggtgtcggggccgcatcgaccgcacgaccatgcagcacaacagcatgccgcccatcgtgcaaacgatggtcatggcgagcgcgcccagttcggtcgcgcgttcgtcgcgcacgtcggccggatctggcgcgggcagcggtattgcgacgcgatgcccggagactagcagccgatgcgtgttgatgccgtatggcgtgcaggtcatcaacgtcagccggtcttcgccgggcacgattttcaaccgtgagacgtcgtccggttcgatcacgctgattcggtccacttcgtatcccagcgtctcgtccatcactttgatgtacatgaaatcgccgtcgtgcagttcgtcgagccgtgtgaacatcaacgatttgaccaggccgcgatgcccggtgaccaccgtatgcgagtcagtgccgccgaccggcaggctggtgccgtacagatgcccggcaccgacggcgagcaccggttcggacgtaccatgccgaatcggcagttccacgccgattttgggcaccaataccgtgcccatgatgcctgcgccggaatccagcaggccctgatagttcgcgtccgtgtccgcagcggaaagcccggcaccgccggaatgtgccgaatcgtcggcgacatcagcatctccggcagtgccagccggtctggtagtgaacggatcggccgcctcgcccaataccggctgtccttccacggcaagccgccgattgtatgcgcgcgcccgctccaactcctccatcgccatcggatacggccatccggcaaccgtgcgagccgccgaatcggatgtctcggccaagcgccgcgcggaatgcgcctgcatggcgaacggcaacgacgcgaccaccaccgcgcccacgatcagcagcacggacacgcaccgcaccaatatgaaacgaatccgccgcagcctgcgcgcgcgaaccacatcggcaatgtcaatcgcctcgtaaaacgacggcgttccagcgaacgttccagcagacgcaacagttccggcatgaccactgtcggcagctgcaccggcatcagatccgactccggcgccattgccgatgccatcgttatcgtcaccggcatcataggaatcagccgaggcgcccgccacggcaccgaacagccgcatgggcgaacgcagcaccgtatgcgcatgcacgtaggaatccgtcctgcgggcgagcagacggacgggtttactcatcaatcgagaggcagaccaaaacatgggtttctccttcgaacacacccatgttcacacccgccatacgaaagcccttgccccctataggagggcttacccctagaaagacaacggtttcaggcacgaaaccggcaattttggcaccaaaccgcgcagcaccccacctaccggcggaacgcagctcagacaagccgtttttcagaggaatgcaagtcagacgaatgtaagccagacgaatgcaatccaggcggacaagccccgcaaatccttaaaaaacagaaaaagtcaaagaaagcgctcagatgaacgcacgctcaccgaaaatcgcagtgccgacgcgcacgatggtggaaccttcggcgatggccagttccatgtcgccggtcatgcccatcgacagttcccggcaacggtccgtgcctggttcgccggatgcgaggatgaggtcgcgggtcttgcgcaggtgcgagaaaccgcggcgaatcaccgtttcgtcgtacacatgcgcgccgatcgtcatcagtccccgcaattcgatgccgtccaacgtgccgattttctgcgcgatgcggatggcgtgcgccggatcgcaaccggatttcgattcctcgccggattcgttgacttccagcagtacgccgacagtaataccgcgagccacggctctacgtgaaattttttctgccaaatcgattgaatcgaccgattcgatagtgtcgaccaccggcagcactttgccgattttattgctttgcagctggccgatcaggtggaatggaatatgctccgccgcagcatccggcgcggcgcctgcgacgcccagcgaaaacccgcgttccgcgcatcgccgtgccagcccttcggccttcgccgtcacttcctgcggacggttctcgccgatcatgcgcacgccggcatcaatcgcagccatgatttcgccgatgtcgcgcgtcttcgtggcggccagcaggcgcacggagccggcttcgcgtccggcttgttcctcagcggccgcgatgcggtcgagcacacgatgcacgccgtccgtgatctcacgtgcgcgcgcatcgtcgatcacctcgttggcgaggttcttgtgatccatgtatgcagtcatcgtccacctctcgcaagttcattcgaccgccggtccgcggccggcaccaccgtttccggcatgtcggctgatatttcgataccagtgttaccagaaaaccgccgacaacgtataaagaagcccacgcgatgacctgaagtgaagcgataaagcggtcataaattcgcgcgggctataaaaccagacggcagtagaagggggacttcaaagactccgtctacgcatttaatgtatcagataaatgcgcgcgaaccgccggaaaaaaccaataaatctgaaaactttttttcagattttatcccccttgcgcagcccctccaccaaacgctccaatttatcgacgcgatcgctcaacaccatcacctggcataccagcgattgaatcttgcccaacggcacttccgacatcgcattgtggttgtccacagccgtatcatgcggttccggctcttcggccgccttgcgcatgatgtcctcgtcacgcttccagcgtgcgatattgcgttcgatgcgcttgtgcccgatgaccgatgggctcaatcccgcggaaatgaagatcgcagtcggcttctccccctgcagataccgcctcatgcagtcgatttggaattccctcgcatacgtgattctgctgtccgtcaccgcgtcgatcgacggcaatgtacgcaggtattcgatttccgctctactgaactgtcgcttcgtcatattcgccccttgtaaatccccttttgaccggccataccgataacgcatagaccgaattgccgaaatcaccacccagaataccggatgacgcacaccactttacgcacaccccaaacgaaacgcgcggcccgtatcaccatgcgctaaatatccttctcacactgtgagatatctcacagcgacggcacgttttcggagcacgctgcaacctcggcatggcacgtcacggcacgtccagcaacgcattccacaatcgcgtcccacgaaacccgccgttccggccgccgatgcaggtacagttgcaagcatcggcgcaaccggtctctgcatcggcaacaccgaaccgcccgccaacgacaggaaggaaccccgtgccaggtcgtttcgcacccaccccatcaggccgcatgcacatcggcaacatctatgcgatgctcggcgcatggctgtccgcgcgtagccgcggcgacgacatgctgctgcgcatcgaagacatcgacgaaccgcgcgtggtgcccggcgcggccgaactgatgatggacgatctgcattggcttggcttggattgggacggcgatccggtgttccaatccgctcggcacgacctgtaccgtgaggcgctgcattgcttggaaaacctgacgattgacgacgcatacgattcgccgtttgacgagcgcaacgaccacacccccgcagtcggcagcgcagccaacaacgcaatcgctggcacaaccccgctgatttacccttgcttctgctcgcgcgccgacatccgcgcagcctccgcaccgcaggaaggcgaccgtttcatggtgtatcccggcacgtgccgccggcttatcgccagcaatccggataccgtccggcggcggctggccaacggcgaccgccattcgctgcgcatcgccatgcccgccgacacaaacccgcacgcaaccgtacaattcgatgacgcagtgttcggccatcaggaattcaatctggcgcacgacgtcggcgacaccatcgtgcgccgcgccgacggcctgttctcctaccagctggtggtggtcgcggacgatcttgacatgggcgtcgacgacatcgtgcgcggccgcgacctgctccgatcgaacgccctgcaaatcgccattcgccgagcacttatcaaggcgggattccgcaaggcgaaaacgcaggcttctgcaccatcgcagcacgcaccacaatcgcaatacaccccatataaccccgaaaacccacggtacgcgcatctgccgcttatcgacaacgcggccggccgcagactcgccaaacgcgagcgctctttggatatgggggcgctgcgcgcgcatggcgtcaccgcggaacaggttgtcggctattgcgcgtggctgcttggtttgcagggcgattccgcgcataccagtccgcagccgatgagcgccgtcgaggcgttgcaggagttcgattggggtaaggtacgggccgatacggccgaccgcagtatcagccaagacgatttcgacgcgtatttcggcttgtgacaacggctggccgaatctcgccgaattgccgagacgacccggtcagtccggaaaacagcagaaaacagcagaaaacagcagaaaataacgggaagcagtcgacgttcagccgatccacagctccgagtcaagcggatattcgttgaccttgcagccgtccaaatgcatggattgctcctgcatcagcggcgccaactggccttcgccggcgcaggtcgtttcgttgtcgatgtgccccagccggtgtccgacctcatggttgatcaccatcgtgcggtatcgtgccaggttgccgccggcggcgagccattgttgcgtgccaccgttccaacggtcgtcgttgacgatcacgttgttgtcgaccctgcagctgtattccaccgagcatgatggcgagaacgacgtcatttccgacgcttgggacagcacgagattgaaatcgcagttgccgtccgtggattggtcgaatatggctccggcgcgtggccatccgtgttcgtcgttgaggatgcggaacgccgcgttgccgaattcgtcggccgaaccgacgtttcctttggtcgcgatgcagtaatggtattgcgtcaccggtttgccgctgttttgcgcggtttcctgcgctttgttcagaatcgcggttttctcgtcgtcgcccagtgccgccgattgcgcgctcaccgctttggcgatggcctgctcttcctgcgattgtttggtttccggtttggtttttttggccgtcttatgctgattggttttggctgttttcttggctggcttcttggccgacgtcgaatgcgtggcttgtgccgtcatctgcgtgttcggcgtcatgcggaccagcagtgcgtgcacgctgcaggacgtcatcgatgcgatcagcaggaacagcacgagcaccagcacggcggccctgcggatgcgaaacgcctcaagccgttcccgttggcccattgtggcgtcggctttcggatcgagcgcacgtatgatacgacgaatccgcttcaatccagcctcccgatatggtgatgtttctctcttcggcaacagtaccagtctcagtcaacatgccgaagccgccgaccgccatgcataccacctatgcgtaaggcccgcgattccggagggaatcacgggccttaccagcatgccagacgaatgccggcaatcgtcaaagtaacgctcaggcgaacagcaccttgaacaggaacgcgccgacgatagcgcctgcgatcggggccacgaccggaatccaggcctcgccccagcgggaatcgcccttgttcggaatcggcaggatggcgtgcaggaggcgcggcatgaggtcgcgggcagggttcagaccagggccggtcgggccgcccatggaggtcacgaggccccacacgatgaagccgacgacgatggatgcggcggccgggttcgccttgccccacggcagggacaggcagcacagggcgccgagcaccagcatgaaggtgccgaagaactcgttgaggaagtagttcacgcggtcgttgtgcgcgtcggtggtgcagaaggtgccgaggatggcttcggcatcgtcggtgtccttgtagtgcggcaggtaggtgacgtacacgatgagctggcccgccactgcgccgagcagctgggcgatgatgtacggcaggacctcgttccatgggaacatgccgttgacggcctgcgcgagggtcatggccgggttgatgtgggcgccggagacgccgccgaacatcaggaccgggaacatgacgccgaagccgtagcccatggcgatgttcagccagccggcatggtagcccttggtgtttttcagttccgcgttggcgacagcgccgttgccgaagaccatcagcacggcggtgccgacgaattccgcggcaagcttggtgaagagtgtgtattccactgcagtttcctctattgcttcttctctaacgattcttacgattcgtgcgattcgagatgaattgcgattccgctctgggcggacaacagcgcactaccttactccgtacggaggaagtaacgcggctttgggtggacgcatgtccgaaatacgaaaaagacccaagccattggcttgggtcttgtctgtgccccctcagggattcgaaccctggacacgctgattaagagtcagctgctctaaccaactgagctaaaggggcgttggtcttggcgaggtttttgttctcgctgagcacatggagtaaatatactcagaatcggaaagaacgcaaccctcggcgtgtcgcaatcataaaaccgctattttccaacgttttcagcaaatcgccatctatggtgcacatcgcgtcatacgacgaaaaatgcggcgcgatggcgccctaaaatccaagtaatcacattttcttcacattctgccgcaatgcaaccactccgacagtcaacggcacgaacttttccatcacacatttccaccgcggcgagccgaatagcacgcatcatcgtcgagcccgtcggcgcgccagaggccctttataataagggccatggcgcgtcacaggagtatatgacgcgcatcaagaaggagaaaggcttacctatggcatgcccaaattgcggtcagccgaccatcgaaggcgctaaattctgcgcctcgtgcggctcaccgctcacccaaacgaccgcggcggcaccgcaagcgccggccgcgccggaatccgatgacggcaccatgctgtcttccgcgccgcacatggcaccggccccgcagatgccgaccgctgccgtcccactgcccaatagcgccgcaccggcagctccgcaaaccaccgtcccgcagcccaccacaccgcaaccggcggcgcaagcacagccgaccgctcaggcgcaggcaacgcaaacggtggcaccacaggccgcgccgacgcagcagttccagtatgcgccatccccggccccgcagccggcagcagcgccgcagccaagccagccgacccagcaaatcgcccgtccggcggccgatcccaccatcaccgcgctgaccacaccgcagtccatgaagaccatgggcgccagcctcggcatcggtctcggcgcgagcgtggtgttcgcgctgctcgcatcgatcgtcttcttcatgggcaatgccgcggccagcaacgggcttgccggcattccgggcttttccgacaccgcctccttcctgggcaacaacggtgtgtccggctccggcccgaatttcttccagattctcttcaccgtgatgacgctcggcgttggcggttcgctgaatctcaaaaccagctcccagggcttctctctgagcaatctcggcattgacgcctcgcacgtcagcgtgacgctgccggtcggactgcccggcgtggcattggcgatcggcgccgcgttcggcgcatacatgctggcacgcaggttcgcgcttcgtttcaagtggacgggcgtcatcagctcgctgatcgtcggcgtgctgtccggcctggtgctgctggtcttcgccgccatcttcccggtgacggtgggtggttcctacagcgactattccgcttccgcgtcgctttccggcgtgtccttccgcacgttctgcatggcgttcctgctgtcggcggccggtgcgctggccggctacgcgttggcacagtatgcgggcgattcgggtaacgtcttctccgccgcttggcgttgggcgcaccgcgctcgtggcttcgtgcgcacgctggtcgaatcgtttgcgatctacggcgtgctgttcctggtgcttggcctggtggcgacgatcgccatgtccgccgcgaaccatctcggcgcaggcggtctgctgctggttccgctgctgttcccggctctgccgcttatgctgatttcgctgtcctcgttcggcggcatcgccttctcgacgtccagctacagcgtccatacgatcacgttgttcaacgtgtcctccctcagccagtatggctggattctgtggatctgcttcgtgctgttcctgcttgccacgttctatatcgcgctgcgtgagaccgcgcgcaatatgtacgacccgtattacgcgggctggcagcatacgtggaaggctccggtggccgcgatggtgttctggctggccgcggagttcctgttcacttatttcgcggcgggatacgcctcgtccagcatgtcgatgacgaccccgatgtggtatttcctcgtcgccggcatctgggcgttcctgatcgaggtggccgcgatgacgttcggtccgacgctggtggcgtccctgccgggcatgtggcggatcgtcgtcggtggcaccgtgcagcagaccccgcagaacgtggtcgattacgtcaagtcctgcgatccgtcctacggcatgaagaagacctctgccacggcgagcggcacgaccgcaacagcgaccatgccgacggcttcggctgccgcacagccggtcaatccaactactccggcagctccggccgcatcggtcccccagcccgcgacgccggctgcgccgatgcccgcgcccaccgctcctaccgcaacgcctgtttcacaggccgttccacaaccggtcgccccgacgtccatgcccaatacgacaacgggcaacacggcaacgggtgcggtgccgctgccgcaatcgccagcaggcacggcttctatgccggtcgcagctccgggggcaggtcagccgctcgacccaaaaactaagaagacgatccttatcggcggcatcgtgatcggtgccctgattgtgttgggcattgtctacggtgtgctcaactcgaccgtcttcagcgcgaaatccgtggcgcagagctatctgacggcgattgccgacggcaagtatggcaaagccaatggcatcgccgatccgcaggtgggcaaggaccagctcaagctgctgtccgacgccgtgtcgaaggccgacaacgccacgatcgccaacccccatatcgatagtgtcaaaaccgtcgaaggcgtggccaaggtcaacgtgacgtattcgctgaacggcaagaacgtcaacgattcgctcaccatcaacaaggacgggtcgaagttcctgctgttcccgaattggaagatctcgagcccactgctcaagaccatcaccgtgtcggtgcccaatgccgtggaatcgttgtccgtcaacggtgttgacgtgaccgcgaagaatgcggagaagtcggacagcggcacgtggacgctgcgcgtctacccgggttcgtacaaggtgtcgatcggcaagtcggggtatgtcaccagcggcatcaccatggtgcgcacgaacgcggactccgatgccgccgatctcaagatcatgcctacggccaagcttaaggaggacttgagcaaggccgtgaacgccaagctggacgaatgcgcgaagtccaccgactacgcgccggaaggctgcccgttcggcttcgacctgtacgacgaggactactaccgcaacttcgcgtggtccatcagcgtctatccgaagctgtccgacatcgatctcgattacggcacgttctccacccggcagggcaaggcgaagtgcacgtatgaagagaagaatttcgacgattcgtgggagtctcaggacgacagcacccacttcaccgtcaacggcagcttcagcatcagggatggcaagctcagcgtcacgattgacgatgaggactgatgccggctaaagagcggatataggaaaatcccccgcaccaatcggtacgggggattttcgatgcttaagctcagacgtgtttcagcctgaagtcattcaccgccggtccgtaaggacgtcgagcggtgaatggggcgaaatcactcagcgacgaccttcacgaagaagttggcggtgatttccgggtgcagggcgacggttgccgggaagtcaccggtggtcttgatcggctcaacggtgatgttcttcgggttgacctcaaccttggaggagagcgcgatggcgatcttctctgcggagatgccgccgaacagcttgccggactcggagaccttggcagcgatttcgacggtggaaccctcgatgatttccttggcggcaacagcctcttcgcgggtggcgacggccttggccagacgagcgcgcttcatggcctcgatctgggcggcggcacccttggaccaagcgaaagccaggccctgcgggaacaggtagttgcgggcgtagccggacttgacggccacgacgtcacccgggtgacccaggtggttgacggacttggtgagaataaccttagtttcagccattgttcaaacctctctaagatcagcggccggacgtggcgtacggcagcagggccatctcgcgggcgttcttgatagccttggagatctcgcgctgctcctgcacggtgacaccggtgatacgacgggaacgaatcttgccgcgatcggagatgaacttacgcagcagggcgacgtccttgtaatcgatctcggtgaccttggcggccttcagtggattcggcttcttcttaaacggcttgaccggcggctgcggcctcttgcgtgacatcttgatgttctccttaaaatctggaaatactgcgattaagctgcttgtttcgctgttcgcctatgttgcggacgggtttcggtccgtcagaattccggttcgtcgctgtcgccgccgaattcggaggaacctccgaaggactgggacgcgccgaaggaaccgaaggacgagccggagttatccgagcttgaccacgggtccgaggccggagcggactgtgcgggagcggcgttgaccggagcggaggctccaccctgatatccggcgccgccagcatagctggagccgccctgatatccgccgttgttgccgccgaaaccgccgttgttgttggcgttgttgtagccgccgcgattgccgctgaagcctccgttgccggacgagctttgacgggtcacctgggcggtcgcgtagcgcagggacgggccgatttcgtcgacctgcatctcgatgacggttcgctgggaaccgtcctgcgcctggtaggaacgctgctgcagacggccttgcgcgatgacgcgcatgcccttggacagactctgcgcgcaatgttcggccatgtcgcgccacgcggagcagcgcaggaacagggcctgaccgtcttcgaactggttcgagttacggttccaggtgcgcggagtggaggcgatcgtaaagctggcaacggcggcgccgctgccaatggtacgaatttccggatcggccgtgaggttgcccaccacggtgattacagtttcacctgccatgtcgttacctacttactttgcagcttagaaagcttggtttacttacttgcgaagaatcttcgtacggatgacggattcgttcaggttcagcagacgatcgagttcgtcgctggtggccggctcagcggagtagttgaccacgacgtagttaccttcggtcttgccggcgatttcgtaggcaagcttgcgacggccccagatgtcgatgttctcgacggcaccgccttccttggtgacagtttccagatactgctcggtcagcttcttcagaccgcgctcatccagctcaggatcagcaatgaacatcagttcgtacttatgcgcagacatcacccacctccttcggactatcggccatggaccttccatggcaggagtgtgtatgcgtgctgccttcaggcatcgataagtcgcaatgaacatatggatacgattgatggcaacttgtacaggctaccccgacgccgcgacgtatcgaaacggcgtctgccgggcgcgaaatcacgtgcggaggcaagcaaaaaagccccgctcgcaagcggggcttaatcgcaaagaatcgtaataaatcctgaaatatcgcgagagccgtatggcaatcgcgcgaaatatcaggcgtagatgttgcgcgggcgcatgtcttcgggcaggccgttgagcagcgtcgaaacggagccggattcgaacacggagcggatgccggcggccagcagcggggccacggacaggacggtcatgttcggcaggcgcttctcttcgggcaccggaacggtgtcggtgagcacgatttcgcgggcgccgcagtcgcgcaggcgctccacggccggaccggacagcaggccgtgggtggcgacgagcgtcacggacttcgcgccggcgttgttcagcgtgcgcacggcctcgcagatggtgccggcggtgtcgatcatgtcgtcgacgaccacgcagtcgcgtcccttcacgtcaccgatgatgccgtgcgcctcggcatggttcgggcgcgtggtgtcacgggtcttgtggatgaaggcgagcggcagtccgccgagcttggcggcccactgttcggaaaccttgatgcggccggcgtccggggacacgatggtggtgttctccagcggcatgctgttgcgcacgtagtcaagcaggatcggcatggcggtgagatggtcgaccgggccgtcgaagaagccctgctcctgggctgcgtgcaggtcgaccgtcatgatgcggtcggcgccggcggaacggaacaggtcgaacatgaggcgtgcggtgatgggctcgcggccctgatgcttcttgtcctggcgggagtagccgaggaacggcgcgaccacggtgatggaacgtgcggaggcgcgcttcatggcgtccaccatgatgagctgctccatgatccacttgttgatcggctcggtgtgggcctgcatcacgaaggcgtcggcgccacggacgggctcggtgtagcgcacgtacatctcgccgttggcgaaatcgtatgcggtggtctcaagtacgtcggttcccaggtattttgcggtttcctgagcctgctcggggtacgcgcgacccgtcaccagagccagtttcttatccggagtgccttcgagaatcgccgacatgcttgccttcccaattgttcggtgcgtgaaattaagccaaactccaatataacaacgtgggtgcccacgccacgcggccgttgcggaagcgtttcaccataccgctccaaactgccgtcggcaacatcaaaaaatccccaagccatcgacgcagaaggcacatctcaacgtcgatggttttgggggaaaaccggattaccggactattcggcggacgcgaacgcttcgcggatctgcgctgcgttgccgtaggacgcctgcgcgccgtagccggtggccgcgtacgccgaaacgtacgaggcgagttcggcggcttcggacagcgccagtccggacgccaggccggccagcacggtgcccatgaaggaatcgccgcagccggtggtgtcgacggccttgacgcgtaccggggcgatgcgctggacgcggtgttccggatcgtccgcggtgccgtcgagtaccacggaaccgtcgccgccgagcgtcacgatcgcctgttcgaagccgaatccgcgcagttcgtcgagcgcgtgccaccagtcgaacgaatcccaatcgtcgttctccggctcgtcgatgtcgagcagttgcgccatttcatgctcgttgacgagcaggatgtcggatgcttcgatcagttccgccggcagggacggggtgaacggcgagtcgttgagcagcaccttcacgcccgcttcgtggcacatgcgtgcggccgcggtgacggtttcgatggggctttccaggcacaggccgagcactgtggagtgggtcagcgcgtcacgcacggattcgacgtagtcgacggtcacctgcgcgttggagccgggcgagtacacgatggtgttctcgccgtgcgcgtccacggtgatgacggtggtgccggacgggccgagcacgcggcgcacgtgcgtggtgttgacgcccgcttcgccgagcgctccgagcaggaagtcggcgttgttgtcggagccgaccgcgccgaacatctgcacggtggcgccgatgcgtgcggccgccgcggcctggttgccggatttgccgccgggcagcagctgtagcgggccgccggtgatggtctcgcccggcccgggcagtcgctgtgcggtgacggtgtaatccgcattcatcgagccgattacggacactgtgccgtggatgcggtccaatgcagagagaacttcagtcgcactcatctttgacttccttacattaattaaataaaaaggagatttgcggaatattgtttttcagtattcgcaattatcgcaaatctccattgtttatattgaggatgttatgtgcgattatttagccgattcctcggtttccaacgcatggttgccttcgtagatctttttcttgaagacgaagaacacgatcagaccaagcagtgcggtaccggcggcgatcagcagcaggttggaatagttggcggcgtcaccggtagcaccggtgacggaactgcctgcgagggcgttggagccgagcaggctgccgatgatggcaatgccgatggacggagatacgttcatagccagatcgttcatgccgacgccacgaccagattcgtccttctcaatggtgccgagcacggtggaaacgactggagagtacataaggccacagcccgcgtagaacacgcatgcgcacagggtcagcaccacaaaaccggagttcacgcagaatgccgcgccggtccatcccaggaacatgagggtgcctgcggtcacgatgccggccttgatgccgatcttgcggatgatcatgccggagcaggtgcccaccacagcggcgaccacgaaggcccacacgatgtgcagggaaacctgggtggtggtcatgccgtagatgttggtaccaatggcattgaagatcgggctcagtgcgtagttcacgaagtagaacacgaggatcagacagatggcgcgcagccaacgggtgttcttgaagaacgccggggtgatgaacgggttggaggccttgttgatgtagaaggcgaatgccacgaacagcagcagggagaccacgagcatccaccaggacatgtaggagaagaacagggtcaggaacgcggtggcgaagccgaagatcacgaagccgaacgcgtcgaccttctggccgttgccgctcttggacgggagggtcttgagcaggatcggcaggaacaggatggtgacggacgggatcaggaacaggaactgccatgcgatggagctgagcatgccggccgcgaacacgccgatggaagcggacagctggtatgcggcggtgaacaggccgaagaagatgaccttcaggtcgttgcgcaggtatttggtggccaccaccaggaaggcggagcctgccacctgctcgcctgcggtctgcagcactcgagcgatgatcacggtccacaggttcgcggcgaagaaatagttggccacgaaaccgaagatggagccgatgaacagggtcacgaggccgaaggtgacgagcttcttcagggagacgaagtcaccgagggatccatagatgaagcacacgatgccgagcacgatgctggggaacgcggtgatgagggacgcctgcgccggcgcgccgacgtcggcgccgacctgctggaacacgaggttgaatccctgcaggcacagggtgccgagcacgaaggtgatcagcagcggaataagggcgcggacggccatcttgttgctggtcaccggatcgtcgaacgggtcgacgggggcttgcgatggtgcggtgttgactgccgttgcggctgcgttgctggtagacatgtcagttcttctttcgcttcttcgcttggtttttgtgatgttgtgttgcgattatttcgatggtgattccgtggtgagggttgcgcgggaaacgctccgtggaacgttttccgcgcgagccgtcgttcactgcgcttttgcggcgaggccggagatgcgggtcatgaattcgttgaggaacctcggcacgtccacgccgacggcgaccttcatggtcttgaccgggtcgttgaggcgggtttcgtcgccgatagtgcgtccgcgggtcgggccgtccacatcgaccttcatgttgatgtcaagggtggtgacgagggtcgggtccaccgccacgccgacggcgagcggatcatgcagaccgcagccgcccaggtgcggggacgtagtctcgtaggccttgatgtagaagtcggtcatgtcggccaggaacttgccggccttggtgccgagatcgcgccactgctgagtttccttgtaggtgagcagggtctgcagggtcacgtcgaggccgatcatagtggtcggagcgccggaacggaacaggtagtcggcggcttccggatcctgcgaaatgttggcttccatgcaggcgttgcagttaccgggcacggtcagtgcgccacccatgagcacgatctggccgatttcgtctttgatttccggagccttcttcagtgcggcttcgatgttggtcatcgggccggtcggcacgtagacgagatccttgccataggtcttcactgcgtcgatgatgaagtctaccgcggattcggtttcgacggagcggttggaatcagggatttccacgtcgccgatgccgttgtcgccgtggatgaacgcggagattggcagtacttcgaaatggtcggtggtgctggagtgcggcaaaccctgatacaccttgacttccgggtggccgagcaggtcggtcacggccagtgcgttgcgcacaccctgctcgacgagcacattgccgtaggtaccggtgatgccgatcagttcaatctccgggcttcccagagcatacgaaatggcaagcgcgtcatcaacgccggtatcaagatcaagaatcatctttttcatgtgtgtgcctttcctctttgacgggcctgacgacggtccgccaccatacgggtgcgtcgtcagttatgtatcgaacactttctcatttatgttgtgtgttgacaagatttatgataaagcgttttatcaggaacgcaaattcggcactaccatacggcgtgttgcttttatttccagcaatttaaccgtataagaaactccgacgacactttaatcaagatttatcagcgccacccgtctcatcatgatccgcaggtatctaaaaatcctcaatcctacgcgcaggcggcctgcaccagtttcggcgtaagcacttcaacctgcggattagaaagccacgggcgagcatcccctgattccgtaccggacttggcacgaaccgcaacatcaatccgctcacgcaacataccccaacaggcggcggccaaatcagccacgctctgctcaacggtggtcatacgccaaccaagaccgaatcgtttgagaatattgtcgtaaccaatcacctgcatatcctcagtaacgcgcaacccacgttccgccatacgctgacggaaaccaagcgccatcacatcattgcagcagaacacggccgtcgcaccgccatcaataatctgatccgcagcatgatagccactaccgaaacggtaatccccctcaacgcatagcgacgaatcaaaacactcccccgcctgctcgacggcatccacaaacccacgacgacgctccgcagcactcgactccgcagtatcgccagtcacaatgccaatacgagtatgaccaccctccaacagataacgggcagccaaacgaccaccaagataattgtcaaaaccaacggcatcgcaccaaccgcactgcgtcaaacgatcaatcaacaccacagggcacgacacaagcgccacatcctcacgcaaccgctcagcagcatcgccagcgcaggactcgcgcgccggaatcagcatcacaccgtccaccccacgagccggaaggcgctgcaacaactcatgctcggtaacacgcgaatcatcggaattggccacaatcagcgaatacccctgcgcggcgcactcatcctccacgcacttggcaagcgccgcgaaaaacaagttctcaatatcaggcacgatcagcgcaaccagctgggactgcttggtcaccaagcttcgcgcgctctgattcggcacgtaattcagtttctttgccgcgtcggcaatggccttgcgcttctcctcggacacgcgagccggtcgattattcaacaccagcgaaaccgtcgtcacagacacccccgcggcagcggccacatccttcagtgtcgcacgatacgccatcaaacccccttaaaacgtttctccctccagcataaatgccatgcgatcctgacgcgcccagcatcgcaatcacaaacaaattcctttcacagcaaaataatccgcattatttccagcggtaaatcgtttctcggaagtgttttttgtatactcgcaacgttttgtctgaaatgagagccacacgagaagagaggaaccaccatgcagccaaccatgcagaaaaacaatgtgaaacagcgcaagaccatcgccatcatcgccatgatcgcagtagctgccatcgcgctcgcagccgtcgccatcatcgcagtctccaacaagcgcgaaatgacacaagccgccagcgacacctgcgcgttgaatgcgaaggcgctcgccacgcatcaggagagctttgaagaagcgcaacaagaagctgaagaagcagcgaaactcaccgtgaatgacgtggcggacggcaccacgctcgaaaccctgaaggatgcgatcacactggccaaagccgtggaaagcgcgccagcatgccccgcaagcggcaatgccagcgacttcaccaaagcgacggacgacattcgcaaatacgccgacaacctgcgcaacatcaccaacgaactcgacgcggccgccaagtcggtggtcgccagccaagaactcagactcgagtccgccgagtaagtcaggtaagccgccccgacggttagcgccgacgtcagcgccaaaccctacgtttaacggggccaaagtcatccaagtctgcaacttcgcccccattacaagcattttcgcaccacatcgggcttatatatggcagattcgacaggtcgcccggagacatttcgcttatatatggcaggtcattccggaaagaccgcagttagagggtacaaaattaccccctaactagcttgtttcaaaaacagactgccatacataggcgagatgcctccgtacaaaccccaaaatctgccatacataagcgagatatgcccatgaattacgcatctatgctgtgcaggcgcgacctcgcgtcgcttagaggcttgacaacaccttccatttgacaaaagttatcagttgccacgcaccaggagacgcaataggggccgcaccttcgaggtgcggccgtttttcatccttcaccaaacctggatctgcaactaaggctagcgaacaaaatgtacgccaaaccacacatccattccccggcgaggttgactcgcctgcaacgcgtctcctcgatcaccgcttaccgaacttcaattgtccggcttgcgccacacgaaccaaattcttactggccttgggcgcggtagcgggcttcggtggcggctttggcgggctcccaccaggcgcggttggcagcataccaagcgatggtcgcctgcaaaccggcttcgaaatcggtatgcacgggccgccagccgagttcggtacgcagcttattggaatcgatcgcgtaacgtcgatcatgcccaggacggtcacgcacccagtcgaatgcgtcctccgcacaccccataagccgcagaatcatacgcattacggcaatgttgctcatttcgccgtccgcgccgatcagatacgtttcgccgatgcgaccgcgcgtcagaatcgcccataccgccgaagagtggtcttccgtatgaatccagtcgcgcacgttctcgccggtgccgtacagtttcggccgcgcgccttccagaatggatgtgatctgtcgtggaatgaatttttccacatgctggtatggcccgtaattattggaacagttggaaatggtggcgcgcaggccgtatgtgcgcgtccacgcgcgcaccagatggtcggacgcggctttcgacgcgctgtacgggcttgacgggcggtacggcgagttttcagtgaatttgcatggatcgtcgagcgcgaggtcgccgtacacttcgtcggtgctgatgtggtggaatcgcacgtcgtatttacacgcggcctccaacagccgcatcgtgccctctacgttcgtgcggatgaacggttccgggtcgaagatggaattgtcgttatgtgattccgccgcgaaatgcacgatggcgtcgcagccgggcacaatgcgttccagcagcgacgcatcgcagatatcgccgatgacaagttcgacctgcgattgcggcagcccgtcgatgttcgccggattgcccgcatacgtcagcttgtcaagcacggtgatatgcacgtccggatgattgcgcgccacataccgcacgaaattcgcgccgatgaacccgcatccgcctgttaccagaatatgtttcggtttgaatccctgttcgctcactgtttcagcaaccgccttcccgattccaacattacgaatgcaaacaaaggcgcataaggaaggaaatacctgaattgcataccgtcgactccgattagcccatccgcatcgtattgcagccacaaggcaaggtaaatcagtaggatatctccgatacagaccaccgcgatcaaccatgcgtatggtaaggaaagcacaccgcatgcatttatagaaccattggcagtcctaaccggattctttcggcggcttttggtacaagcattcaccacactggtcacagccaacacgactacggaaaccacgattgccaaccaacacgcggcaatcatgatgctgtccgtcctgttattcatattcgattgagcatgcgttatcgcccatacgatgttcttcacagcatccaacatggcaacgggatccgtcaacaatgcatgcttgcgctcgctcatttgtttgtacgaaaccagcatcggacaattcgtataccaagcattgacgcccaaccagaatatggtccatataccagacgcaaccacgcctatcaacaatggcacagcccgaccacgattcacacgccagcgaccggaaactctatcaaacatcaacggaataaccagcaaaaccaatggcatgtacacaaacttgcacattgccaatagcacgctcgttaccgcaagcgccactgctccacgttgtgatcgtttaccaataattccccggaacagcaaacaggagaacagaatcatcacagcttgtgtcagcgaatccgcagagatggaaaatgaggcgaatctaagcatttgagggacgcatagcaatagtccaaccggaatgcgccattttggcaatgtcataaccgcgcagtacatgagtaatgcatagacagctatcatgcatatttctgccaatcgatatgttgttccagatctcagattaaataatcggcctacagcaaaacccagcaattgcggagcatatacaatcggtgaatttgttgccgtattgttgaacggcaggtcaaccgttgcggacgccttgttattagtaatagactccggaatcacaattcctggatcatatccgtcatattgctccagggaatactgcatccaactgcgatcgaccgcgccaccgactacccccgtctcagcattatgcaacatgcttcttgaagtaactggccgcgcaattacatccccgttgagtatggagtcaattcgataaacatgcgtccaaatatccggcacatgaccaggcttggtaatagtcatgaaaaacatgccttcaagcaacacgcacaacgccaccaacactggcatgcatcgaaaaatcttcttccccttcataccgccactatcgcataactatttgactgcgcttaagaacatgccttggtttcattcatcattcagatacccaccagctaccatcaagacacctactcgtccagacacactggctaatatatagctcggttttacatgctcataaacccccgtttacacaaggggttatttgccgtgaaggaagcgacgatgccttatatccagtctgccgttcatgccttcgagccttcatacaccaagcatcccaaacaatcgtttaccggcggcatctaccagccactggccgatgagagcatgacagataccccctcttatttcaaggcacgtcaccgcgcggagctgtatacgcggaagaccactctccatacaaagcccgcgcgccgaagcatctacataccgacaacggaagcatcccccgtaacatgcgatacgaatattcttgcgattgcggacgagcagcatgcttcctcttttgccgcagaggaacaagttaacggcaatcacgcattacaggcgatgccgtgcactcttcaaacggttcggacagcgctgacgactgctgaacatggcttgaaacgagcaggacacgttattgccagcgcggcccgcaccactgcatgcgccgcacgtaccgctgcgaccacggtgcgtaacgcatggcataccttcacaagtctcaaagccgtccagctcatcatcaagttcttccagagcgcgcatgccttgtggaagaagcgccatcgtttctctttttctttctatgcaatcattctcatggccctcaccacattcgaaacattgtttatccaatggggcatgtattccgaacccgagtacaaaaaaggcgaggatatcagcgaagccgtaagacagacatccagcatcgttggacagttgtcacattttattagtcaaatctggtccgacaagaattacattttcttacttaatctcattattttcgcagtcgtctacctcacgctcatattcataattaatcgtttttggatagcaacagcgatttttggcacagtcatgaccgtttacgccgtggcgaaccacatcaaaattgaatctcgcaatgaacccgtgcttccggctgatcttaatttcatcactggaggcaacactggacagttagcatccttcatccctcaaagcagtcaaggacttgccaatacagcagttagcggcgtcatatggcttgtcgtcatttgcattatcatgcagtttatcgatggacgcaatgccgttatctactgttcctggcgtcacccttttaccgggattaagaaccttgccggcacgctcactcgcattgtagccgcatgctgcagtttcgcactgtgtttttccttcgtatggggatttggcaacgaaggatactggtcaacagatttcgcaaaaaatcttggagatagtccacagatctggaatggcctcgcagattccacgaacaatggtcctgttgtgaatttcctgcgtctcgcgcacacaaaaaccatggataaacccaatggatattcgcaagaagctatggaaaaaatctctcggaaatacacggaacaggcaaaacagcttaatcaaacccgatccgagaacatgaccgacaacactgtcatcatggtgctttccgaaacgttctcggatccaactcgagtgcctggcgtcagcttctccgaagatccaatgccaaatatccgtcatgtcaaagcccaaacaacttccggtctgatgctttccccgggctacggaggcggcaccgcaaatattgagtatcaagctttgtccggcttgtccatggcaaattacagttccacattatccattgcctatcagcagctggttccatccctcaaatgggcgcctacgctcaatcaagcttggaacaaagccaacggaaagggctcatccatcgcattccacgcttacaaccgcaacatgtacttccgtgatttgaattacaaaaaatttggcttctcgaagttttatgccacagatggcacaccacaattgaaaggcctacgaccacttgactctgcttggtatgcctcggatgagtccttctactcagaagtactcaaaaagatttcatcttctgaccagaagaagttctatcaagttgtcaccatgcagaaccatatgccttatgagaatttttatcctgataatcaatttaaggatgaagatacttcttcaaatttgcaggatgatgagaaacaaaatattgaaacctatacaaagggtctaagctatacggatcaagcaacagctgaattcttgaatcagctcaaccatatcgataggccaatcaccgtcgtattctatggagatcatctacccgggatttactccacggcatattccagcaaagataatattcttggtctgcatgaaactgattatttcatctggtctaacgatgcttcgaaatcgtcaggcaccaaactggatgatgcctccagtgcctacacatcatcaaattatttctccgctcagctagcctcacatctcaatgcaaaagtcagcccatatctggctttcctgacgaagatgcacgaaaccatcccggcaatctctatcccctcgtcggctgggggcaatgcagacgagccggtttatcttgatgcagcaggtaatcgcattaataacaaacagctttccaaagaagccaagacaatgcttcatgattatcaactcattcagtacgatatgagcgtcggcaagaattatctgaaggataccggctttgtcgatttacctcaatgatttgtctacaatagcctgagatggtagtaaaaacaaaaggcaggttactcttatgaagattgcggttgctggtactggctacgtagggttatctatcgcattactgctttctcagcataacgaggttcacgcgctcgatatcgtccccaagaaagtcgagctgctcaacaatggcaaaagcccgattgtcgacccggtgatcaccgattttctggaaaaaaatgcttccggcgagcgtccacttaacttccacgctacggttaacgcacaagaggcatacgcagacgtcgatttcgcaataattgcgacaccaacaaattacgatgagaagaagaattacttcgacacttctagtgttgaagccgcaattaccgcagtgcgtcagtactcaccgcacgcttggattatcattaagtccactattccagttggatatacgcaacaacttcgcgagaatctagatgacgatcgcattcttttctccccggaattcttgcgcgaagggcacgcactatacgacaatctgcatccaagccgcatcgtagtgggcgctccgcaaaacaatgctgaatccgttcaggcagcacggcaattcgccacattgcttgccgaaggtgcagacccctcagaaaacaaccgtacgaatagcgacggcagcaccggtatccccacactggtggttggcaccaccgaggccgaagccatcaagctattcgctaatacgtatttggctctacgagtggcatatttcaatgaacttgatacctatgcggaaagtcgaggtctgaacacccgcgaaatcatcgatggcgtatgtcttgatccacgcatcggtgacggttataacaaccccagctttggctatggcggatactgcctgccgaaggacactaagcaactgctggccaactataatcaggtgccgcagaaccttatcgaagctattgtggatgcaaaccgcacccgcaaggagttcgttgcatctgaggtgatggaacgtatcaaagacgttcaaaatcctgtcattggcatttaccggctgaccatgaaatctggctccgacaatttccgtcagtccgccatccaagatgtgatgaggcagtttaaagccaacggcctccccgtgcttatctatgagcccacattagataagcccgacttccaaggcagtgaggtcactcagaatctcagcgaattcaaagaacgttcatccgtaatcgtggctaaccgctggaacaatgatctcaatagtgtggctttcaaggtctacacacgcgatctgttccgcagagactgatttatcaacagcttatcttgttggtgtttgcccaaataggaatattctggacaaacaccatcagcagcatcaccgcttaccttggaccttgcgggccaccaccttcatcagctcgcgctgcttggaaccggtcggagccagtacatccacgtacttgcggatggggctgtcctccgcgatcgcacgctcatgatgttccggcggagcgggacgttccacaccactcattgctgcgatcatctgcgccacgaaaggcgtttcctgcgcataattccaatacaacggggcgaaatcgcaccacggattcttccatggcttgtcgaaaccagcgtaatgcacgattttcggagccttacgagaagccatgtatgccttatacacattggcgggcgcgaaatcgaatacgccattgacccgaccggcacagttgtgcatcacattccacgaataatccaggtacgtgaccaggccttcgcattccacgttcaaaatatcctggtcgttatagatgtatccgggtttggaggcgatttccagccattcgtggacggtatggatcttgcgcatacgctcgaggttcatcaccagcacgccggcctggaagtagccgtacgcatcgcgcatatgcaattgcttgcgcacgtatccggcccgttcgccgtttttcatattgagattgccgatgaagtcgatatcaggcacggcggcgatcgcattgtctccaagttcggtatcgaacagttcggcgacatcgccattgaccaccagatcacaatccagatacagcaacttcgaatagaacggcaacgcctcctggatgatgaaacggtaatacgtttcgatgctgatatgcgcattgctggtggtgagattgaagccagccaagtaacggctcacatcgaagaagcggatcacggcatttgggaaccgttcgaaaaactgacgtatgttttgcttgttctcgccggagatattccgttccaatacgatcacatcatatgaacgatctttggaagcgttcttcagcatcgaatagatggtggtggtgagcatcggcacatagttgttgtccgcggcgaacaccaccggcaccacgttcttgtatccggcatcaagcggcttgagaacggtggccggttccggatgcaggaaatgcacgcactgcagtcgcttgatcttccaatgcgcaccggtacgctgcttgtgcgctatgaagatgttgagcagccgttccgaaagatgccccaccgtacgtgtggtctgcacgtccattctgctgaaatcggttgccacagcgaactcatcaagcagtgggaacagccattcgttgtattcgaagaagatgtccttcctcatgatgaacatgttgcagaatgccgcggttctcccattgagcacggcatcggcgtccaccttgtagtcgggatggcgcgcgcacagaatgtcatacatgtggcgcaggtccttcaaacgcaggtgctcgtcggcatcccagtgctgcttgagatttgagaatccgccgatacggcgaacgtcattcaacggcgtggtgatgacgtcccaaccatccacggcacgagcgatcgcatcatcgttgataccgtattcggcgagcgcgtgattatcgatatacgaatcgataatctctccgtaatcgttctctttgtgcggagtatcggtgaaatcgaagtacctgcggtagtggcagaagccgtaatagtcagcatcctcgtttttccaggcccagtattgcgcggttagctcacaataccgcgggttttccgcagaaatgttcacaccttcgtcgtcatgcaaagtgttcgtgaaacgagtcgcagcattcgccgcgcccacctgcaccggaacaatactgttcccctcagggaacgtggcctgcttatgtgccgacacaaagattttgatattcggatggtgctgttccgctgtgagaaccatgtgagatattccgccttactaagacaaacgtcctttcctcaatagaatatatgagagtactgccgaagagggacgctctacgagcttttgcacccaaatacttcgcacgagtaggataggacgtttgtgaaagactttttcgaaagcctcaagaagaggtaccactatgcgatggtggttttcaaggaactggtgaaaaccgacttccagctgcgatatcagggctcattcctgggcatggtgtggtccgtgctgaaaccgctgatgctgttcgccgtgatgtacgtggtgttcgtgaagttcctgaagttctcggatggcactccgactttcccgatttcattgctgtgcggcacctgcctgtggagtttcttctccgaatcgaccagcatgggaatgcgcgccatcgtcgatcgtggcgatctgctgcgcaagattcatttcccgaattacatcattgtggcgtccaccacgatgggttccatgatttccctgggcatcaaccttgtggtggtcatcctcttcggtttcttcgcccacgcacactacacctggcgcatcctactggttccgctcagcattatccagctgtattgccttggtcttggcgttgctctgcttcttggctcgctgtatgtgtatttccgtgatgtggcccatatctgggaagtggtgctgcaggccatgttctatgccacgcctatcatctacccgatttccatggtggcgcagaacaaggagttctcctgggctgccgacattctgatgcttaacccgaccacgcagaccatcatggatatccgccataacctgctgtctccggaatacgtgccgaccgtgtggaccatggtggataacaagctgctgtgtctgctgccgtatgtgctgtccgctgtgattctgtggctgggcatccatgtgttccgcaagtacagcgccaagttcgcggaggtgctctaaagccatgagcgaggtttcgatgactgacaacaacactgttgatgaacgtccggtcgtactcaaggtcgaccatgtggccaagtccttccgtctgcccaccgaacaggccaccggtctgaagatggctttcctgaactggacgaagggcatcaagggctacaccgagcagcatgtgctgcgcgacatcaatttcgaagtgcatcagggcgatttcttcggcatcgtcggccgtaacggttccggcaaatccacgttgctgaagatcatttcgcagatttacgtgccggaacagggttccgtgatggtgaagggcaagctggtgccgttcatcgagctgggcgtcggcttcaatccggagttgaccggacgtgagaacgtgtatctgaacggcgcgctgctgggattcacgcacgaggaaatcgacgcgatgtatgacgacatcgtggaattcgccgagcttgaggacttcatggaccagaagctcaagaactattcctccggcatgcaggtgcgtctcgccttctccgtggccatcaaggcgcagggcgacattctggtgctcgacgaagtgctcgccgtcggcgacgaggcgttccagcgcaagtgtgacaacttcttcgccgagatcaagaaagatccgaccaagacggtcattctcgtcacccactccatggacgcggtgaagaagtactgcaataacgccatcctcatcaaagatggcgaaattattgcaagcggagataagaatgatgttgccgatcggtatacagaagagaatctgacagcaaagaaacagaaaaagcaggtggacggagcctatgaacaaggtttgaatgaggcatgccccctcctgaaaatcaaacctgtgtctaaagttgttgtaaacggaggttctcctttcgatttcgatttggaatacgagtccagagactccggagatttatttatcacgttcacattatttgacgtcaaacgaggtggaatcatttatgattctgccgactcactgagaatagtaaaacagggacatcacacagcccacctacaattgcctctcaatttatttactaacggcgatttcagactgcaagctgccatgatgactccagatccagaacgtccaggtcatcctaagcaaattgcatacaccaatgaagataactcttgtttcttcgcaatccgtgaatccggacaccgtaatggctacggacttatcaacagcaaatcgctctcaatcataccaaggacagctatctaggcacattagaataaaataagggtgtataagaacgccttatacacccttattttatttagttatttgatgtttagcccatctgggcagtgcagtaattacaagccctattttgtaagtccatgaatctttaatccgctgcgtttctttttcaagaaaactattatcttgtttaagactcatattttccgcatgtagttcttcacttttgacatgcatattcgccaactgagttttataaaaaacctgatactgcaccaatgaatctcggcagagttcatactgattcaaattaagcaaatcaatttgattccgctgaagcagtttacaataatcatccattgagagagccacgaaccgagaatatatagattctaatgcttcgtagacatgattagaacaatcaccgagcatttttcgcagttcttcagaaataacaaaatgactagcaaaacggcgtatgtaatcatgagcatcattgtgcataatcgaacccgaacgaatacgacgtttatataatttctcattaattatgccgactctccttgccttaagaagaatctgtgtcataaaaagattgtcttcgaacaaaattcccttgtaaaacggagttttctccacgagcgtcttccggtaaaatgacaaaggcgcagacggaacaaaatgattactattaaccattgaaataaaagcatcttcgcccgaagaaacacaaatctgattatttatgcgatcataatactcatcatattcctcaatacggcgtttcgtcgattcctcatcccccatagcgtaagaatcatccgcaaagttcaccgcagaaaatgaaagaacgtccaaagcattttgatacgacaactcaacaaaacggagcaaggcgttttgcggcaggagatcatcagagtcaagaaaataaacatattcaccagttgctaatttaacaccgctatttcttgccgcgctaagaccaccattttcctgatgatgaacaacaacatgctgccgaatctgtttcaccgactcagcaattacttcaagggtcctatctgtcgatccatcatccacgacaatcagttcccaatttttataagattgttctcgcacacttgcgattgtctgattaatatattccgccacattataggcaggaatgactacagacaccaaaggtccgttattgtctaatttcatattccggtacctcattcattaccttgattgttcggacgatgtagcgtcaaatacttataatactgaacatgtcaaatgccaaagaacacttggtacaagacgcaatcgacaagaaagggaccccaatgccactcttctcggtgattattcctgcatataacaatgcagaatatctcggcaagtgtcttcaaagtcttcaaaaccagacttttcatgactgggaggcactcattgtagtggatggcagccctgacaatgcagcagacattgctacttcagtcgcttctcaagatcagcgtttcatccctttgataaaaaaaaataatgagggcacccatcttgcacgtaaaacaggtgttaagcatgcatcaggcaattacgcgcttttccttgatgctgatgacgagctcaaaaaaaatgcacttcaggaactcaaaatagctattcaagctagcgctccagacatagatgttattcatttcggaatggaattgttcggaatcgatatgccgaaagacgtgtgtaatggcatgttggaacaaagcaatgcgcaacttcccgatgcccacaacgaagagattattcaatccactttcgcagagaggaaacaagactggagagtattgcaacgcctctactcatcagatttgcttaaaaatgcttttgcaaatatgaccgatagtcgattaggacgcggacaggatgcctatgaatggttagttatatcaagctcagctaaacatgaaaccttccgcaatgacctgattctttaccgctactatcttggacggggaattacgaatgtccaaccaatctctggcgaaaaatggttaaagaacgcaaaggccttcaacgatggaatccaagccggatatcagtatgcaaattcttttaaatccttcgatatgaaaatctacgtcgatgacttaaaaaaccatcaactcgaattgctcatgaacgattggcatattcgcgttaacaatgctgaaaaaatatctgttgcgctgaagtcagccgaactcttcggagaagatgcaatagcagccgaactcatgcgcttagcacgcgatgacgcatactatctttgggatcatcaacttcctttctctgaacatgagccttttattcaatggattcgttgtgcccaacaattagtaaacaatgaaaatccttctgagaggtatcgttcattttcagaagcaactctcaatcatctcaacgatctcagaaatcgagaaaagcaatctcctcatattaatacgctgcttcagaaagtaaaacagattttcattcggtaaatatcgaaaatatcttaaggaaaatttatgcctaaaatttctattatcgttgccgcatacaatgtggaagaatatcttcagcaatgtcttaacagtctcagtaaccaaacattttcggatttcgaggcaattattgtcaatgacgccagtacggatgccaccgccgaaattcttagacgctccgcagaaaaagatccacgcatcattcctgttacgcatccacacaaccaaggacttcatctcactcgcaaaaccggtgtcgagcacgccagcggcgaatatgctttcttcctcgacggagatgacgatctcgctccggaaacatgtgcgcaacttgcagaagagataaaccagcatcccgttgacatcctgcattttggaatttccgtcataggtgaaaacggcatccttgacgatgaatgtaaagcctttgaagcattcaataacactcaaaccaagaactgcactggctccgatatcgttcgaaacatctatgccgaagctaatggccagcaggtagattggcgagtaacccaaagacttttcaagacttccttgcttaaaaaggcatttaataatatgaccagcaagcgtcttgaacgagctgaggacggttatgaatgtctcgtcatttcggcgctggcgcacacttaccggtcttacaaggaatgccgtggatatcaataccactacggccgaggtgtcaccggaacgaatcaggtcacagccagtaaatatgccgctttttgtcagcaatttagccaatgctttaacgcggcacaattgtttgcgaatcagaatccaagtcttgacttgcaagattgcgtaaatggataccgttggaaggcgaccgaattacttgccaatgaccttaatatccgtatagctgatgaggacaaggccgaggcgattcaagccatgttcgaaacgttcggcccagcaatcaccgcccgcgaaatctggcgttttacccgcgacaacgcatgggcggccattacatctaaagacaataacgattctctgaatcgtgccaacatgtggaaaagacttgcggacgccatcgatgttccggcaaccggcaacattgaaaacaaccgttatctgaccgtccgtcaccgtgccgaggaattgcttgcagatttggacacagtgcgcaataggcaaaaatatgccaatcagcgtatccgtattttcgtcactacacacaagaacgtcagcaccttcaacagtgccatcatgcagccggtgcaggttggtctgcacaatggcagctatcgtttcccgtgggcgttccatgatgacgaaggagagaatatttcaaatcgcaatccacgttactgcgaactgaccacccaatactgggcgtggaagaacattgacgcggattattacggattctgccattatcgccgctatttcgatttttccgaaaccgtgcatgaggaaaacgcgttcggagaaatcatggatgactatatcagtgtcaagactgcgaaggaatacggtttggacgatgataatatcgcccgcgtagtcagacaatacgatgtcatcacaactccatttggcgatctggatgaaatcatcaacaagtatggaagtcctcgtgctttgtgggaggccgctcccctgctgcatgatgacgatttgaagcgctgctatcagattctgtgcaatatgtatcccgactataagaaggacgcacaggatttcttcaacggcaataaggcgtgcttctgcaatatgttcattatgaagaaggagatcttcttcgattattgtgaatggatgttcccgattctcgaggaattcgacaaaaacaccgattacagcacgtacagcaaggaggcgctgcgcacgccaggtcacctttccgaacgcctgctgaacatctatctcatgcatcacaagcggatcggctccaactggaaattcaaggagctgcagtgcgtccacttcaccaatccggagccagcggagcagctcaagccgcttgacattaccgacaagccaatcgttccggtggtgttcgcagcggatgacaattatgttcctcaattgaccaccaccgtgtattcagccatgaagaacgccgatccgaactacttctacgatgtgacggtgctgcagcgcaacatcgcatgggacaagcaggaacgtctgcgcggcttcttcaagcagttcccgaatatgaatctgaggttcaccaacgtggaccgcgaacttgctggctacgatctttccaccaataacgcccatatcagtgtggagacgtattaccgcttcctgattcagaaggttctgccgtgctacgacaaggtgctgtatctcgattccgacatcatcatcaacggcgatatcgcgaagctttacaacatcgatttgcagggcaagatgctcggcgcgattcgagacatcgacttcctcgccaatctcaacgtgaagcacggcaaacgcatgggctacgcgcaaaccgtgctgaagatgaagaatccatacgattacttccaagctggcgtgctggtgctcaacaccaaggcgatgcgtgagcattacaccatcgagcagtggcttacctacgcctcgaatcccaatttcatctacaacgaccaggacgtgctcaacgcgcactgcgaagggaacgtgatgtatctgccgtgggaatggaatgtggttcacgattgcggcggccgcgtgggcaatctcttcacgcaggcgccgaacgatatctacgacgcatatatgaagtcgcgtagcaatccgcagatcatccattatgccggcttccagaagccttggactgatccggattgcgatttcgcctctatctactggaggtacgcgcgtgagaccccgttctacgagcgtttgctcaagcgtgtggtgaaggcgaacgaaccggaaatcccagaaggagtattccgcccgcaacatgagcgcgcagtcggcgagaacaatccgattcgcaaaatcgtcgatccactcatgccgatcggctcccgtcgccgtgatgtggtgaaggcaatcggacgtgtggttcgtggccgtcactgaagcacccaagaacacactttgcggttagttttcggaaagggtatggtcgcgccgagtaaattatcagtcctcagataaaaagcctcatggggcatgaccatattcgttccgtttagcggcgaaagaagttccgttaaactatttcaacggcatcagctgctttatttttgcaataatccacttgccgatgtataccgcgataccggtaagcgcatagaccacaatggccttgatgaacggatgggtctgtcccaatgtgataaaccctccgatcggcccgcacagagtgagattcacaagcagcagatggaacatatacacgcccagcgagacgctggatactttacggatcatgagcttcatcttgtcggaaccgcgctggaaaaacggctccagcgttttgcaaagcataaatagcgacactgccgatgtcacacatagtggggaagaagtgccgacaagatagttatggtactccgttcccatcgttccttggaaaaagccgttccagcacaatcctccaaggaacatcaatgccgcagacccgacgaataaacctgcccaagccggagctttccatcgcaccggcaagccataattctccagataatatccgagcaagaaatacaacaaggcgctggacgagaacagcggccagctcagcaatggactgaaatatttttcattgatgccaatggccttcgccgctggaatgagaatcgaacagaacaacgtcaatgcgatggcatattccatgagacgacggtcatggacgattttcgaaagcagcggagtcagcagatacaaataaatgatggaatacaggaaccagtaaatatcgataatagagttggtaaggaatcgcttgcagaaatcgacaaagccaaagctgtcggcgatcgactgcgctccgtagaatagattggggagcaggccaaacaacagatagcatgcgatgcttcccagaatcagcgctcgccccacccgcacgaaacgttttttaaaaaacactttcgtcgaatatttcttccgataatccagtaaattcataccgctgaccatgaagaaaatcggcaccgcaaaaatgaacaccgcctgcatcagctcctgaaatgcccataaccgggttctctgaggagaaaacacacccaaagatgtgtgtaagcagaccactgcgaaacaggaaatgatgttcaatacatcaacaaacacaaaatgcgttctcgctttgccgtttttccgttcactcgcaaagccctgttctgtgtccaacagttccgctgtcatcgactggcgttcccttctttctgacatacgcacttcagcataacaaataatgacgtcccttcttgacggaggactgcgagcctgcgtccgctctcgcccctaggctataaaagcaatgaactcccattgacgtatcgaaagatcaagcatggcaaatagattcaggagcagtcatatctgcgttgcaaaacggatccgcaccggctcatttgtccgagtgctcaggaaccctttcgcgattctacttgcctttattctgttattcagttgcgcttcagcaaacgctgcggaagacaaggaaacagatcaaaacgggagcaagttgactttgccaagctatgtgatggacggcatggttttgcagcagaacaaaatcaccaccctgaacggttcaacagcaaaatccatgtcagggaaaaccgtttcagtcaccttacgcggaggcaaaaaccaatataacgcttcatcaagaatctccaaagccggaacgttctcggttcagctgcctaaaatcaaaggagcgcttacccaatacaccatgaaatttacggtagctggcaccgtagcgaaaaccgtgaatgatgtatacgtcggcaatttattcatcgcttctggtcagtcgaatatggaaataaactataacgactatttcgaaagcgattcgcttttcaaaacaagtacttccttgcactacacacgcaacgatattccacgcaatatcaatgacaaatatgtccatttcctctcaccgaataaaatcctcgacacaaagaattatccactaagagatttcgaaaagaaatcctggcttacagccacaggagatgacgtcaactatcttggctatattcctcaatattttgcgcaacgacttcgtaaacaatatccgaatatacctatcggattcatccaaaccgcttggggagggacagctatatctcaccatataaaaggcggagacatctataaaagtcgtgttgccccattacagggacttggcgtggccggtgtgttatggtaccaaggtgaagatgattccggatcgatggatctggcattacgatatgacatttccttcgccacacttataaatgattaccggaatctatttgatgacgctacattgccgttcctttacgtgcagcttgccagatatgacggctacggttacatctatgacaccatcgttcgtaatgcccaattgggcatgcttaacaatcccgtcattgaatcgcataaaaatcttggcatgaccgtctccatcgacacggacaaaggaacgtcgaaggcaatccatccactcggcaaggaaatcgttgcccaacgtatggccaaccaatggatcgccataaacgagcgcaaagcagtaccatctggcccgttacccgaggaagcacatcttgactcagacgacaagtcaacggccattatcactttcaaagaaggcacagccgtcaagctgcaagcaaagcaaccgaattacacaatcagtgcaacaatcgacaatattgcaaatgttaccaacactccgctgtcaggattccaggtcgccgatggagacggagccatgcacaacgccaccgcaactattactggcaatacacttcgtatccactccgacgaagtgaaacgtatagctcaaatccaatatctatggcaaagcaatcccaactgttcaagcattgtatataatgactcgaacttgcctttgagtccgttcactctcaacgtgaaccaaaaaacttattcgcactgattcccttttcttgttaaggagagcacaacgccaatcatcatcggagcaaacaataatgtgtagaacatatatcttgtaggattaccatgcccgataaagggatttggacattttccgattcaatcttagggacaggtattacctgataatggccattgcattattatttcagtggccgttcttttgcctcaacacgatgcggctattcatcaggaatacgttttgcagtcgtcccagaagactcagacgtataattatccatcactgaatggctactccgaaaaatatctttttttatacttagcataccgaacattaacggcgtcatgataatcatcggaagaacataacgtatgccttcaacggtcaccgtcgctggcgaaatccacaagaaaagaaaagtcgcgatatatggcatcatacagatccaatttttgccgcggaatcgtctaaaccattcatatataacgaacaagaacatccaagtcgaccatgtagcgcgagaaaaaagcagatttagcacaggaagatgttcaagcttgtttattttattttgaacgatggtcacccgattaatgttacctcgctctattaatcccatttccttggaatacgcaacacttgtatgattgctgccggttaagaaaacaggcaatgacaaatcctcaggattctgtgcactccctaaagtgggaacgcctaaccatccttcctgcaaagccacataggcctcaacatatgtaaaagggtgctccaataagccgcggaaccatgctttcgcatattgcgcaagatactgattctttctggaatcccaagtgtagcctttgactccatcagctgcccaccattggtatttatcagcgacatcatttcccaatatcttgtgaatgacatccacatcctcagggttcatctcacattcatgtcgtttcacctctaatgctgactgttgaaatggaacagcgagcatctcctgttttccaccttcctgaatgtggaacatgggaaaaacaactttcggaaccaatacgcccatgacaagcagttcagtcagcagtacagccacaattcgaaggcgatactgacgaaacactacaaacagcaaagcgatgcagcagataagcactatgtacaaaccggttttttcgttaaagctgctagtacagatagcgaaagaaatagtgcaaatagccatgggctcttaagacacgcgcctttgctccgtacgatctgcacatacagtaccgtgtaccagacgaatagcggcatgaataccgtatctttgacaagacttatagaaaagcaggggatgaccggggaaaaacgaaaagaacatcaactgcgcaaagcaacaacgccagcttgcgccaatatgccggcaatacaagatgaccgtcgccagcgaaagagcagccgccaatgccaaaacgatagagcataggaataaacctaaatctactgatccaagcaccttgccgagttgggcgaatgcaccaaaaaataaagtgtcaaatacaggatgatggttggaccaaaaactaccatcggaaaaaatattcgactgatggaaccattgcataagctgctcgcccgtatcgaaccataatattcccggatatgttaaccaaatatatggaatccagcacagcacgatgaccgcagttgtcaaaaagaactgtttatgtccccaagagaaggaaaagcaatcacgtactgaggccatccgttcagcagtcctatccccatcttttgaacaccaagcgagaaaccgttccccaataaacacaaaggcaagaaacagcagcgcaatcgctccagtgaaccacatgcatcggaatgagaacacaatgtgcccgtgaatacggatagcatcaacaatcgccgcagcaaatccacataatagtgccaacgtcacaagcgctatatgcttcatagataaaacacgtgtaattgacttttctttgcgcatgttatgtcttccttcacattgcacataagcacatcgcaatcagaatttggataaacacgaataggcatggtctaacttaacctgcgtcatacatcatgcccactcctgattacttctcctcatgatattccttgtcggtattcacgttccagacatttttcttatccgcgcggccggtcttgatgttgccaacagcttcaaaagcagtcaccatggaatgatccatgttgttatatctatgctgtccattccgccccacgcagtacaagttttcaaaggagtccagccacttaaccaaatcgtccatctgataccaagtatcgaaataggccggatacgccttcttcacacgttcacgatgagcgtcttgaatgtcgttcttcgatgcgataattcccatcttcacaagttcattcgcagcaaaatcaatgcattcggcatcagacatattccagaagccatcgccctcattacagaagtactcaaggccaatccagactttattgtcaacatcctttaccaggtatggactccagttgttgaacacttggatgcgaccgaccttcacactcgtatcctgcacataaatccaacaatccggaacaatcggaggattgcctaaggtaggaatatcggtctcattcttaagattcaaatgatcgacaaggaatcccacagtcacgaaatcacgatacggaagaccatcagcaatctgcttcattttgacaggaacaggctgtgtggattgatttccatcagcaatggagtcaaccaaatctttcaccggcatagaggaaataaattcatcgcccacaagtgactgctcattgccatcaacatcgcgatacacaacagaatcaatgcgaccatcagatgtttcattgattttcacgacttcggcatgcttgatgatatgggcaccgaactcctcgtcatgtctagcgacggtttcccaaagctgaccaggcccatacttcggataccagaattcctcaatcaaggaagtttcgccttctccggccttcttctccttaccgatgagcttattccacgcatccttgagcacggccatgatgctgatgccctttacacgctgcgatccccaatcggcagagatgacagacggatgacgcccccacaacttctcggtatacccttcgaagaacataccgtataaagctttaccaaaacgattgatgtagaagttttccagattgtcttctggaagtttatgcactagagacttcaggtaggagaaaccaaccttcatagtctggatgaatcccatattcttaagcgtctgcggcttcagactcactggatagtcaaaaaacttaccatgccaataaatacgcgaaacgcgatggcgcttcagcattacttcgtcggttttttccggatccgggccgcctggttccatatcatgagcacggttgagctttttatcatcgtatgaaggtgcaccttgaagagggaggatagtcttccaccagctcatcacacggtcatctttggaaaagaaccgatgcccgccaatatccattcggttgccattatggcgaaccgtgcgagaaataccgccaaattcgccagatgcctcaagaacagtcacatcgaactgctcagagccattattctttaaaagttcataagcggcggtaagaccagccggaccaccgccaataattacaatagtttttctcgccattattcaataatccttacccgcattggcgacagtcttcataccatcacatttggcactgtactacaaggataaaaacccacaacaatcaatatacgtggatcacccctttcatacatttttcataccaaatatcatccaaactccgttctttagaaaccgaattcctagtttcacatatccgagcataggtatcactcacacttgaataacaacatgctccttaaaggcatcattgtgagaccacatatcaccatcctcacaatgctggtgtcaatatccgctgttcaactctcttatttgcaatgaggtaaaatccgggcaccacgaacacatcaatctcaaagtcattgcatactaagattatctgctatacgatttgcagtcatttgacttacagcactcgttccacccacgatccaagccttagttgtttttccacggaacttcactgaatacgacactgttgaattactcgaactatccaccagaagcagcacactcccattacggccagccaatggacccgcagtcaatgcgtcaggaaagttcaaacctgcagcatacacgatagcatcctcacgaagaccattagataatcccccaatcagccaccgccatactcgtttcataacgtgttgcaccagccctacgaatcacacctggcaaatcctgaacgaagcgggatggaaccgcattctctccacctacaaccagtacacgtttaaaattcttcaacgccacccgttgttcatcagtcaagcctgtaactggatcgcacaaaaacaccggcgctttctctgcatatgcatagggactcactgataatgcatctggataatttgccgctgacactacaatcgcagtagatccccaagcattgccaccatctcggtataatgcggatgacgtatccgtacgtgttgcacccgctatacgacttacctttgaacaaataccctgcaatgaaaccagcacattgcccgatatcactgacagaccacctacgacaataattctagagggcctcagcgagcgaatttgttcagtggcctgaggagataatttattaccctccgtcaacacaattggcgcaccatacacacccgctaggccagaagcagacaaagcatccggatagttctctcccgacgctacaatcaccgtcccaccagcgctccaagcgccctccgagacaacagacaccatcgtatcgtaacgcgtactgccagccagacgctttatcactgagtaagtcttattgccaaaggcgctcatatccacattgccgctgatgccgttgatctggccggagctggtgtattgccagccacgatcgttagtgccaaacgccgtgaattccatctgcggaccgtattgcgccacccaacgggtctttgcgtagatgttcgaattgttcaacgggccttgcaggtagctcgtatacgaatacacaccgagattcttgtatccggcggactgcagtgcgccataccaggcgtcggccataccgctataaacattcggattggtcggcggggtatgaccagcccacgtccacttttcaaggtcgtaatacacagggtatttcagatcgttcgggctcacgcccatctggcggagtttggcagccacatcattgccttccgcacgtgcgcagttcgcatcgtatgcatacgaataccagtagatgccaaaaggaatgcctaaacgcttgcattcattgatattgcgttgtgcttgcttatcagcactgttgccccagccatagcccaaacggatgattgcaccttccacaccatcggctttcgctttgacccaatcaatgtcgttctgccatgaagaaacgtcaatcacgcccttggcttgttgaacgaacaggttgttcctataatcgaaaaacgcctttgttccgttgtaggttccccagtgtgctccgtattcgttgctctcgaatttagtgagccggacagtcgagccacccttcaaggacgactgctccacagactgtttcacaggttgttccacagcatctttcacatccgaggcactcaccggaatgaatgattcgccatccgttttggccagtggatcaggttgctgcgattgcgtgccgaccagctgagcgtccgtcacggtttcgccggtctcaatgttctgcacatcaccttccggcgtaaccgcaaggttctccgaaaccacagtggaatcgtccgaaatgttttcgcttaccgtttccggcagcgtcgcgttcggattgtccggcatgctgtttgacgaattctgcacatcatccacagttgcggcaaaagaacttggcgcatcctcaatcgcaatatcctgcatggcgtaagccggcaccacggcaacggaaaccgtcattgcagccacggaagcggtggtcgcaatcttcattaagcttttcggcgatatcatcgtcagcctctctcacaaaacgcattttcactcgttgacgcaattgcacacgcaaaacttaagtgtattctgagatgtccccacttaaaataaagcagctggattccaaaccaaacttcacatttaccgaatatgccacaacatgaagtgctggcattcggaagtggaacgggtaacataccttatgtattgtcatttgggaacagaggaccttgtcggaccacctccaatagacaacatcaaaacggtatcgcggactcctggagggaagcatggcacggcacgaaaggcagccaaataaagctgacagtcaagcaagtaacgtccgcaagccccggactttcagcagtaccgcgaccgtcgggaccagcaaatccaacaattccgtcaatgccaccaatcgtgacgaaaagcttagaacaaaagcaccggggacttcctaccgaacggctcccgaagatccgttccaaatggccatattgcaaggcgtgcaagatggcgacacttgggtacataaccatgtcaagaacttgattcgccgttccatcatcgtagccgttatcgtcgttgcggtatgcattgtggtcttcggcgtcatgggcgtgagaacatcgcagaaaatgcgcgaactgaatgccattaacgactgcagagacgcggttgccgccatgaacgcttcatattccaaggatttccagctcaagggaaagattgtcgacgcattttccagcatggattcctcatatgatctggaaaagctcagcaccttgtatcaggaagaagtcaaatcgccgaaggcgcttgactgcaaagccgacccgtccgggaccaccagcaaagccaacaccgaacgagccgcatatgacaaacaggccagaaccttcgagcgggcgttgacaaagaacgaggcaaatcagaattgaatacgaaacgattggcaagaacggcacttgccgttatcgtaaccgtaggaatagtcgttgccatcatcatcgggtgcggccccaaatggggcaacggaacggcaaccggtaaaaccggatcgcaatccaccgccaccgcccatactgcggccactgttgatgtgcagctgccctcatactacatggacaatatggtgttccagcgcgatcagccaatcgtagtcaaaggcaacgtcagctccacggaaagcaaccccatcgacatttcgaaactgtcagcgacacttacgcaaggcaaaacctccgagagcgtcaaggcaaaggtagcgaaaaacggcagtttcacctgcacgctgagcgcgcaaaaggcaagtctcaatccgtattcgctgcaagtgcagtacgccggcaaaaccgtgctgaaactggccaaagtgtatgtgggagacgtcttcgtagccgctggccagtcgaatatggaactcaactatgtgcagtattacgaaaacgctacttacaattttggcaatggactaatcacgacaggcgatttgccgaaaccgctcgtagatgacaacgtgaaatttgtcatcgcaaatcatgatgttgaagacactgattttccactgtccgctgttaatcagagcgccgatgcatggctgactgcagattccacaaattcactgcacctcagctatctggctcagcaattcgccatgcagttgcgcgccaagcaccccaatgtgccgattggcatcatccagaccgcgtggggtggcacgcctattcgccggcatgtacaaggcggcgatatttatgcgaaccatatcgcgccgttgaagggattccatgtggcgggcgtgctgtggtatcaaggttgcgatgacgccaataattacggaactgctttgcaatacgaatcgcaaatgaccacgctcatcaaccagtaccgtaacgtgttcggacgcaaggacctgccgttcctgtacgtacagctcgcgcgctggccaaactaccagtacacgcaaaacgtgcgagaagcgcaacggaccacgcttgacaacgcgaatctgcgaaaccgttccaatgtggctatgacggtttcccttgataccgacaagggcacatcagcgctgatccatccgcttggtaaggatattctcggggcgcgcatggccgcgcagtatctcgccatggaagacggcaccaccgtgcccaacggaccgcttatcgaacatgcccggcacactgcgaacggcgcaatcgccttgtctttccaaaacggcaccgcaagcgggctgaaagccatgcagccgaactattcgaagaccgcgagcgcaatcgcaccaaactataagagcgctccgaaagcgaccccgttaagcggtatcagcaatatcgccgctcccaccactacggcattgcaggggtttgaggtcgccaattattccggtcaatggcaggcggtcaatgccactatcaggggcaatcaggtgttgctcaccgcagccgatggttcaatactgaacgatctcaacgccatgagccaggtacgttacctgttcagtggcaatccgaagtgcgcgagcatgctgtacaacggctttaatctgccggctagcccattcatcactattgtcgagtgatctttgttgggggccaccgctagataaaccaatacgggcgggataagtacgggcggtctaagccgttgcttggcctgcttggtcatgttttgagcaggctgttccggattctggtttggtttctggtttcctgcttaaactatgaagactgctgcagcatcgcagaaactagacaaatgtcatttttccaccggtttatttaggcacattcccctcctactatggcatacggaacgaacgcgagcgcacaatcacagatcgaatgcaaacgtgcgcaggagaggaaccaccatgaggaatcgtattgcagcagctgcagcggcgggaatattaaccatcggcatggccgccttgccttccgcggcttcggccagtgaagtcgcaccgtctacggacggattggccggcagcaccgccatcagcgggcagatcgaccaggatatggccgtgtgcaccgacaaaacgtgcgatgccgtacagcatgtgcgcaaaaccaaccagcagatcaagtcggacatcgataccgccaagcagcacgccgagcagctgcatcagaacgcgcacgaggacgccgatgcgctccgccagtacaacgagcaggcctggaagaactaccaggaggaccgcgaggatataaagaatgcgattgacggcgcggtcaagcgcggtcaggagcgtcacgacgctctgcatcaggatatgcaggacacgcaggcccacctcaaccagatgcatgccgatatgaaagagactcacgacgagcttaaaaccaagcatgatgcgttcgcggcgagcagccaccagtggcatcagtcgttcatcgcggcgttgaaggatgcgaattccaagacgggtcagcagggcggctcatccgttgctaccgacacgcatggcatcacggctggaacgaatgccggtacgaccgttactggagtcaacggcaccactggcactgtgcgcacggctgccgacactggcgcgaatggtgctgcaactggatccgtcatagcttccggcgatcaaaccgccgcgtccaccggcgcgctgaccaagtcggaatatgggcagcttgcgcaaaccggcatcggcatttcccttgcctgcgcagccattctgctgcttgccggccttgcctacgccatgaagacgttcgtgcagtataagcgcgaaaccagcgaagactgagccggctcgctgccggacagcgtttgcttcatcgactcatgaaaaaacggtctcgaatatatcgggaccgttttttcatgcgcgtttttcatatgtgcttttcatctgctatacgcattgttgcgattcaattggaatgacgtagtacagcgacgtacaatgcagcgcgaagcgcgcgtaccgtgcgtgaaccgcgtgtatgtccagtattcccactgatttgttacgttggccgttctgatcagtccactggtcaattcgcataatggggagcactgctggcgattcgcggcgacggcgtatcgccattccccgccgtccgtccggtactacccgcgctccccgcatcgccggccttttcagcattgccgatgttggttctacgcaacgaccccgcggccaacgagcggatggatcgcctgcgctgcgcctgttccgtctgcgaagcggactgaactgcgggaaaagcgcccgttacaggacgaatacgaccggttgcggtcggaataaagcttggtggcaaaacctgcgttgtgatggcgcttatggatgccatctgcggctgctgcgtattatcaggaccatccgcagcgtctttttctttcacggtttgcgattcttccgcacgattcgcgtcatcattcgcatcctcgcccgtttgcaaggcagacccagcttcgctctgcttttcttgtttttcctgcttttcctgcggagcggcctgcacatcactctgcaatacgattggcgatgaattcgaacggcgtcgggcaagcgccgccagagagtcacgagtatcagcatcgcgttggtcagtctgctggctgccggcagccgtcttgtcaaccatcgtcgtgcttctttctctcaacgtcacgatttcgagcgtaacgtagcgcagcgcaaaagtgcgcgtaaaacgacgatgtacgcaactcccccaccgaatcgcaatcaaatatcgacatatgagggcaaacaatcccattattgagaccacagactggcaccaataagccgcagcatggcaatcagagactttcctggatgccggcccgtacacgcgagacttgcgatacgggacgattcaaaaaaccgaggccaacgaaagaagcattcggagggaatctggaaggaaccggaaaacggagtggaaaagaaggaaccccagaaaccgaatgattccaacggtttccggggttccaatccgggcggagaatacgagattcgaactcgtgaggctgttacaccaacacgctttccaagcgtgcgccatagaccactaggcgaattctccaattatgcaacgctttccggtgtctatccgttaagcgcaacttgactagaatacaacaggaatggcagaagaccaaatcggcgtgtcgcactgctggtttgcagagttgggcatacgtgtcaaggttgtgcaacaggtatgagcgatcggctgcctttactacagatacttcttatttcgcacactgtagatgctatattgccgccgatggaatccaataggcaacgggattcggtaagcatgggaaaagatacgaaaaaagggttcccggagcatatccggtgggaattccagggaacataaaaaatgggcctcccgggagtcaaaggctcgaccgggaggcccgatacgtgtgaagcggcggcgtgctactctcccacaccctctcgagtgcagtaccatcgcccggtggtggccacgttggcgatggcgtacagcaggtaggacagggcgacccacagcagctggtcgttctgggcgagagccttgaacgcggcgagtggaccaccgttatcttcggccttggcgcgcagggtgctggtgctttccttggtgccgaacgcgacggagcacacggtgaggacgccgagaatagccacgatgatggcgaagcaggtccagccactttggctttcctggtgcttgccggtgaagacatagctgaagtaggtgacgatcgggatgacgacgatagtcaaaccgttgtaaccgatggagccgccgaaggaaccgagggcggtgtaggtggagcgctcatgggagtcggaggacagcgccggaatcatgccccaataggagatgtcgcgcagggagtagaacacgtcgagcacgatgaaggtgatgacgaacagcacgatgaacagcgtggtgttgacgttcaccaagccgaacaggccggtgtagaccagcacgagtagaacggcggaaacggtgccgccgatgagctgccatggcttgaaacgaccccacttggtcttggtgttatcgatgatgttgcccagcagcggatcgatgaagatctccgcgatacggatgacaaccacaaggccggtgataacgccgatgagcttggtagcgagcgccttgtcaacgccggagaacagcgagctggtgacgtagacgatgaagtaggtgctcagcgcgttgtagaaggcggattggccgacgttgccgaatgaataggccacgcgggacagcagactgcctttcctggttggcttcgcagactgctgcgtctccttcggtgcggctgcgacattggattctgccatcgtacttctccttagaagttgtgattgaagctgtaatcggaaatcatcatttgatttcgcatgagttaagtatatccctttacccctgtttagtaaaatttaacatctgcgttgtgcactattgggcgtgtcgcattttgtgcgattctgcacatatacatgtcatattgtgtgcgattcgcggtatttcgccgacagtagacaaacaaaaggcgattgatgacgcagcatcatcaatcgcctttcatatttttccgcacatacgtacgctaggcagcccgtttcgaccgggcagatcgcttcgatcgggtctgcaattttggccgcgattcacgtttcggctgcgccggcacgaaactatctcgcacttccagcgtcgtcgacaggtacgcatgctgccgtactgtgcgcttgctggcaatcgcatcggccaaggtgagaatcgcaacgcgcgcaagctcgttctggtcgattgcgaaagtgctcaacggtggcgacgtaagctgtgcgatcgtctggttgttgatgctgatgacgctgatgtcgcggggcacaatcacaccaaccgcgttgaacgcctgcagcacgccgaccgcgatgatgtccgccgaaacaataactgcgtcaggcagtgcgccgttgtggtcacggataaactgctcccccagcttgcgaccattctccacggtgaacaagccgtcagaatacaccagtccacgcaggtcgagaccataacggcccatttcacgccgaaaatatgtggcacgcccctcttcgtccacctcataaaaattcgtcagcctccccttgccgccgatgaatccgacacgcttcatgccagccttcgcacatgcttcgaccgcgtcatgcatggtctgctgtaggtcgggctgcacggaatcaaacaggttcggtgcgggattcacatcgatgaacacaccgtatggcatgacctcatgcaacttctcaaggtcgctttcggctatgacattggcgccgatagccatgaaaccatcgaatttccccttctgattcaacatctcgtcaagactgtggaaaacagtgagctccatacgctgctgtttggcgttatgttccagcgccgaacgcaaatcggcaaaatacgaatcacgcagcgtttcgtcggactcctcgttgtccaacaaggctacttcgtgcggaatgacgatacgcttggcctgggcgctgtatcccaaatcctcgctggcgcggatgatcgcgcgacgcgtctcctcacgcaccgacagcgtcggatcgccattcaacagacgcgacaccgtggcctgcgaaaatcccgtacgtttcgcaatctccttgatggtcgccatcgctccctcgccctcccatggatgcctcatcagattttagtaaaagcattactaaatccatcatattacattaccgaacgtattcttatagccatgacacagccagagcaatcacggaaaccgcgaatcgcgcatcagtccacggaacggatgaacgaactgcgtgcacaacaaaaatcctttgccctgcagaacatgcggagcaaaggactcggcaacgccggtctgcctttcaaagcgaccggtcataaaggtggcatcagtcggcagggttccaaacgcggctgacaccgtggagaaacgcggtcaccgtcagccccacgggcctgcggctggaagcgcccgcccttctgcgtggccgacttgccatgtgagccacccctcgatgacgccacgctccgcatcggttctaccggacgcgtatacatcaggcctctccccggtgatgctgcggatggaaccatgcacatatccacatttttcacggagacggttgcggggctgctggctttccatataccgtcagcgcatggaaagcttcggacacaatacatttttcacattagagcaggcacgggaggaggcggcgagacggcatcttgaatgcaggcaggtgttgtcgcggataaggtcacgctcctcggttccactctatgtaagccacggcacagcgctggagctgcatggcatgattgccaccatgaattatttacccggatatggttcggagctcgttcacgtttcggtgtgccggcaacgtgacctgcggaaaatccaggggatgaaattccattacgcaaggcatggcgtagacgtggcgcacgccgacgaattggtgtcaagcgtctccgcgatgcaggcggtctgccagattgcgccctatgtcgacgaacggagtctggtgatcgccatggattggctcacttgcgccaatcccgatttacgcgtctgcactcacgatgagctctccgactacatccggagtgcgccgcgattcattgggagcgccaaatgcagaaaggccttgcgcctgtccaaaccaggtaccgattctccgcaggaaacggtgcttcgtttggagagcgatgcctacgggctgcctgaggcacatgtcaattatgagatcattgaccacatacgcggctcgggcacgatgaaggtggatatcgcctacccggatgaccgcgtctgcatagaatacgacggaaattaccactacacccatgaccgctggatgtatgacctcgataagcggaaccggctgagggatctcggtttcactccttttgtcgccacccgcgagcatctggcttccaagcagaagctgaacgagctgttcggcatggtcgcccgcgcaatagccagtcaccgttacggcttggactagttccgtaggtggtttttcgcttccgtaggtggttgggtctgaatacccggcatgaaaacggccagaataaagcctttctccaaccccgatactctgaccaaccacctacggaacacccaaaccgcctacggaaccgcatgagtagtccccgcaatggatttttcgccattgattcggggaatccatgaaaagccacagcgggcgcaccctgcgtaaaaggtcatgcccgccgattcatgggagccatatgcgcaagggccgtgcggaagccacatatgtggcttccgcacggcccttgcattcgttgaacactaccgttcagcctgtccaattcgccaagaacgggacaggaacgaagcagaaggagccttactccagttccacggcgcccgtgtacagctggtagtactcgcccttctgcgcgatgagctcgtcgtgcgagccgcgctcgatgatgcggccatggtcgagcaccatgatcacgtcggagttgcgcacggtggacaggcggtgcgcgatcacgaacacggtgcgtcccttcatgaggttgtccatgccggcctgcaccacttcctcggtgcgggtgtcgatggatgaggtggcctcatcaaggatcatggccggcgggtctgccactgcggcgcgtgcgatggagatcagctggcgctggccttgggacagaccggagccgtcgccttcgagcacggtctggtagccgttgggcagcatgcggatgaagctgtccgcgttggtgagcttagcggcggcgatgcactcctcgtcggtggcgtcgagcttgccatagcggatgttgtccatcacggtgccggtgaacaggttcacgtcctgcagcacgatgccgagcgacttgcgcaggtcgggcttgcggatgcccttgacggagatgccgtcatacaggatcatgccttcctggatgtcgtagaaacggttgatcaggttggtcaccgtggtcttgccggcaccggtggcgccgacgagcgcgaccttctggccgggcttggcgaaccaggtgatgtcgtgcagcacgggcttgtccgggttgtagccgaaggtcacgtcggtgaaacgcacgtcgccctgcagcagggtcaggcgcccgtccggcgaggtgatcgcgttctcgcgcgccttcctcgccacttccgcggccttcgggctcagcgactgcgcggccttcagggaacgggtgccgtcgtcgccttcctcacgcttccaggcccaatggccggtttcgtggtccacttcggtcatggtgcggccgtcttcgccgagctcgacgttgacgagtgtgacggagccgccgtcgtcctcgggcttctcatccatcagctggaagatgcgggacgcgccggcgagcgccatcatcaccatgttgaactgcatggagacctggccgagcgggttgacgaaggagcgcgacagggtgagcagggagatgagggcgccgagggtaagcttgcctgcgccggcgagaccgaagttgcccatgccggagagcgccatgaatccaccgacgatggcaagcagaatgtagaggatgtagcccatgttgcccacgactggcatggtcacgttgccccaggtgttcgcttcggcggaagcgtggaacagttcctcgttcttctcgtcgaaggtcttctgggtggcgtcctcatggttgaagaccttgatgaccttctgaccgttgacggattcctcgacgaaggcgttcacatcgccgatccacatctgctgcttgacgaagtagcggccggagcgggagacgatggcgcgcacgactacgaacaggatcgcggcgaacacgagcacgaagatcgtgaccggcaccgacagccacagcatggagaccagtgcggccagtgcggagatcgcggacgagaacatctgcgggaaggactggctgatggcctggcgcagggtgtcggtgtcgttggtgtagcggctcatgatgtcgccgtgctcgttggtgtcgaagtagcggatcggcagcgtctgctggtgtgcgaacatgtcgtcgcggatcttcttcagggtgccttgttcgacggtgacgatgagccactgccacagccagctgcagaaagtgccggccgcgtagaggcaggccatcagcgtcagggcgcgcagcagcgggttccagtcggggttcttcacaccgaccagcggcaggatgtagctgtcaatcagggattgcaggaacagcgcggaaccggcttgtgcggccgcaccgatcaggatgcacagcacgattgccacgacatgccatttgtattggaaaatgtagccgaagatgcgcttagtggttcccggcgcggctttctgcggtaccttcggtccaccgtgcggcacggcatcggggcgcttggctttgttcccctcctgcgggtgcatgccctgcgcggttttcttattggttgttgcactcatgtctgtacctcctttcactgcagttcctcaggctgggcctggttcttggtctgcgattcgtagatggaacggtattcgtcgcaggtccgcagcagttcctcatgggtgccggatgcggtgatgcggccttcctccatgacgagaatcatgtcggattcctgcacggatgcgatgcgctgcgcgatgatgatcttggtggtgtcgggaatctcgttgtggaacgcctcacggatcagcttgtccgtcttggtgtcgaccgcggaggtggagtcgtcgaggatgaggatcttcggtttcttcagcaacgctcgagcgatgcacagacgctggcgttgtccaccggacacgttggttccgccttgttcgatataggtgtcgtatttgtcggggaattcctggatgaaaccgtcagcctgggccagttggcatgcgcggcggatttcctcgtcggtggcgttcgggttgccccagcgcaggttgtccgcaatggtgccggagaacagcacgttcttctgcaataccatggcgacctggtcgcgcagcacttccatgtcgtagtcgcgcacgtcgacgccgccgaccttgagcgaaccgtcggtcacatcgtacagtcgcggcacgagctgcaccaggctggacttcgccgaaccggtgccgccgacgatgccgacggtcatgccggaacggatcttcaggttgatattgtcgagcaccggcttttcggagttatcagagtagcggaagtcgacgttgtcgaattcgatggacccgtcggccacttccttgatggggttggccgggttggtcaccgtgctttcctcgttgagcacctggcagatacgttccgcggacgcctgggaaatgatgcacatgacgaagaccatggacagcatcatcatggccatgaggatctgcatggcgtaggtgaccagtgcggtcaggtcgccggtggtgagccccagcgcggcattattgcccgaggccacgatctgcttggagcccatccatgcaatgaggatcatcgagacgtatacgcagaccatcatgagcgggttgttgaagctcatcacacggtcggccttgctgaagtccttgtagatgcgctgggagatgcggccgaatttggcgatttcatgcgattcgcgggtgtaggacttgaccacgcggatgccttgaaggttctcgtcgaccacgttgttgagcttgtcgtaggtgtggaacacgcgctcgaacaccgggtgcacgtacaccgccagaccgcacagaccgaaggcgagaacagggatgcacgccaggaacaccaaggaaatggacgggctgatgcggaacgagaagatccacgccacgatcatcatgatcggggctcgcacacccagacgaatgatcatggaataggcgttctgcaggttggtcacatcggtggtgagcctggtgatgatcgagccggtggagaaccgatcgatgttggtgaagctgaagccctgcaccttttcgaattcgtcgtggcgcaggttcttggcgaagccggcgccggcgatcgcggcgaacttaccggcaaggaagccagccgcgagcgaacatagcgagcacgccagaagaatcagaccgaatttgacgatggcgggcatgcttttgccggtgatgccctcatcaatcaacgacgccatcaccgtggggatgaggatttccagaacaccttcgatcaccacaaatatcggggtgagaatgctgggcttcctatattcacgcagcgatttgccaagcgtgcgtacgagatgccgcttttgttttggctgcgattgcaccgcagccgttgtcacgtttgttccgctcacttactcttcctttcctgtttcgtcttcctgtgatgttttccgtacagttggttgcgattcgcattcccgcgattgccgttcccgcgattccgcctcgcacaatgccaggctggagtagcgactttcgtcgccgatcagcccggtggagaccagattggtttgcatcacgtcgagcacgtgcatgaattcgcggatctcgtcgtcgctcaggccctgcagcaggatgccttccatggcgattgcgctggtgcgcagcgcttcggcgatgtcgcgcgatttgtcggtaagcacgattttcttcagtcgcgcgtccctcggcacggattcgcgcacgataagccctttgcgttccatcaatgcgagcactctgctcgacgtcgaccgggtgatgccgaagcggcgttccacatcctgcgggaagatctctcgttccgaatggcgtgcgaggaaggtgatgatgtcgatgttgccaccgctcagactctccacttccatggggcgcgtcaccgcaagataccggttgatgacgttgtgcagcgatcggatggcgacgctcggcggcttgcatgcgcctcggtcccacgcttcggtgaacgcggggttcaccgaagccgttccatcgttctgtatatcgttcacggaacatacgataacacgttgtacatacaacagttgcatatgcaacattcagcgtgtcgtgtgtgacggaaccggatcgcagcacaccgaacgcaatattgcaatcgcaaaatcgcttaaaaatagccaaaaataagctcggaacaagccgaaaccaagtatgaaaaagccgaggatgtggtccgcaccggttcattcgcggggccacatcctcggcctaaatccttgaaactccttttgcttacgtcttgtttacgtcaatccgtcttattcggcggtttcggcgattttggcgtactcgtcgagcatgaaggcggtgatggctttgccgccgtcgctcatcagcatcggcatggagttgatcggcatggacttgaggaacatgcgcatcatgtcgttgtcgggcagctgcggcagattgccggcctcgccttccgcatacacggatgcgacgattttggagccgaccggatcgtcggcccattcgccgaacgtggaccattcgtcgagcggcagggccttgccgtcgccgtcgagcgtgacgacggccacggcggcgatgtcgcggctggacgtgccgacttcgacggtgtattcgccggcttcgacatgccagtcatcgaacttctcggaccagtaggcgaaggcgcgctcgtccagatcgaaggagatctcagccgattcgccggccttgaggaacacctttcggaaacccttgagctcatgcttcgggcgggctacggcggccttgcctggagccacgtagacctgcacggtttcggcggcgtccacgtcggacgtgttggtgacggtcgcggtgacgtgtgcggtgttggcgccggtcttggcgacgttcacgccgtcgatcgcaaaggtcgcgtagctcaggccgaagccgaacgggtagtcgacggccttgtcgtacgtgtcgtagtagcggtagccgacgaacacgccctcaccatagtcgacgtgcccctcctcacccggccagttgatcatgctcggatcgtcgttgatgtccatcggaatggtctgtgccagcttgccggacgggctgaccttgccgaagatcacgtcggcgagcgccggaccgcccgcctggccaagcagccaggattcgaggatgcccttggcgttgcccgcccatggtgccacggagacgacggatccgttggacagcaccacgacgatgttcttgttttcggcggcgacggctttgagcagttcgacctgcttggctggaatgtcgagggtttcacggtcgaagccttcggattcggcggcttccggaaggccgaggaacatgaggacgacgtcggcgtttttggcggtttcgacggcttcggcttcgagcttggcgtcggccggttcgaggtcgagggtgaagcccggtgcgaacgcgacgtccgctccgcgttcggcgagggtgtcgaggaagctggtcatcttggttggggtgatgtgggacgagccgccgccctggtagcgcggggtgcgcgcgaattcgccgatgacggcgattttcgcgtttgccgcgaccggcaggatgtcgtcgtcgtttttgagcagcaccatggattcgacggcggcctggtgggccacctcgtcgtgggcgtccacgtcgaaacggtagttctcgacgctcatggcggcacgggtcttgttcacgaggtcgaccatgccttgggccatgcggtcgagctgttcgggctggatgcggccgtcacgtgcggcgtagacgatctggtcgtccgtgtagctcggcggcatttcaaggttgaggccggcgttgagggaggcgacgcggtcgtggtcggcgccccaatcgctcatgacgatgccttcatacccccattcgtcgcgcagcacgtcggtgagcagccagcggttttgtgcggaatgcacgccgttgatgcggttgtaggagcacatgatggtccatggctgggcggttttgacgatgtgttcgaaggccgggaagtagatttcacgcagcgcgcgctgggagatgttggcggatacgcgcagacggtcggtctcctggttgttggccgcgaagtgcttgagcgaggtgcccacgcccttggactgcacgccggcgacgatgccgactgcctcatggccggccagatacgggtcttcggaccaatattcgaagcagcggccgccgagcggattgcgcttgatgttgactccggggccgaggatgacggccaccttctcctggatgcattcctccgccatggcctcgccgaccttgtggatgagttccgggttccaggagctggacaggccggctgccggcgggaagcaggtggcgggcacggagtcgttcaggtcggtttcgccggtgctggatgccagggatttgcgcagtccgtgggggccgtcggtgatcatgtagccgggaatgcctttggtttccacaccctgcaggtgccaggcgtcgccgccggaggtgagggacgccttctcttcgagggtcaggtcgttgacggaaggataagcggtgtcgctcatgagctgcctctttcgtatgtcttctgtgtttctggtgcctttcggctattttctcggccgtctcgcgattgtttcgcggtgggacttcaaccccgaattccctacctaccgattggtaggtactttatcaaaaaacaatacgcaacacgccaatcatctttgaaaaagaaaccgaccgaccgtaatgtgaattacatattccaataacctccagcaacgacgggagcacattatggccaacgacgaagtcgaccgcagaagcgcgattctcaacgcggcggtcgaatgtttcggcacgctcggctactacggcacgtcgctgcagcgcatcgccactatggtgaacctcaccaaaccgggcgtgctgcattacgtcggcagcaaggaagggctgctgcatgcggtgctcgacgaaatgtacgaccgtgagaccgaggacgtcaccgccggcatggtgcgagacgaacgtccgcttatcgccgaaatgtggcgcaggacggtggcggtcaacgccaaacgacccgaattggtgcacatgttctccacgttgagcgccgaggcacttaatcccgaccatccggcgcatgattatttcgccgaacgcgaggaacgtatcgtggaagtggccgcgaacatccgctggcatgtgccggaaggcgttgacgccgagcaggtgctacgttccggattcgcgatgatggatggcgtgcagctgcgctggctgcgggttccggggcgcgacctgaacgaaatgtgggcgcgctgcgaggacgtcctcttccccctgccacagtgggagggctatcgctgaccatgaggtatctgctggcaccggattcgttcaaggaagccgcttccgcgcaggccgtggctgagtcgatacgccggggcgtggcggccggcgatcccggcgccgaatgccgcatgatgccgttgtccgatggcggcgagggattgaccgacgcgctggtccaggcaaccggcggcgaattgcgatcggagcacgcgcatgacgcgctgggccggccgatcatcacacgatatggattccttggcgagggcggtttcggaacatctcacgatggagagaatcctcgcaccgcggtggtcgagttggctgcggcgagcggcatcgagcgcatctcccccgccgaccgcgatccgttggcggcgtccactttcggcaccggcgagctgattcgcgccgcgatcgacgccggagcggaacgcatcgtacttggattgggcggcagcgccaccaccgacggcggcactggcctggcccgagcgctcggccatcgtttcctcgatgcggacgattgcgagttgccgcttggcggcggcgcactcccccggcttgcccgcatcgacgacaccgaggttcccgacgacgtgcgaaacatcccgatcgtattggcatgcgacgtcaccaatcctctgaccgggacggacggcgccgccgccgtgttcgcgccgcagaaaggcgcgaatccggaacaagtcgcattgctcgactgcggtttgggcaggctcgccgacgccatcacggcactgaacggtcgcaaaataacagataagccgggcgcgggcgcggcgggcggcaccggcggcggcatgctgggcctgttcaacgcgaccatgcgccccggcatcgagttggtgctcgatttgctgcatgcacgcgaggcgtgcgcgtgggccgatgtcgtcatcaccggcgaagggtcgatcgacgggcagacgccgtacggcaaggtaccgagcggcatcgcgcgactggcgaaatcgcaaggaaaaccggttatcgccatcggaggaaaagtgacgcgcgatccgaacgtcaccgccgcgctcaacgaagccggcatcgtcgcgacgttcggcatcgcacccggcccagccgctctgccggaactgctcaccggaacaaaacgcaacgtggaggccacctgtgccgccatcgccagtctgctgagcgtcgcgcgcgaatgctcatcgagacctcatcaatgaggaacaggaaccccgcctgttgcaccggtattgaggactactttggggtcatcatcaacaggccactcgcctgaactagattttcacatctgcttacggtaagtattcacgcaagagcggaaccgcgaaatcaacttcgccgcaaccggtctgacgaatgacatatgcatccagcaaccgcttgcgaatatgtttggcattgtcgatatcaaaattatcaaagctatcgaaaaacgacagaagtgaagccttccaccgcgcatgaccagctatgcggcgcgcttcgagaagcggaacatgagcagggccaggatctcacccgtcacggccatgccgaagaacacccacatgctggtggaaaacccggcgacgtaggcggccgcggacttcatgcccgcgacacggttcgctgcggagaattcggcgatcagcgtggacgcgaccgcggtgccgatggcgccggcgagctgctgcacggtgttcatcaccgcggagccgtcggcgttcatcgcggccggcagctggttcagcgcatgcgtctggtcaggcacgagcacgaatccggatgcggccatgaacagcgcgtaggcgatcgcgacggcccattcatgcgcgccgccgagcatcatcacaatatccatgatggccacgccgacaaaaccacaggcgatgaatttcggcggaaaatgcgctttcagcgcacctccgatcaacggcgcggaaatcgcgccgaccacggctcccggcagcagaatcagggcggcgatcatgctggtgtggccgagtccgcgctgcaatagaatcggcagcaggaagttcacaccgagcacgccaccggacgacatcagcagaatcagcatgcccaatgtgaatccggggaatgcgaacgtgcgcacctcgaccagcggatgctccatcttcagctgcacggcggcgaacacacccagcaccacgatcgcgccgacaagcaccgtccagaagcgccagtcgccgttccactgcgcgaagaagctcgccgccacgatgatgccggccagaccggccgccaccaataccagcgacggcaccgacagatgccccttcccgccgtggcggatgtcggggacggtagcgcatcccagcacgagcgagatgagcaggaacgggatcatcgtgtagaagatccaatgccagttgaggaattccatgacgagcccgccgaacaccgggccgatggccggggccgcgcaggtcaccagactgaccaggccaagcatcatgccgcgcttgtcgaacggcgctttctccaggatgatgttggtcagcaacggcagcgagacgcccgtgcccaacgccatgatgagtcgcgcggtgagcaacatggggaagttcacggcgagcgcgccgaccaccgtacctgccgagaacagcgccacggcagtgacgagcagccccttggtggggaatgtgcgcaccatgaacggtgaggtggggatggctatggacaggagcagcagatagccggtggtgagccattgcaccacgtcggcggagatggagaactcccccatcagcgtggagtaggcgatgttgagcgacgtttcggataggatgccgaggaaggtgaggatggagagcgccaccaccacgatggtgagtctgccctcgctcatatatctgcttggctgtggcccctcccgcatcgcctttgccggctgttcccgccgctgttcgcgttccgtcatgatctgcgactccttccttttcgtcatgggtgaccgcatcgtttgccgcatggctcgatggccctccggcctaccgtttctccgccgtatgagatcgaggatcgccgcccgccatcaacgtttcgacacgtgccggccaggcatcggccaccttcgtggtccattcccctccccggtccgtgtccatcagccgatgcatagcctgcagcgtggcgaccgtggtggcgacgtcctgcgggctgatgccggacagcacgccacgcagatgctcatggaactggtgcacgtacagttcgcggatttcctcggcggcttcggtcaggctcaacgtcaccgcacggccgtcggcttcggatgcgtgcttgaccacaaggcctttgaccaccagttcgttgacaagcttcgtgatgcttggtgcggttactcccagaaaggcgctgatgccgctgacccgtgcggcgggagccggggatccggcacgatgattgagattccagatggcgtcgatgacatgcacgtgacgaggcttcatgtttttcggcagttccggcaacgcttcggtgatgcgtttcgccatccagcacacgtcgatcagatcacgcacgtcgtccagggacagttgtcgttgcccgcttcgcgattccaccatggcaccctattcgttactaatagtcattactaaaggtaagtatatgggtgctccggacaacgggatcgcagccttggcccatcagtcttcaaggcatgttttcacaacccgacgccaacaagtccgggcgcgcacccactggatgcatgcccggactccacggaaatcccaatggcctttgcactacacgcgacgggcggcgagctccccgcccacccggtcgacgcgcttgtcgaggtcgtagaagaagagcagcgcggccataaccacggccatggcgaccggcacccacacgaaggtgttgaccatggcggagacggtggcatcggaccgcacggcgagcgagccgtcatatccgctggcaccgagtatccacgcgatggcggccgaggaaacgcccatggccaccttcatggagaagctggacgagctgaacacgatgccatcggaccgcacgccgctgcgccattcgccatattccaccacgtcgccgctcatggcgttgagcgcggcgttcatcgggatgatgccgaccatgcgcacgatgatggagacgaagaacacccacaggttgctcggatcgacgaacaccagcagactgccgacggcgacgagcaccaggccggccatcgaggcgttgcgtttgccgaaccgggccacgagcggtccggcgaacggcaggccgatgaccatggggatcactgtcgccagaccgatcacggcgatcagattggagttgccgagcacgtacttggcgatgtaggcggccatgccgttgtaggtcgttgagccccagcgtgagccaccagtacttgttgcgcgcaagcgccttgaaatggtcgccgacgggaattctgccggcgcgcccatccacgccatcgcccggtttcatggacgcgatctcatgcgtattcgcgaaggtgaaccagtagccgaacgggatcatcacggcgatcgccccgaagaagacgctccagccgagggacgaaccgccgaggaactcactcccgacaccggcaaaccggtaagcaaactgaatcttggacgcttcggcgcgggcttcatcttcttctgcatcgtcttcatgatgtccggcaccatcggatccaccgtgccgctcccagcccgcttcaacacgctcggcatcggtcagggcgaaacgatcctcggcacgatgaactccatcggcatcatcttcgccctgatctccaacgtcatcttcggctcgctgtccgacgccccccacagccgtttcggcaagcgcacgccatggatcatcatcggcggaccgatcgccggcatcggattctacctgacctccatctccccgacgccgccgaccatcgtcgcctcctggtcactgctgcagatcggcctgaactgcatgatcgcgccatgcgtggcgatcctgtccgaccgcgttccgcagaaataccgcggctccatgtccgcattctacggcgcgggccagatcgtcggccagtccatgggcaccatcatcggctccgccttcatcgatgctccgaagaccggcttcatgatcgacaccatctgctggtgcctgtgcggcatcggcaccgtgctcctgctcccgcgcgaactgtccgcggccacggccgacgccgagagattcgacatcaggcagatcgccatgcagttccgcccgccgaccaagggcgcgcgcgatttctatctggcgctcgtcggacgtctgatgctcatcttcggttacaacatgatcgtcggctaccagctgtatgtatgcatgaagtacatcggacaggacgccaaggccgcggcctccaccgtgtccaccatggccgtgatcaccatggtcgtccccctcgtcgtacccctggtctccggcccgatctccgacaggatcggcaagcgcaagctaccggtgttcgtctcctccaccatcatcgccatcggcatcgccgtgccgtgggtgctcaagtcccagttctccatgttcgtctacgcggcgctcatgggcctcggatacggcatctacatggtggtcgatcaggcgctgaacgtcgacgtgctaccgaacccgaacgaggccggcaaggctctcggcatcctgaacctcgccaacacactcggacaggttatcgcgccgattgtcgtctcctccatcgtggtggccaccggcggctacttcttagtattcccgatcgccatcgcggccgtaacgatcggtgccgtggtgattctgttcatcaagaaggtgaagtagccgccggcggatcgtaggaccacgcattcacaggcgcgcaagggccgttcctttccgagggtttcaatctctccaccggtttttcgaaaaggaacggcccttcgccatggcaaaccccgtagctggcatcgttccgtaggtggctctgccgttccgtaggcggtcacctgcggcatcggcgatgagaaacggccgtatttgagccgttccttcagtgaccatccgaccccaatcacctacggagtctgaaaaccacctacggaaaaaccggaccttgtcggcagtcgccaggtcctaggcaccacccgaccgcatatacgcgcggaaccgatgcggcaccccgacgaatcattgcaaaaccggccatacaagcgatgcccgcaatatgcgcgacatgcgctgcgtcgatttgtgaaatcacctaaatcatagtaaactaccaagtggtaattaaaggacaccgcttcaacgaggaaagtgagcaatccatgaccaacaccaccgacctgccatacaagaatcccaacctgcctgccgaagagcgcatcgccgatttgctcggacgcatgaccctcgaagagaaggtcggccagatgatgcagcttgatgctcgcagcggcgatctggatgacctgatcgtcaacaagcacgtcggctcgattctgcacacctcccccgcggacctgccccgcgcggtcgagaccgtgaacacgaagacccgcctcggcattccgctgatcatcggcgacgactgcatccacggctattccttctggccaggctccaccatcttcccatcccagctcggcatggcaacaagcttcgacacggccaaggttcaggccgcgggccgtgccaccgccgaagaggtctccaccaccggcgtgcattggacgttctcccccgtgctgtgcatcgcccgcgacacccgttggggccgtgtggacgagacgttcggcgaggatccgtatcttatcggcgagatggcctccgccatcgtcaagggctatcagggcggcgccaaagctggcgagccgctcgccaaggatgcgattctggcctgcgccaagcatttcgccggctattccgaaacgcagggcggccgcgacgcttccgaagcggacctgtcccaccgcaagctggaatcgtggttcctgccgccgttcgaacgcgtggcgaaggagggttgcggcacgttcatgctcggatacgaatccatcgacggcgtgccggtcaccttcaacaagtggctgctgtccgacaagctgcgcggcgactggcactaccagggcacgctgatcaccgactgggacaacgtcggccgttccgtgtgggagcagaaggtcaaggccgattacgtgcacgccgccgcggacgcggtcaaggccggcaacgacctgatcatgaccacgccgaagttctacgaaggtgccatcgaggccgtgaagaccggcctgctggatgagtcgctgatcgacgaagccgtgtcccgcatcctcgcactcaagttccgcctgggcctgttcgaagatccgcgtctgccggaccaagagcgcatcaagacggttatcggctccaaagcccatcaagagctcaacctgcaaatcgcacgcgaatccgtggcgttgctgaagaatgacggcgcattgccgttctcggctgcggcgggcaaacgcatcgccgtggtgggcccgcttgccgatgacgcgcaggagcagttgggcgattgggccggcaattccggtcaggtcaattggatgccggatggccagccgcgtgagatgatcaccaccgtgcttgacgggttcaagcagcttgcgcccgaaggatgcgaggttgcgtattcgcgtggcgcgaacatcatcgatttggtggacgatccggaaggcgagttctatccggatggccagcctcgtccgaagctcgccgtctccgccaagttcgaccagcaactgctggatgaggcggtggacaacgctcgccgttccgaccttgttgtcgccgtcgtgggcgatgtggtgcagttggtcggcgagacctgctccaccgccacactggaactgctcggcgggcagaacgccatgctcaaagcgcttgccgacgtggcccgcgagaccggcaagccgctggtcgtggtgctgatgagctccaagccgcaggtgatgccggcatgcgtgatcggcacgaatggcgtgatcgtggacgaatccacggccgacggtgtcagcgcgttcatgtgggcgccgaatccgggtatgaagggtggccaggccatcgccgaaatcattcttggcgaaaccgagccgagcggacgtctgccgatcaccttcccgcgtcatgcgggccagctgccggtctattacaaccagatccgtggccagcacggcaatcgttatgccgatctcacgcaggatccggcgttcgcgttcggcgagggcctcggctacacgaccttcgcgtatggcgaaccgacaatcacgaacgttccggcttccggcacgttcgccaccaccgataccatgcatgtcgaggttgcgctcaccaacaccggcgagcgcaaaggcaccgaagtagcgcagttgtatatcggcgatatcgtgacgtcctacagttggacggaccgcgagctcaaggcgttccagcgcgtggagcttgagccgggcgagaccaagaccgttgcgttcgatattccggtttcggagtgcactatcgtcgattcggatgccaaccgcatcgtggagccgggcgagttcgaggtgctgatcggccattcgagccgtcgcaaggatctcaagcggaccacgttcaccgtggcgtgaatggttccagcttggtagtggtcggcgatcgtcatcgatggtcggcctctaccggcgacttttttggggggtagccatcagactgcccccaaattcatgtgcgaatcatcatatgcggatcatcggcgggaatcagcgataggagtcccacaatggtgcggggaacagcatgttctccatttctgcccactcgccgcacaaatcgacttccggttcgcgcagccaccacagttggatgccgtccatgatctccatggctttgcgcaccactggccgcatgctgtcggcccatgcgcccaattgcggcggaaccacccatgggtatttcgaatagtgctcccaaataccgtccatgcgttccataaattcgtcatgcaatggatggtccggattcagcgattccgccgacagcacggtgaacagctgcaccatcatgcggcggcgcgagttgtgtttcaccaggtagcgcaggtatgcggggaaatgcggcgcggatgggtcgctgcccggcatgctcgaagagaagaagtcctccggcgtgccggtctgtccgtagtattcgtcgaataccaacgccagcattgtgtctttgttttcgacgtatcgcagcacgccttgtttggagatgccgacccgatcggccacgtcctggatcgaaatgccgttgaatccgcgttcgctgatgagctgcaccgccgcatccagcacttccgcacgacgctcctgcggcgatttgcgggtacgtttcgaagtctcttcctctgccatgactccgagtctaatgccctttgcgtcgattgccgttgattgacggcgccgatgccacgtcatcgtggggcgtatccgcttgaatccatccatgacgccatacgcgggttagatcccacgcttcgagattgccgccgttgcgcggatctcgcggcggttttccctcaccactgcccggtttcgcggagcgtgcaagctggtagctccaatagatctgtcctgctgatgcgtcccatgccgcgcgttgcaatcgcgatacttgacggtatgcgtccgctcggtttcggccgtgcagggcccaccggttctccacgcaccactcgcccacaagtacagggatatggcgggccgccgaacggatggcgatttcgcgcgcacccaccagcattcggtacagccatggcaggtgccgcgattgcaggtacagtcggcgtgccggtcccgcgaacaacggttcctccatggcgatgagatattgatgggtgtcgagcatgacgttgcacatgccggcgcgacggaaccaatcgccccagcggagcagtcggaagccgtcatggaatacgatcagggtttccggacgtagtatggcgcgcagccgggtgtaggcgtcacggtagaagcgcttcagaaaccgtagtgggacatgcgtgctgccggaggcctcgcggacgtccttcgccgtattcgacgtgccatggaacaccgaccagctcaccggttcgttgagcacttcgatgctgtgtagggtcggctcgtcacgatatcggcgggccaatcgttccagcacattcagcgcgtattccaccaagtccggattctgcgcccatttgcacacgcccgtcagaccgccgttgtcgaaaccattctgtgagccgggcacggtatgcaggtcgatcatgatcttcagtcccgtctcccgcgcccaacggaacgcgcggtcgaggtatgcgatgcagcccggatgtccgggccagtcgccgaagatgaaatatggtatgggaatgcgcacgagattgagcccatggtcggcgatgatgcggaaatcctccagggtgatgtaggcgtcgcggtgccggcgcagttcctcggcgagattccgctcggaccagagggcgccgtgcgtgcgatgcatccagatttcgtcgtcttcggcagtgcggacgaatggttccggatccatccatttctccagcaccagccagttaccgaggttcacgccgttgattcgctcgtcgatgcccagcaccatgcatcccaccgcctttctgtgcggggtttcgcccggcttgtcgtttccgcctattcaaaaaccaaacagcccaaaccaaacccctatttcagcccaatgggccaaggaacgcaccgttcgcaacgttccttggcccattgtatgcgtcctgcaatcagccacgcggccggttggaatcggaccacggccggattggggtttcggaatgatcgtggccggatgggcgggatcagtcgaccggcttcgtctcgtccgcctcgtagtcgaagaagtcgaagtcggcagtcttctcatgcaacgcggcgtcggtgacggcgacgccgaccatggtgtcggtgagcagcttgtagttccagtagtagaagccgctgcccttgctccatgcggcgagctgggattcggccacgccctggtacagcgagcgcttctgttcggcggtcagggtctcggcctgcgcgccttcctcgccgttgagcacgctttggccgccgtgggtgtccacgccgcagccgacggagttgaacaggcaccactcccccacgatcaccgggaagtattcgctcatctcggcgatcatcggcgcgtaggtgttcctcacgaagtcgtcgtagccttccacggtctgcgggcagcccatcatttcggcggtcatgaggtactggtgggtgtcgaggaccacgttctcgaattccggcgcaagcctgccatcggacccgcgcatgaagtccttccactgctcgatgtcgaagccgtcgtgaaacaccacggccttgtccgtcggcagcgcgcccttgtcggcgtcgcgcagacggtggtaggcggtgacgtagaagtccttgagccagtcgaaggcgatcgggcctgtgccttcggcgagctccgggtcgaccgccttgtagcgttcggtcacattcatcatcggccaggaggtggtggtgttcggctcgttgatgatttcgatgcccatcagcgcctggcgatggccgtaccgcttggcgaggcgttcgagcacggacagcacgaattcgacttcgtcgggcagctgcgcccatttgcacacgccggagatgccgccgttgtcgaagccgttctggctcatcggcgcggtgtgcaggtcgataaggatggtcaggccgtatttttcggcctagttgaaggctttgtcgagttcgtcgatgcagccgatgaacggtgcacggtcgccgaagatgaagtacggcacggggatgcgcacggagttcagcccccatgatttgatggtggcggagtcgcgttcgttgatgtattcggcgcggtgggtcttgatgcgggcctcgtagacggccgggtcgagctgcgtcggcaggtagtattcgtcgtccgcggtggtgccgtcgaacagcgccggattcatccacttctccagcaccagccagttgccgaggtccacgcctttgatgtagtcgggattcatgtgcactccttcgtacgtcatgcagtttctattacttagtaactacttagttatatcgtaatacatttccgttccacacgcaacccaatctcgtcggcatcccacggcgaaggactgctcggatgagaaaaaccaccaatacaaacaaaggtgcccgccgcgcatggaggggatccatcgcggcgggcacctcatgggcagggcgtcggcaatcggcatatcgccgggaaaaagggaaaaaccggcattacgcgcgagccgacgccatatcactccggctcagtccagcacgaaggtgttgaacgatcgcggagcaagcgttaccttgaagccgcgttcggcggcatcgggatcggcgaattcgaacggacgctcctcgtcgagggcattctgcaccacaaccaccaccgtgccgtccggattgcggaaggcgatggccatcgagttgaaatggccagtggtgccgagcaccttcgcgccgggcctgacgaaatgcgagaagtgacgcatcacgtagtattccggattgcggcgcacctcatgtgtgtcggcggtgatggtgaacagggagttctgccaccagccccatgtggaatcctggtcgtcaagaatcatgttccagtaggtgtatgcggtggcgccgttgcggaagtagtggttgatcagatggaagatgtactccgcgtactcccagctgttgtcgccggtgccgcattcggactccgactggatcagttcgatctccggccatgattcgtgcgtgcgggcgatgcagttctggccggcccactgataggcgatgcccttgatgtacttgcgcgcgccgtcgtcgaagaggatgttgtcgacgaagcggttgtagttgttgagcgtcataccatagccgccgccggtccaagccatgtcctccgggccgttgagggtgcccagccagatgtcggtgtcgagtccggcctcgtcgaacgccggtccgaggtagtcgcggatgaacaccttgagcgcttcggaatcccacagggcgctcgggaacttctggtcggcgaacacctcgttctgcacgtgcagctggttcacggtgatgccgtgctcggcataggcctggatgtacttgacgaagtacttggcgtaggccttcaggttctccggggtctgcacgagacggccgtaattgtaggccttcgggcgcttcatccacgtcggcgggctccacggactggagaacagctgcatgttcggctgccattcctgtgcgcggtggatgtacgggatcagggtctgctcgtcgtgttcgacggagaaatgctccatcccgtagtcgccgtcgacctcgtcgtagctgtaccagtggtcggcgaagtcattggcgccgacgggggcgcggttgaaggtgaagttcatctcgtcggggctgaacagctccttgatgatctggtcgcgttcggcttcgctgacgttctgcagcggcagccagccgagttcgttgaagcagccgccgaagccgcgcagggcctggtattcgttgccgtcgagctgcaggtcggccgcggtggtggcgttggtggattcgatgtcggaggttcggtcggcaagcttgttgtcttgcgtcgttgcaatccagatggtcatgatgttccttggtatcgtcgttgataattcggatatgcgttgatggttagtatggatgggagaggcgggacgattcgaccccgcggaggggagacggcctatggcacgaccgtctcccccggtttacagcagctgccttacttgaccttcttgatggccatgatgaagaagcagccgatgatggccaatgcgatggacgtcgggaacgcgaagttgtagccgaggttgaccacgatggcggacatgacgaccgggccgcacatctggccgagggtggtggccatgttcaggatgcccagatccttgccggcctcttccttgttcggcagcacgtccaccagcagcgcctggtcgacggcggagtagacggcgtagccgaggcctgcgatgccggcgaacaggtacatgcccatggtggacttgaagatccacggcatggcgatgccgacggcgaacagcacggaggcgacgacgaccgggaccttgcggcggccgatgagatcggagaccgggccggagatgaaggagccgaccagggacatgaccatcatgatcatggacacgacggacacggtgacggcggattccttgacggactgaccgatgtagttctggatgatgtacagctggtagacgttgatcatctggtaggccatgagcatgcagaagcggccggcgaacgccttgtagaagtcatgcgcggtggagaacttcggcgggcggaaggaggagaggatgtccttggcggagccttcgtccttcggcaggaagtctgcggactgctccttcgggatgatgatcacggcgaccacgccaccgaggaacatgagcacgccggcgacggcgaagcccggaatcaggttttcgatgaacagtgcgccgagcatggtgccgatcggagcgccgatggtggagccggcgccgtagaaggcggacatggtgccacggatcttggaaggcacgcggtcggacaggatggcgaccatcggcgcgatcatgcagttcagaccgaacatgcaggcgcagtagaagatggtcagcagcacggcgttatgcgtggtgccggtcaggaacagggtgacgccaccgagcacggctccgaagaggatccacggggtacggcggccgaagcgggaacgggagcgatcggagaagttgccgaacatcaggttggcgaccagggatgcgaccgcggtgaacgcgttgacgatgccgaccaacgcatcggcgttgacgcccgggatggtcttgtagtgcatgggcagcagcactgcggaaacgatgcccagaccggacatccacagcaccccgaataccaggaagcctgcgccgaaacgtgcggcgttcatcttggacagcggcttgccggtttccggggacagcgacggatccttttccgccgcggcgatgttggcgttgtaagcggcaaggcgctccgccttgctggcgattgcttcactcatgaaactctctccttcgaatcatgcttcagtagtgaacttatgttgtgtgcgattccgcaccttagcggtgtatgtggtggtgggacggcctcgccccatctgttaactaccatgtggtaactaacgtgttttcagcgtaaaccatctttcgcaaaggcacaagtcgacgtcatgtcatcgccgtctcaaagcgtttgcaaaaccggtcggacactgttccattcagcttcacagtcaccggtttttattacctagtaactgcttagttaaagcatataacaaatcgtttgtctgcgataatccggcgtgttccaagggtttccatcgtcttcttctcccccttcttgtaccttagtaagcaccagatgaaggagagcatatgcgtcgccgcaccgaaaacaaacccagaaagcgaatgagcgccgaggatcgcaggaaggcgattctcgaaaccacggtctcattcatctcccagttcggtttctggggcttcaccatacgcgatgtggcccaggctcagaacatcaccgaagccggcctcctttactacttcaaatccaaagaacaactgcttgaggaaaccctcaaatacgccgatcggaccaatcagatcgccatcgccgagcatcttggcgtgcagagcgtgaccggcgaagtccttgacgacggcatcgcataccactgcgatctggggctgaaggccatttccacgggaaccgtggagaccaacgccgaccgtccggagatggtccgtctctacaccttgctggaaagcgaggcgttaagcaaggaccatcccgtgcacgagtatttcgaacagcgcgaaatcaatctgctgaaggaatacgcgttcgcggccgagcgcgacggtgtcgccgatccggagcgcaccgcgctgcaggtcctgtccgcgatggagggtctgcagctgcgctggctcaacggatcgcatgacgtcgacttcgtcggggaatggaaggccatcatcgacctgctcatcccctgacccagtgggccgacgcaccgccaccgctttgcggctcagccggcgatgacgaccacattccagcggccgatcgtcagcctgtcgcccacctcgaccttcgagccctccttcagagcgatcgccgcggtggcggattcatcgacggtgccgtcggtgcccaccaccaccggagcgaccaccacatcgcccgacaccgggctgtcgatggtgacctcgtcggcggagtagttgagcagatacgtcacctgctcgccgcgggcgttcgttccgcggcgcaccgtcacctgtccggcgagcgcggtgccggcatcggcgatgcccgcgtgttccacggcttcacgcaggacggcgcggatggtgtcggcgtcgagcagggtggcgatccattcggcgtcgcccttgccgaagccatgtcgggtcaccgcggcgtaatccttccacgcgtagtggccgtagctggcgagcacgtcggtgccgtcgaatggggtgaccagttcgatgagcgcctgcgcgtcgcttgccggggttttggcgagcgttccggcgaattccacggatacgtggccgttcgggcgggtgaattggttgtaggtcatgccgaacacgtcggtgaggttgtgcggcgcgcggtcgtgccatacggtcacctcgtcgtcggttacgaaggagcgcatggtggagacaaggtggccgccgctggagacgaattcgcgcagacggtcggttgtttcctgcggagtgcagtacagtgccggggtcacgatcatctcgtatttggccaggcgttcggccggcgcgtcggacgggatgaaatcgcattccacgttgagttcgaacagcgcgtcgtagatgttgcgcaccacgtcgttgtacttgagggtgccgccgaacgggaagccggactcgatgaggaaccagtcgagcgcggtcagcgattcgttgctgaccatgatggccaccttgttgtgcttcttcaggtggacgagccgctcccccacttccggtttggcgatctcgcggccgaacacgcccgcctcgcggtaggtgggattcggttcgaggtcgtggctcagcaggcccttccaatatgtttcaaaggaattgtggatggagtgccagtgccaatattccaccatgtcggcgccggaggcgaggtgggagtaggcctgcaggcgcagctggccagggaacggcacccagccgtgctggccctgggcctccgtttcgagcaccaggtagttcctgccgtccttggtggagcgggtcatgtcgccgccgaaggcgatctccttgccggtcaggtcgtcctcggtggggtggtagatgtccacgccggtgatgtccacggcggtcgaggccttgaagtggtcgacggccggctgcacgccgtaggagtatccgcgccattcgaaatcgaagttgtgggtgatgaactggtcgtcatgcgcgtattcgcgcacgatgtcggcctgccactgcaggaaggcgcgcacctggtcgcggcggaacttgtcgaattcgccgcccagggactcgttgatggtggcggtcacgtccgggaagtcctcccaggagtcgatgcggttggaccagtagtcgaggccgaagtggtggttgagctcgtccagatcgccgtggaacttctcgcgcagatacttgacgaacaggcgctgcatgtcttcggagacggaatcgtagtatttcgtctcgttgtccacctggtagccgatgacggccggatggtcggcgacgtgggagatgagcttgcggatcacacgttcgccgtagaagcggtaggtggcgttaacgatgtccatgatctggcgcgcgccatacttgccctgtccgttcggcgtgaccgcgagcacgctcgggtcgagcttgacgagccagctgggcaccgcgtaggtcggcgtgccgacgatgacgtcgatgccggcacgctgcgcggcgttaagcgcgcggtccacataagtgaagtcgaacacgcccggctgcggttcgcaggtgctccatgtggattcggcgatgcggatgacgttcagtcccgcagccttcatcatcgccatgtcctcatcgatgtggtcaatgcccttcatcatgagatattcgtcgtaatatgcggcgccgaacagaatgtggtctgcctcgtaacggcccatgaatcctccatcgtcctcgttgacttttatatctaacagtcattagatataagaactatatatcttccgaaacaaatcgtcaactgtcgcagattttcaggcgtttcttaactaacaaccattagatatatgccttcggaaggcttaccgatatccgtcccacaccggcgaggggaagatcatccgctcgaagacgagccactcgtcgtacaggtcgatcggcggcttgcgcgtccaccgcaactggatgccatccatcgcctcgatgcattgccgtacgatcggccgcatattgtcccatccgccgatctgcggcggcaacttccatgcgaaccgcgaataatgctcccacgtcagatccggtcggttttcgaaatactcgtgcagtggatggtccgcgttgaacgattcggtttccaaaaccatgtacagctgcagcagactgcggcgttgcgcattgtagcggaccagaaaccgcagatatgcgggaaacagcatgccgtcagaatcgctgccgggcaatcccgacttggcgaagtcggcgggtgtgccctgctggtcgtagttatcggtgaccagcagcgacagcagccgctccttgttgccgatgtagtgcagcagtccgggctggctcatgccgatggcgtcggcgatgtccttgagcgacgtgccgtaataccccttctcgccgatcagcttgcccgccgccgcgatgatttcgcgtttgcgctcttcgggcgatttacgaacccgctttttcccctcggtaaccatatggaacagcgtaccatcggacgggccctcggccggtcacgcctggaagacgtccggatgcttcggatcgcccggttcgtcggcgagcacaccctcaaggccgagaaactcctgccagaattccagcgagttgccgtatgggatggcctggcttccgcgcgcctgcaggttcgccttggcttcgaacacatcctcctcgcggatgccgtcgaagtagctttccagtcggtcgagattcgtcggatcgtagaacagcgagccgatgatctcggtaagccgctcggcgcgggccaccggcagcgaatcccagtggcggaattcgatgaagttcttcaaacgcacgtcgttgaagtgcgtggagatcacatggttgatctcgtacgcgttgagctcgcggtccgggtacacgtcgttcgcgttctcgtagaacgccggatggtgcagatcggtgccgggcaccgccagcgcctccggggtgtgggtcaggtcggcgaacatcatcggcgtggacagcacgtccaccgcgtaatcctcccaaccgaagcgcgggtcgaacagaccggggatgacgttcgtgcgctggaagtccagataatcccacatgcgctggcgcagcagcggatacgggttctcacggccttcgaaatacggggtgttgcggaagaaccatgccagaatcgggccgatcaccgtacccaaccgcagtttggcgatcgcgtcctgttccgaaacgtagtcgatgctgacctgtgtcgaagcggagcaacgcatcatgcacggaccgaactgtccgacacgtcccaggtaggcggtcatcgccttgtatcggtccttcggattgacgggaatgtcggcgtaactggatttcggttggtaaccatagttgacgagtcggaaaccaagttcttcgaggatggggtcgacttcgcggcggaacgcgccgtacaatgtggcgagctcctccggcttgtgcaggatgccgatggacgtttccaactgtccgcccggttccaaagatacggagatgccgtcacgggcgagtccgaccagtcgcccgttttcccagtattccttgttttcgtcgtaatacgggcggatgcggttgagcaacgcttcaatgccgttgctttcgtagtaggtcaccgcggtatcgtcgctgttatgtaccggcaggtgttcgatttccacgccaaaaccgccggtgccgcgctgttggcagccggattcgaagaatttgataaggctttccacatgcttcggattcggctcggtcagcaggtgcgcgtacgtgatctttggcgttgtcatagtggccatcctaacgaaaagcgccattcgcaacgcaggctacgctatacggaaaatcgataaccgaccatcattccccatcgatttggctggcgatttgaatgccgattcgacgaccatcgattttacgatcgccgaatcagccatcgatttggcggctcagataccgtcgaaccgacgtcggaaagtttcccaacgtcggttcgacggaaataagaatggcgattcaagcggccttctcgctgttgcgcgcctcttcggctgcgcggtgcgccttcttggcagcggagatcatcagcttgatgcggttgagctggttggcttccgaagcgcccggatcgtaatcgatggacacgatgttggcttccggatgcagtcggcggatcttgccgaacatgcctcggccggtcacgtggttcggcaggcaggcgaacggctgcgcgcacaccacgttcgggcatcccgattcgatgagttccaggatttccgcggtcagcagccagccttcgccggcctgcacgcccacggacgtgacctcgtcggccttcttgaccagttcaggcatcggcagatcctgcgagaacttgccgtgagccagatcgatcgcctcgcgtaccggagcgttgtacaggtcgaggcccttgcgcatcagcgcatagccgatcttgctgccgcccatgccgaggtaatgctcgttccagtcggaaatgtacggtcgggtggtcatgaattccatgatgcccggcaccacggcctcgcaatcctgcgattcgatgacgtccaccacatggttgttggcgtccggctggtacttgacgagaatctcgccgaccacgccgacgcgcaccttgcgcggctcgtccttcaacggcaacgcgtcgaacgacttgacgatctccttgacgagcgtcggatacggcaggtaacccttgctgatgaatttgcgcgccgtcttggaacgaccgtggtgttcgagcgcctcgcgcacgatggtgtcccacgtcttgtacagctggttcgcgctgccgggtgtcacttcgtacggacgcacgcggtacaggcacttcatcagcagatcgccaacgataagcgccttgatggcacgatgcagcaaagccggcgtggcggtgaagcccgggttgtcctcgatgccctgcgtggagatggcgatcaccggaatctgcggataaccggcgtccaccagcgccttgcgaatcaggccgaagtagttggtggcacggcacatgccgccggtctgcgtgatcgcaagcgcggtgtggtccggatcgtatttgccttccagaatcgcgtccacgagctggccgatgaccatgatggccggatagcaggcgtcgttgttgacgtatttcaggccggtttcgacgtcctctcggctggcatgcttgaggatgtcgaacttgtagccgccggagcggatgacggattccaccagagagaagtggatcgggctcatctgcggggcgacgatggtgtagtccttcatgttcttgccgaacgggatgcggttcgcatacttggacagggtcgccgagttgtgtgcggacgcgcccttgccatttgtctgcgttttggcggtttcttgcgattcgcccttgccgttttccgccgcgcgcttggatgcggccgtgacggcttcggtgagtttcggattggctttcatgacggtgtcgagcatgacctggcgaccgggggtcggcgcttcggtgccggtcttgcggaatccgtcgttcttcttgttgcgttcacgctcctcgacggcggccttgagcgagcgcagacggattttcgccgcgcccaggttggagacctcgtcgattttcagcatggtgtacacgtcggccttgtccgccaggatctcggacacctggtcggtggtgatggcgtcgaggccgcagccgaaggagttgagctgcacgagctcgagtcccggataggaggccacgaaatgggccgccgcgtacagacgcgcatggtaggcccactggttggtgacgcgcagcggcatcttggtgaccttgcggtcgtcgacgtggcggaagccgttcgcgttcttcttgcggggatcctcttcgccttcggcgaggaattcgctcaggttgagcttctcccccggctgcagttcgcagatggagtcttcggaaagcaccgccatgcccagcgagcagatggtttccgggatgccgtggttgatttccgggtcgacgtggtatgggcggccggcgagcacgatgcccttgcagtcgtgttccttcatgtaggcgagggccttgaggccttccatctgcacgtcgtgcttgaacacttcgttttcggcgtaggcggccttgaccgcggtttcggcttcctcgcgggtcacgttggcccaggcgaattcctcgacgatgcggtccaccatgagctcatggttggccatgttgaagtacgggcgcatgtagcgcacgccttcctcgcgcagttcgggcatgttcgcgccgatgaccaccggatagttggccacgaccgggcagttgtagtggttgtcggtgttgggaacgaagttctcctcatagctcacgcacgggtagaagatcgtcttgatgcccttgttgagcagccacttgatgtggccgtgcacgagtttggccgggtagcagatgttttcggaggcgatcgattcgatgccggtttcgaacagttcgtgcgagctgcggccggagatcatcaccttgaagccgagcgaggtgagcagcgtgaaccagaacgggtagttctcgtacatgttgagcacgcgtggaatgccgatttcgccgcgggtggccttcttgtcggtcagacgacggtaggcgaagcaacgcttgtatttgtagtcgtacaggttgggcctgtcggaacgctgcttcttggaatcgccgccgcgttcgcaacggttgccggtcacgtagcgggagccatcctggaacgtggtgatggtgagcttgcagtggttctggcatagcttgcacacgtcgcgttcggtggtcatggacaggttgtcgagctcgctgccggacacgatgctggatgcggtgtgcgtgacgccgtcgatgtcgacggtcttgcctccgtcggcgtccgcgtcaccatcgtcgagtccgtcggcgatgtcggtgtaatgcatgcgcgcggtcagcgcggcaccgtatgcgcccatcaggccggcgatgttcggtcgggtcacctcacgttcggtgagcagctcgaaggcgcgcagcacggcgtcgttgaggaacgtaccgccctgcaccaccacggtgtcgcccagctcgccggaatcgcgcagcttgatcaccttatacagcgcgttgcgcaccacggaatagcacaggcccgccgcgatgtcctccatcgaggcgccttccttctgcgcctgcttgacggaggagttcatgaacacggtgcagcgcgagcccaggtcgaccggatgcgtggagttgagcgcggcctgcgtgaattcctcaatcgtcagtcccatggactgcgcgaacgtctgcaggaacgagccgcagccggacgagcatgcctcgttgacggcgatcgaatcgatcacgccgtcggaaatcgccaagtatttcatgtcctggccgccgatgtcgatgacggcggtaacgcccggcgagaccatttccgcgccacgatagtgcgccatggtctccaccacgccctcgtccaggtgcaggccggtggtgatgaggccttcgccgtatccggtggcgcaggagcgtgctatccacgcgccttccggcagctggctttgaatctgcttgacgatgttgacagcggccgtcagcgggctgccttcgttggtggcgtacgacgaccatacgatttcgcggtcgtcgttgacgagcgtcgctttgatggtggtcgatccggcgtcgatgccgaggaagtgcggaccttgcgcgccttccagcgtgccgatgtgcacatgctcgcggtggtggcgcttgttgaacgcctcacggtccgcttcggtcgggaacagcggaggcatggtgggggtgttggccggcagattcttcaggtcttcaaggcttttcagaatatcggcgcaggtgcgtgcttcgaaatgctggccctcctcaagctggtccggttcgccggcgagcagcgcggagccgaacgccacgtacaggtgcgcgtcggtcggcacgatgaattcgtcgactttgtcttcgagcgcgcggtggaacgcctcgcgcagttcggacatgaagaacagcggaccgcccaggaagatgacggtgccgtggattggtcggccggacgccagacctgcgatggtctgcgtggcgaccgccgtgaagatggatgcggccagatcgggcttggccgcgccgtcgttgatgagcggctgaagatcggttttggcgaacacgccgcaacgggaggcgatcggatagagcgtctcgtaatgcttggccatgtcgttgaggccagccgcgtcggtgtcgagcagggtggccatctggtcgatgaacgcgccggtgccgcctgcgcaggaaccgttcatgcgctgttcgggagtcggcttcagatatgtgatcttggcgtcctcaccgccaagttcgataatgacgtcggcttgcggatattcctcgtcgatggcgcgggtctcggcgatgacctcctgcacgaacggcacatggagattatcggccaaggcaaggccgccggaaccggtgatggccagacgaatcggctcgtcgccgcggccacgggcctcaagttctttgtggatgtcctccagcaggcccgccacggtggcacgcacgttggcgtggtggcgacggtaatcggagaagagcaccgcgtcgagcgaatcggtctgatcgagcaccacggccttcaccgtggtggaaccgatgtcaagacctacgcgcaacggcttcgtatcgcaggtgttgtctgcggtaactgctgcttcgaccatgtactgtacctctatcgttctcatccgccgggttgcgtccgtgccaacacgaacgccctgccccggttatccaagtatgtaatggtagtctgtgcccctgcctaattcggcacggtatcgcataaagcgcacgacacgacgcataattagacaacgaatatagtcagcttgcctaattccaaccgtccgtacacgaaccgttcgaaaccattcaggaagccgccccctcccctgcgacgcggtccttgccgtagatttcgggaatgaaccgcgtctgatcgtgtagtttcgaccacagcaccacctgcccgctttccaacgacttgggcacatcgatgatgcgctggttggagctgccgcgaaactgcagcagcgaatcgtgcagatccttgatataccggccatccacgaggatatcgatctgttcgagcagttcacgcttgtcggggctttcgccttcgcgcatgagctcctcccacgtgtagcccgtccagcaccagatgtccttggtgcggccgaaccgctcacggatcttgcgtgaaagcggcagcagcacgccggtgttgagcagcggctcgcccccgaggaaggtgatgccctgcacgtacggcaggctcagatcggccatgatctgagcttcgagccggtcgttgtattcgtggccggcgcggaaatcccagatcgacgagttgtagcagccttcgcagtggaatgggcagccggagacgtacagcgagcagcggattccctcgccgtcggtcatgaggaaccgcttgtagtcggcgatcatgttgtggctcatcgcgttcgtccattgtccggcgcgcgggttgctggcgcggtttgtcggaatgaacggcccgcggccggtttcgccggccgcgaaatcacggcgagacacagcgggatcggcgctgcttaccatacgttgctcctgaattgcctgttgttttgcgattattgcgattgattacttggcttcctcgaaccattcgcgttcggaaccgtcgtcaagggtgacatggccggtttcgccgctcatgtgcttgacgcggtgcgcgatttcctcgtgtcggccgtgcaccatcgggcgctgcaccggattgccgaggtagccgcaggtgcgcttggtcacgttgcagcggtccgggtcggagttgccgcattcggggcacttgaagccttcttcggtcggttcgaagtcaccttcgaaaccgcattcgtagcaacggtcgattggcgtgttcgtgccgagatagccgatgccgatggtgtaggcgtagtcccacaccgcttcgagcgccttcggattggcctgcaggcacgggaattcgcagtaattgatgaagccgccggaagcgtagtacgggaagtccttctcgtagtcgagcttctccatcggcgtgggctgcagccacaccgggtagtggaaggagttggtgtagaagtcgtggtcggtgacgccgtccacttcgccgaacttctcgcggtccatgcggttgaagcggtcggtgagcgattcggccggcgtggagtacacggagtagtggtagccttccgcggtgctccaatccttgcacagctcgttcatgcgcttgacgatggacagtgcgaattccttgccttccggatcccagtcgtggtcgcgcatccagtccttgccatagaacacgctggtcgcctcatacaggccgatgtagccgagggacacggtggcgcgttcgttgcggaacagctgatcaacgctgtcgttggcgccgagacggccgaatgcgccgaagcggaacagggtcggggcgttgaccggagtggcctgcttgcaacgcatgatgcggaactgcaacgcctgatgggcgacggccatacgctcgtcgaagatcttccagaagcggtccttgtctccgtgggattccaatgcgatgcgcggaatgttcacggtgaccacgccgaggttcatgcggccgtcctcgacatccttgccggtcttcgggtcgatccagccctgcaggaaggaacggcagcccatcggagctttgaaggagccggtgatcttcacgatgttctcgtagaagatgacgtccgggtacatgcgcttggtggcgcattcgagggccaactgcttcaggtcgtagttcgggtcgcccggatcggcgttcacaccgtgcttgatggtgaagacgagcttcgggaagatggcggtgtgatgctcggaaccaaggccgcggatgcggttgaggaagatggcgcgctggatttcgcgcgcgaaccagtcggtgccgagaccgaagccgacggtcacgaacggggtctggccgttggacacacggttggagttgatctggtattccatggtctgcatggcgtcgtagatggccttgcgggtctggatcttcgcccagatctcacgcagctgctgcagacggtcggacgtcttgtcgaacggctcgtccatcggcagtgccggacggtccttttcgaaatgcaggcgcttcggctcgacggccttggccatgcgcacctgacgttcggcgatctcgatcggcagatcgtcgggcatgatctcgtgggcctgctcaaggaacttgtcgtagtccttcttggcgtattcggcgaaatgctcgtcggcgcggttggcggtctggccaccgtactggctggaggccacgtccttcatgatctgggtgatctgcgtggcggcgatggagatgctgttcggcgaacccatcggcgcgttgccgagggtgaagccgttggcgagcatatcccagtagttcggcagcgagcagttggactgcgcggtgaacggcgagtaatcggcgtcgtggaagtggatgtcgcccttcatgtgggcgttggacaccgcgtccggcagcatggagaaggcggatgccttggacaccgcgccggccagcaggtcacgctgggtggagtagacgttggagtccttgttggcgttctcgcgcaccagagcctcgtcacggttcaccagacgcttgacggcttcgttgatgtcggtggccttggcacgttcgatgtctttgttcagacggtagttggtgtacgtgcgcgccacatcatacaggtgatcttcgatcaggccgtgttcaacgagattctggatgtcttcgatcttggcgggaccgttgtaacggtccttgatttcggcctcgacctgattggcgatgtcgcgaatcagccgttcctcctgaggaccgattttcttgtcgaggtcggcgaaagccgatttcaccgcgctgatgatgttgatcggatcaaaatcgaccacacgcccgtcgcgcttctcgacaagcaccttgaccatttccggcgcgttctcggtttcggtcgcaacgccttccagagtctgggtttccatgtatatttcctttccgggccggacccatccggccaggtttcatgcttcgtccgcatgcccgttcgtacctacagatgcacactctacgccaaggtcggcactaaatgtagtgtcaccacgccgctagagaaactatatattctacttttggcgagatttcgccattttttgccttgtgtgacaaaagtaacgatttcatctcggagtgtcgttttgacacagccccacacaccgtactatcttcacgcacggagcattcgcaacactcgaacatatgttccatttgtccgcaagatgatggaatcttgacttatgacttggaacccggattacaacccaccgacggcgcagcggacgtcgaagccgctgccccgtctggcgtcggaaaccaccgccgacaacccttggccggtgagcctgctcagcgagaagttctacacggcggtcgaacgttggccctccgtatgggtggccgggcagatcacgcagatcaacacgcgtcgtcagggaagcgcctacatcacgctgcgcgacgaccagcaggacatcgctatggaagtcaacggcttcggacggttcgccgcggcggcggcgccgtttgtgcagggcgaccgtgtcatcatccacggcaagccgaacgtgtggatgaagcgcacgtcgctgtcgttgcgcggcgacgcgatcatcgcggccggcgcgggcggcagtctgaaggccatgatcgacgagctacgcaagaagcttaagggagaaggtctgttcgacgccgatcgcaagaagccgttgccggaatttccgcattgcatcggcttgatctgcgcgccgcaggcacgtgcggaaggcgacgtcatcaccaacgtgcgtctgcgttggcccgtcgtcggcttcaaggtgacgcatgtgcacgtgcagggcgagcagtgcccgtcggacgtggtagcggccatccggcagctggatgccgatccagatgtggatgtgatcatcgtggcgcgtggcggcggcgctttcgaagatctgattggcttttccgatgagaacgtggtgcgcgccgcggcggcggcccacactcccctgatttccgccatcgggcatgaggacgattggaccctgctggatttggtggccgacctcagggcctccacgccgaccgacgcagcgaagaaggtcgtgccggacgtgcatgagcagatgcagctgattcaggtgaacctggaccgcatgcgcgtgcgcatcgacgccaccgtctccaacgagaccaggcttatcgaaggctacgcgaaccgtccaagcctcacccagccgctcaccatgttggaaccgcatcagcgtttccttgatgacgcacgcacaagaatgcggatcggtctgacccgtattcttgacgacgcgagcctgaccatcgagaaagcgcacgcgtcgctgaccgcgctgagtccgcaatccacgcttgaccgcgggtacgcggtggtgcaatgcgccgacgggcatgtgcttgacgacgcggacaaggtgaagacgggcgaccagctgaccatgaccttgaagcacggcatcgtcgtgtctgaagtgaaaaccgtaacgaaggagtagcacatgagcaacgaagcagcaccggcatccagcctgaccgacaaggaacgcgaagcaatcgcgcagatgccatacgaggaggcgcgcgacaagctcatccaggccgtgcaggcgttggaggcgggcggcctgaacctcgaccagtccatgcggcagtgggagatcggcgaggcgttgtccaagcgcgcgcagagcctgcttggcgaggtccgagccaagctcgacgccgcgcaggcagagcaggccaccgcggccaacaccgcaggcacgcaagacaatctggcctgagcatccgtcgcggcacagccgctcccctcacctacggacgttccaccggaacgtccgtcaaacggcttgagcccgaacaatcaggtccgattacccgtcatgtcgagtccatattgtgtgtacaatggtgactcgttgcctcagtagctcagtggatagagcacttctctcctaaagaaggtgtcgtaggttcgattcctatctggggcactttttcatatccccgtacattgtcggcgcgcatcgccatcggcagcatccaagatcaatcgcacgtccgcaatccggacaacaccatctcaccgccaccctccagcacaggcacaatgaccctccctctgttatagtggcaaacggatacttaagcggttgagtgaatgtatccaaaaggttcccccttctgctatggaagcatcggaaagcaaccgcacaacccatacatcacctttggaagaccaagggatcagcatgcaagacataccatatttctctattgtggaacggctggcgcacacgaatccggtaggacagttgcccggaccgctctcctacaagctgctcgaccagttcaccatgccgatgctgcccacagaaccgcaatgcacgaacgtcatcgcctgcatctgatattcgaataacatgccggtcgtcaccgtctagccacgggcttagccgacccgcacaatcgccagcagcgctttgtggtcgctgccgtccactttgactgtgcgcacctgtccggcctgcatgccggaatccagtacgatatggtcgattccggcgaacgacggcacgtaatcgacattcgcaggccatgagaatttcaatccctcgccggcctgacgggaggcgtcggagaaacggtttcccagaatgttgcggaacggcgtatggtcgtacgtcgcgttgaaatcacccatgaaaacgtaccgtcggctagtgtcgaaacgtagtttcgccagttcgtcgagcgaccgcttccactgctgccagtaatcgttcgtcggcgacgtggtatgcacggatacgaaacgcacctgcgtggctcccccattgaacgaaacggtgccgcccggcatgaacgacgcgctcgaatcgacatcgtcatcggaagggtcgtcaagcggactcgccgaccaaaggccgttgccgtacacgccgtccgaactcgacacctgcgcatagggcagatacgaggcgatgccggcacggttcagatcgtccacgaaagcgtcggtcgtctcctgcaacgcaagcacctcgacgtgttcgctgcgcaccagatccacgatctcacgcgcatcggcgcgccctttgtacacattgcacgtcatcagccgcgcgtagccgtcatccgtgttgacggtttcgccggacgccgccgcgactgcggcacgtggcagtttcgaaggctggtagaagaacggatactgccagaacgcctgcaacgcaatcgccagaacggccatcacgatggacaccgtacgtttggagacgatggcgcagacgagcgcgattacggcgagcagcgtgaaccatggcactagggagacgacgatcggcatatacggcaacgcctgcagttcttccggcagaatgtgcgtgacagtgcccagcagcgcggcgagcgcgaatatgaaggcaatcaccgcgcagatgaagttgcgtacgcgatgcgttttcgtcttattcagcgtgcgtagcggcttgaccggtctcgttgcggccggttttgccttagcccgattcgctttggccgacgcttgcgatttgcccgttgccggcccttgcggctggcgtgtttttgcctgagccataccattcccttgttttttcggaacgcacgtccgcgaccatccatgtccgcccgtgtccgtttatgtccgttccgttgatgttccgacggtttccttcacgccttcggcttagtcgtcgaggccgagctcgtggcggatgccgtcgatgatgatgcggctggcggtggtgccgcgttcacgcgcgttttcctgcagcatcattttcagatcggatggaattttgaaactcatgagcacacgttcgccgttgccgttgccattgccacggctgcgggtgtcctgcacgctggtcagcggagcggtgaacgctgccttcgcaccaccgttcggttttctaatggccatcaggcgatcgcctcctcaagttcgagatacacgtcttcatacccattgagattgctgggaaatgcgtggccgatgactttctgcatgcccacgcgcttgggtacggacgcgtcgaagacgctggcgccgcgttcgcggatgagattgaccgcattgccggccagcttgttgttttccactttgagcagcagcagcgcgtacggtttgccggccgcgtcgaggctttccgcggtttcgagcgcatggctcagttcgaatggcccctgggtggccggaacgatgacgaaatcggccacatcgcaggccacgtccaccacgttgccggccggcgggcagtcgatgatgacgagttcgtcatccgccatggttttgcgcagtcgtttcagtttgccgatattggcggagtccacggtgaacggcagggtttcgccggcgtcttcggcgtcgcccgcccatgtggtggcgtcgccttgcggatcggtgtccagcacggacacgttgcggttgtgccgtgcggccgcggtggccaacgccatggcggtggtggttttgccgctgccgcccttgaggttgatgaccgagatgatcatgaaggttcctccgcttcgacaatcaatttatataagacgtatatactttttatatattggatagacgacagtcacgctgacggcgtaacggcattggcaatgtaaaagatagtggcgacgcactcttgtcagttgctttgacagataacgaaaaatcccgaggagctcagctcaactcgggattcgaaaagagtaaacgcggcgacttgctactctcccacaccctctcgagtgcagtaccatcgccgtgctaggccttagcttccgggttcggaatgggaccgggcgtctcacctaggctatgatcaccgcaagaagaaacaatacgcgaatacgccacattcagcaaatctcggcgtgtcgcagattgcggacaccagcaacccaaccataaaacgatagccaataatcgcactagtactataaatcgcaacgtttttgcgttaaagtcgaagcgatgcttttcacagcttatgaaagaaggccagcaatgacgatcgcctcctgcggttccgtttccgcaatcactttgggtctgccaaattccactgcgattcccgccgagaaggcgaggctgccgaaaggcctgttcgtggcgaagattccggtttccgccaaaacaaagcagcgtttggcgaacgacatcgaatcaatcaccatgctgtcgctgctgcaggcgcgcaatatcggactcgccgccggtacgcgcgtgccggaaatactggtgatcggcctgcgtttgcacgaaccaaacgccgccgttccgacggatatcgtcgaattgattgcgatgcaacgcaagtcgggcatgctgttcgtttgcgtacgcgacgccgatttcgaaggtacgacgcgtcaggagtgcgcgttcgccgtccgtcgagcgctgccggcacgtgccgggcacacgaccacatccaaggtgttcgcttccgattggcagccggccggcgaggccacgctgaacgccacggatccggcggtcgattccatggacgccttgtgggagtcgctatgctcgcaggtgattctggacgacccctcccccatcgacgtgaacacgcgtcttgcccgacgcatgcagattgcgcatcttaccgcgcaagtcgataagctcacacgcgaccatcagcgtgccaagaatcccgaacagcgcaatgaaattttcgcaaaactgcacaaaatgaagaagcagttggaggaattgcagcagacggaagactgaaatctgccgccaaaaatgcaggtgcccatcctcaaaaatggaggatgggcactattcattgcaatacgaatcgcaataatcgcaatacaaacgacgattgcagcagcacgaaaaacgcgaagcaggaaccgctcaaccgcgcgccttggctacgaaatcgccaagtcgcttcaatccttcgcgcagggcttcgcgggaagccgcgtacgacaggcgcacgtgcgtgtccgcggtggcctcgccgaaatcgcggccaggcgtcaacgcgatatgcgcttccttcagcgcacgctcgcagaacgtccacgcgtccaaaccggtgctggaaatgttgaaatacgcgtagaacgcgccgttcggttcgacttccagcggtagaccgatctcggccagaccgtccaccacaatgcggcggcgctccagcagttcctgacggcgttcctcgcacacggccagcgtttccggcgtgaagcaggcgagcgccgcatgctgggtcggcgtgtgcgcgcacaggaagaagttggtggcgaggtcgtccatggcttcgagcgcgtattcgggcacgaccatccagccgagcctccagccggtcatgccgaagaacttggagaagctggagcagacgatggcgtccggatcgcaggccagcacggatttcacgtcggatccgtccggttcgcggtcggccaggtcgaggtaggtttcgtcgacgatgcgccatgcgccacgctcacgggctaggtcgcacacggctttcagggtgtcgaaggcgatggtggtgccggtcgggttggacggcgaagtgatcatgacggccttggtgcggtccgtccagtattctttgcacagttccggcgtcaggtggaatcgggtggcggcggacgtcggcacgtccacgactttgccgccgaacgcgcgtaccagctcgcggttgcacgggtaggacgggtctgcgatgagcacttcgtcgtcatcgttgaccgtcagcgcggcggacagcagcagtgccgtcgaaccgcccgcggtaatcgcgatgcgtttcgggtcgacgtcgacgtggtgacgttccttatagaaatcggaaatcgcctggcgcagttccggcaggcccatcgccgcggtgtacggcagcggacggccgtcatactgttcgcgcatggcgtcacggacggccggaggagcgccgaagtccggctcaccgaggctcagcttgaccacatcggtgccgttggcgatcatctcatcggccatggctccgaacaccatggcacggaacggattggcaatctgcgcgcgcttcgacaactgcggctgcgcgccattctcaacatttcccatattcctgtttttaccacgtttcgtacaacgccgcctgccgactgtcatttcccggaatcgtccgcctttccggaatcgtccacgatttcgcggtaaagacgttccaaccgttcgtcgcgcactttcttgccgagctcgcattcccagaccacgatgactttccagccgtccgcttcgagttcggcgcgctgcctcgcgtctcgttcgtgattgcgcagcagtttcgcggtccagaattcgacgttcgatttgggcacgcgtgtggctttcggacagccttcgtgcatgtgccagaagcagccgttgacgaatatgatcgtacggtattttggtagtaccacgtccgggtggcctgggtatcgcttgtcgtttttgcggaatcgcaagcctttggcaaacagaaagctacgtaccatccgttcgatggatgtgtctttgccgcggatgtgggacatggtatagctgcgcgtgccccgctcgtatttttcgggtttgccggtttttctaggtttgccggttttcttgggtttgccggtttttccgggtttggctgtctgcctgcgatgctctgccgtcacggcttcccattatggcaaaagggccgatcaatcgttttcgcataacgcgtgccaccgtcgcatgtggcgtacgctggtcattgcaacgtagcaaacaggcagttcaaaacaaggagatttcatggcacagatcaatgtggcgattctcggcgcgggccgtatcgcgcagagcatggccgaaacgttggtgaaaatggcggcggatgaccggtaccgcgatctggtcgcaccgtacgcggtggcggcccgcgacggcgagcgcgcagcggcgttcgcggcgaaatacggttttccggtgtcgtacggatcgtatgaggagcttgtcgccgatccgaacgtgaatcttgtgtatatcgccactccgcataacttccatgccgagcaggcgattttgtgcatgcgcgccggcaagggcgtgctggtggagaaggcgttcggcgcgaacacgcagcaggcgcgtgagatattggacgtttcggatgagaccggcatgctgtgcacggaggcgatttggacgcggtatatgccgtcgcgtggcatgatcgacgatatcatcgcgtccggcgtgatcggcgaggtgcaggcgatcgacgcgaatctgtgctatccgaccacggcgaaggcgcgtatcaccgatcctgcgctggctggcggcgcgctgctggacgtcggcgtgtatccaatcaatttcatcgacatgatcatgcataatgcgccgatcgcacgtgttgaatcgtcgatgcaaccgtatgaaaccggcgtggacgcgcacaattcgatgacgttctattaccagaatggtgtgatggccaccgcgcaaagctcgattctatgccattcggatcgtatgggcgcggtgtggggcacgaaggggtatctcacgtgtcagaacatcaacaatgtcgaggcgattgacgtgttcgacggctcgcatgccgtcaccgcgcattatgacgttcccgaacagttgaccggctacgagtatgaggtggcatcggccgcacaggccatgctggacgggcgtaccgaatgcgatgagatgccgcattccgacacgttgcgcatcatggaatgcatggattcgctgcgtgcggattggggtcttaagtacccgttcgaagcgtagcgatgcgatcgatgacgtgggcgtgacgcgctccgcccacgttataattgccccttgcggcggtttggaaacgcatggaaggagcgtcatgggattgctgaggatgctgaagtacgtgctgggcacggaagatgagacgcagcagccccggcaaacgcaatcctctgccaagaatgccaacaacgccaagcctgcgcggaccggacagaccaagcagacgggacaggttgcgcgacgagtcacgcaaccgcaactgcaaccgcatgccacgccgcaacgtcaatcgcaacgccgtcaatcgcagcaacaccaatcgcaacggcctgcaaagctcaccccgcaaccgctgttgccagccgaccgcatcgacaaagcgcgtgacatcatcggcaatatcgaaaagcacgaattgagcgacgagcagatcagcgcgatcgccggcgcaggtcacaacaccctcgtacttgcgggcgcgggaaccggcaaaaccactaccatcgtcggatatatcgcatggctgcttgccacaaaacgcgccacccccgaagagattctcgtattgtcgttcaccaaggcgtccgcggacgaaatgtcgcaacgcatcatggcaagcaccggcaaaacgatccgcgcatgcacgttccacagtctcggcctggaaatctgccgtgcggccaccatcgccaaccgtcccatcatcgacggccatgcgtcgaacgccgtggtacgagacacgtttgaccggctgctcgcacagaacatcccctaccgtctgctcgcattcaagctcatgtcgaaggagctgttcggcaagtatggcgccgccgcgaaacgtgaggatttccaactgccgacggatgattacgctttcaaccagtacaggcaaagccttgtcgagaacgcgcagaccatcatccagcacatgcggcagaacaatatcggcatcgacggcatgcgcgagctcaatgagaggcgcggcggcaaacatatcggccgtaatcgtgagatgctgcagctcgtcgagccgctgtacaacgcgtatgtcggcaatttccgcgcgacccagggcatcgattttcccggcatgatcaccgacgccattcgctgcgtaaggcgcggcgcataccgccacccgtacaaatacgtgctcatcgacgaataccaagacatgtcgcggccacgttacgagctgatccgcgcattgcgagagcagagcgatttcacgctgttctgcgtgggcgacgactggcagtcgatctaccgtttcgccggcagcgacattcacctgattctcgatttcgccgatatttggcgcgattgggggccgacacgcatgttccagatcacgacgacgcgacggttccggcagagcctcatcgatgcgagcggcgcgttcgtcatgcaggacaaaagcctgtacgccaagcaattgcgcaatccgagcgacaagaaggattattcgctgaaggcgcttggcggcgcgacgcaggaggagcggttcgatgcgatcgtcgagcagttgcgcaaactgccgaaagccgcgtcggtgctgatgctgggacgctaccgaagcgacctgaacctgctgtcacgcaacgaccgcgacgggctgttccaaatcgacgagcataccggcggcatcgtttttccggaaaaaccggacatggacatcaaattcatgaccgcgcacgcttccaagggtctgcaacgcgatttcgtgtttctgctgtgctgttccggcggtttgaagggtttcccaagcgcgattccggaagagccgctgctcggcctgctgctgccggaagtggaacgcatgccgcacgcggaggaacgccggctgttttacgtggcgatgacgcgttgcaaaaagaagctgtttttcgtggtggaccagtcgcgtccgtcgcgtttcatgtacgaattgcacgacaagatctgcccgaacatcttccgcggcgtgaagctgccggcgcaatgcccgaattgcggtgaggcattgcgattgcggcacaccggctccgacccgtcccgcgcgttttacgggtgcaccggtttccccaactgccgatacaccaggccatgcaagtgacaccattgggactgatttccatcgcgtaagttgctccccattcgggcctggcgtaatctcccccgttgtatcctggacctgttcattagtcaggagaaagcaatgacggcaaccgaccagaatccgcaacagtcagcgcaaccgacaccgcgcaaaaccattaacgtcgtcggcgcggctatcgtcaaagacggcaaggtgctgtgcgcgcaacgcggagaaggccgatcactggctggtttctgggagtttccgggcggcaagatcgaaccgcatgaaacggcgcgtcaggcattgcatcgcgaaatcgaagaagagttgctgtgcgaggtcgaagttgccaacgaagtgtgcacgtcttcttacgattacgatttcggtaccgtcgcgctcacgtcgtttgtgtgccatttgataagcggcgcaccccatctgaccgagcatcatgagattcgttgggtagcgcccgccgaaatgcccactttggactgggcgcccgccgaccgagaagcggtgcgattgatctccgccatggattttccggcttttccggcagccacgcacgaaagtgacgactgatgatgcgcaatatggacgaccatgaccattcctcccttgttgaggcgctgctatccggtttcatcaacaaaaaggacaatgtcgacgcacagtacgagccgacgttgatcgccaaccatgacggtcggaccatggaatacgccatcaaggacgaactgcaacgcagtcaggatttcgacatgtccgtcgcattcgtcagccagggcgcgttgcaggtgcttaagcagtatttccttgatttcgccgacaacaatgaccatcaggccggtcgaatcatcacgtcgacgttcaattatttcaactctcccaaagcattcagggaactgctgaaacttcagcgggaaaccggcattcaagtgcaagtttggcagccggagcggtccagccgaaacgatgacgatgccacagctgcctacccttatcatcccaaaggctatgttttccatcatgcgcaaggcgacgagccgctgtattccacgtatgtcggcagttcgaatctcaccatcaacgcgctgaattccaatcgcgagtggaatctcaaagtcgccaccaccgataccagcggtcttgccgaacagcttagcgaggaaatcgaatcgcaaatcagcgaatcgaagccgctcaccgacgcttggctgaaactgtacgaggaagacttcaaaaagtacgcgccgcaacggccgaatcgcaagccgatcgaaaaaacaagccaatcgcaaaccattcagccgaacgccatgcaggtggaagcgctgatgaatctcgcacagctacgcaagcagggcgaaagccgtgcgatcatcgtttccgctaccggcaccggcaaaacgtatctgtcagcgttcgacgtgcggcaggtcaaaccgaatcgcatgctgtacatcgcgcaacaggagcagatcctcaagaaagctgaagaatcgttccaaaaagtgcttggatgcccgaaaagcgaactcggcctgttttcgggtggcagcaaggaatcggatcgcaaatacgtgttcgccaccgtgcagacgatgtcgcgtccggaaacgcttgcacaattcgacgcagacgagttcgattacattctcgtcgacgaagtgcatcatgcggccgccgaatcgtataaacgcgtcatcgaccatttccagccgaatttcatgctcggcatgaccgcgacgccggaacgtacggacggtgcgaacatcttcgaattattcggcaacaacgtggcctacgaaatccgcctgcagaaggcgcttgaagaggacatgctctgcccgttccactattacggggtgcacgaatacattcaggacgcgcccgacgagaagatcgccggcaaagacgtcaaggtcgagtcaatgaccgaccaggaacgtaacgagctaagccgttggcttgaagaactcgccgacccgaaccgcgtgcgctacatcatcgacaagatacagatctacagcgaggccggaacacccgtgcaaggtctggtgttctgcagccgacgcgaggaagcgaaacgactgtccgacctgttcaaccagcagatgaaccagcaggcggaacggccataccgcacgaaagccatcaccggcgaaaattcgcagatggaacgcgacactgccgtggcacagttggagaacggcgaattggactatattttcaccgtcgacctgttcaatgaaggcgtggatattccacacgtcaatcagatcgtgatgttgcgtcaaacgaagtcgagcatcattttcacgcagcagctcggccgtggtttgcgcaaggcaagcggcaaggattgcgtggtcgtcattgatttcatcggcaattacgcgaataattatctgattccgatcgcactgtacggcaataccggcgaccgcgacgtagcccgtaagaatctgcaacgcgaaaccatcggcgtctcgtccatcagcttcgacaaaatcgcccgcgagcgcgtgcttgcctcgcttgacaccgccgatttgtcgaatatgaaattgctgagccagcagtaccagcagatgcggtacgaattgggacgcatcccgatgctgatggatttcgcgcgccgtgacgcgtcgctcgtgttcacgatggctgcgaagaacgacgattatctgtcgttcgtgcgttcccgtgagaagagcctgtcgcgtggcaagaacgcaaccgtttcgtatcttgaacagcttgaatcgacttcggatgcgcacaatggtgtgctgaaaatgttgaccgccacgcaattgcgcggcttgcgtccgcacgaattgttggttttggcggcattgtgcggtatggattggcagcggatcgatccggattgttccgaggatgcgctgactgcgcttcgtgaggtcgcttcacagcatgcgatcacgatcgtcgatttgcagacgttgttgactgcgctgttccccgatgcggacagtaacgagttgcaatgccgttccgcgttcgccacgttggattattcctatttcatcgccgcgaacagcaaacgtttcgggcagactcctttggtgcgcctctgcgatgatggggcttatcggttgaccgacgagttccgctcgatgcttgaacagaccactttccgcacgttcttcacggataccgtcgaagccggtctgttcaacgcgttggcgttggcggaatcgtcccgcaagcatcatatccgccagaatcatgggttcctgtatggagaaaagtacagtgtgttcgatgtgatgcgactgtgtggttggcctgcggaacaggtgccgcagaatgtcggcggatacaaattggacaccgaaaccggctcgctcccgattttcattaaatatgaggcgagccagtatggcgaccggttccttaatcccggcgagatcgaatggttcagcaagaacaatcgttcgcttaaatcaaacgaattccggtggctgctggacggaacggaacgtactccggaatggcagaatcgccattttgtgccgattttcatccgtcgcaaagccgaagaacaggagaaatcctattacttcgtcggcagcgcggtcgcattggacgatgtgcacgcgtcggtgaaccccggcgaggatggcagcgagtcgaaggtggtcatttccacactcaagctcggcaaaccggtcgatccggaactctaccgccacctcaccggcaagtccgccctgtaattcgcgaccttctgacacctatctcgcttatggatggcggttccaacagcaaaaacgaagtttgggggtatgaatcatacccccaaacaagcgatttacttcagtacaccgccatccataagcgagataccagcagacgcacatgaaaatccgccatccataagcgagatagccccgcaatcactccagccacacatcgaaacatataaaaagcggcttgtgtatatacgttgtatgtacagcatatatacgcaagccgtccgagctgaaagtagccgaaactacggaaggtcactcaccgaccgtcggcgtagccacccatgtcgggcccatcgaaaccgccgtcgaagccagggccgtcaggacccgggccgaatcccggaccagcaggaccacccggaccgcccaggaattcgcgcgccgacatgccgttctccctacgggaggcatccactgcttcctgcagcaccttgcgaacttcgaatccgttcagcacgttcttcaatgccactacgccattgccggacgactgatcgcgcgtatccagcacaatcgtgctcatgccgaagatgcgctgcaggaacgtgcgttccacgctgatatccacgatgcggaacagtttgatcaagttgaaactctcgttcagaatgccggttttgacgctcagctcacggtcggtaagtgtgtacacggtgaacgtgaacggcgtacggcaccaattgcgcttacgctgctgccacaggacattgccacttgcaaccttcatatggttcccccttttcatcagaggcctaattggactggccgccctatgcggcacagcacaccattctaccgtcacgctcgcacgaacaccgttttatctatcgcacagcgcagacgtttcacacactgtttcacacgtcgttccgtgtagggaaaagagacacttcacagcacgcgcagcagcttacgcagcaactcgcgccgcatccgtcacgtcgcacacgataacgcaaacacaggcgagcgccgcttccgcggcattggcaccaatcagcaccacaccgtcaaatcagttgtagcccttcacttcgcggaagatgccgctcaaattgccgttgcgtccgtcgaacaccttgccattggacagcttggccaaatcgttgagctgctgcgaatccgcgtcgccgaacatgatggagaaaatcggaacgcctttgccatcggacgcatactgctgcttgaactcgtcaagcttcgccgtgtccgactgcccgtcggtcagcagcgcgatcgccaccgtgtaatcgtcgcggtcggacggcagattcttcaacgcgacttccagcgcattgtagatgtccgcattgccatttgccacctgattttcgctggcggccagcaaggtcgcggtttgcttgccttgcgcgacctgcgccactttcgcgctgctgttgaaggggatgaacacgttgacgtcgtcatcgcccggctcgatatgcgaggcgcgtgcctgatcggcgtcgagggccgcctgcaaaccggccacggcaccgcttttgcccttgcctgacatcgatccggaataatccaccacccacaaggtgtaagcgggcttgcgcaggacggtctgatactggtcgagcgcctgttcgatgatgtcggaggatggcatggtgatggttttcagcaccgatgaatccgatttgacgccccattccttacggaacgaatccttcaccttcgcatctttggcatacgccagcgtgccgtccgaaccggttctacgacccgcctgttcgaacagtttcttggaatccttcgacgtgatcgacttgctgaatcgcttgaacgcatcctctttgtcctgcctgcgatccacgtaagcaagcggcgaatcggaaatcgcgatgccgtcggacggatagacggccagcagcggctccttgttcttcgccgtcaacgccttgtccgcctggatgacgagcgattcgtagttcaccatggaatcgttcgtatccgggtcgttgacgaccatgtccttcagccagtcggacgagccggatgaacgattgacgcccgacagtacggttttcacggacttacgtaatgaagcatcgttcaaatcgtctttggtgagtgccgacttaccgccgttcagcgccgtcagaaacgccatgtacgccgacgctccggaattcgattgcgtggcggacgtcatagcgaacgacagcttcttggccttcaccgcatccataatgtccttcgtggacaccggcttcgttgtaccgtccgtattcgcccagccgagttcctcagccttgctttgcttcacgccgaacaccaccggcgtggtggacgtggagacctggtccttgacgacgtgcttgatatcccccatggtgatccacatgctgctggccggccagaccgcatcgtaatccctgcccgcgtgatggcctttgttgcgcagcgcgtccataacgtccaacgaccccatgtagtcgacggtcactgacactttcgattgtttggccgcctgttcgatggccccgctcacttccttgttttcggagccggaggcgatgcggatggaatctttggcaccgtccacggaatatgtcgcggttgtgccgctgttcgaatcgccgtccgacgtcgcattggaagcgctgttcgtcgaaccgcatcccgtgaacagacctacgatcaaagcgatgaccccagccgccgcaccaagtttgcgtgcgttcatcttgtgttggccctccgttcatattgcgccaaaaaccgttcagcgcacccggaaaacatttccgaatgcgctgaaaacatgttctgttatgtgcgattgattatagtccgattttaccgaacggccattttgccgtctcattttcgtcattattttcgtttccccctcattccgccctttccgctctcttccacagacgtagccgacgccgcctatacttggtgcggctacttgttgcggcacaatcgcaactatgcaatcacaggcatcgcaacggaaaggtgggcgcatgggcagcttcaatcgcaggcaggaagccgacgatctcaccgactacgtcaataacggatggctcagttccgccgaattcgacgggccgactttcctgtggaatcatctcatccgcgaagcaagccaggaggatgccgcgcaacgcaacgatgtgccggtcgccaatctttccgacgcggacgtggtcatcaacatgcccatgcaatggtatttcgacgccctcgtctccatggtgcccaccgcggaacgtaccgatacgggcgtggagattccacgcatcgatatgccgacgttttcgatcgattcgcaggcgctgtccggcgtggacgcggtggtcggcaacgcggtgatcagcacgcgatggcttgacgcggtcggcaatctcgccaaagctgtggagatgaccgcaaggttcgtcggcaatgtggccgaccgtgacaacgagggtttcgactacctgaaagatctgattcagaccgtacgcgtgtacatggatgccgtggcctgcaacgccgatccgatgacgggcgagcaggcgttgcgcatgatcacgcaggtggcgtgcaatgaggatttccggctcaacgccatgcagatggtggagttgttgtcttgcggactgtcgttcgcgcaatgggatgatacgcgcatgttcgcctatgacgcgttgaacaagggcattgccgcgatgcgcgatttcgcagcgaagtccggtaatggcgatgcaagcagcacgactggcgacactacgaacagcgtcggcagtatcgacagtgatgttacgggcgatacgggtgcacgcgacgccaccgcaacgcaatcgcatgaccttcgtgatacgtcctctgacgcggacaatgcgcatagcacgaatagtacagacgctgcggacggcgcggataccgcgaactcgatcacgcattccacgggcgctgccggcgattccactaccggcggttcacctaccctctcccccgaggaactgaacgatctcgccatgcttgacccatcattcctgtccaaacagcagctcgcgcagaccgcgcaaaaccagttcgaccatgccgtgcagttcctgcggcacgatctgatgcggatcagtggcgatgccgaggaggccgatcgtttcctgcgcgacaaccatacgtccgagccgcttgccgacgcgtacgcggcgcggctgatcgctgccgaacggtggcaggatctgctgaatttcgtcgatctggtggagcgtgacgcaccgaaccagtgcacggtcatgttccccgaggaagtggtgccgtacgaatgggagtcgattcgtgaggccgctttggaggcgttgggccgcggcggagaactggtcgcgatgtatcaggagcggttggatgacacgtacgatcccaacaccgagctcaatcgtatgaagcttcaggcgtggactcaagccaaggaataggcggcgcacggctcagcgcatccgccgccagttcctcatctatcgcaggcttctgctctcattcccatcagtatttccaccatcgcttccacaactgacgcgcaacgtggccaattggaacggatgcaggctcagcatcgctccttgcgtcgttcttgccacggacggatcaccgtcggcaaaagccgcgggcaattcggcatccagccgcgcatcctccataatggaacactcgcgtaccgtggccttccccaaagcggcgttgacggcaagtctcgcatgggcttcgccgccgaccgcctcatagacgcgcagtatcagatctccggaaccgtcatcggcaagcttgacccagtcaagcaccatgacgccatccaccgggttgagctgcgccagcggatcgaacgccggcacggctggcagcacggccgcgttgagacggttcgcctcgtcaagcacagccggcatactggcatccgccacaacgttccacgcgaactcatgcacgcccttgtcagtgttcggatcggggtatagcggggacgacagcaacgaaagtcgaatcatcgtgccacgcaccggcccggaagccgtgttccggtgaatcggcgaaacgtcggaaccgtaggtgctggcgttgacgaccgcagccgcatagccggcatcggcgacgcgtacgaaccggtgcgtgcagctttcgtatttcgcctcgtcggaacgtgtgttcttctgaatgggccgttccaccatgccgtactggcattcgtactgcgcccggtcggcctggatagccatgggaatgtcgactttgaggaatcgttcggatgcccgccaatccactttggtccggaattcaaggcttttcgactttgcccgcaatgtaatgcaggcatcgatagacaccccgtcggcggtgctggacacgtgcacggtggctccgccgcgttttgtctccgtcactcgttccacatgcgagtcatcgatgccttcggcgctgaggaaggcatcgcgctggatgtcccatgcgtcccactcgtatggctcgtcgcggagaagctcgtaatgcccgattccactgccgtcgggcaccagttcgtgtccattatcaaggtcgatcagtgaacggaccgtaccgtctggtgcgatgatggcacgtagcaaaccgttgtcaagtatgattcgaccgtcgtcgcatgtcgttgcgatggtggattcatcggcgaccgcgtcggtgccgttcgcgtcatcatcctgcgttcccactgccgcggtgcgagcaatccacgaatcgccattctttgccgtatatgggacgatggccgcgttcgatcgcatgtcggcatcatcccgcaccgatgcgatggaagcacccgcttcagcggcgatatcacgcagtcttgcgatgtcgcgcacgtagtccgcacgcgcctgccgatgcacccatgcgatcgccgatccgggaagaatgtcgtggaattggttcagccccattcgaaggaatggtgggggaatttcgtggtgtcgttccatgagatcttctgtgtgaggaaccattcgaaaccggcacgacgtgcgatttgcggccatgccccgcaataaccgaaactgtcgggaagccacagtccttttggttccacgccaagatgctcacggaagtaacgcatgccgaacgtgatctggcggatcagcgactcacctgtgggcagcatgttatcggattcgacccacattccgccgacgggaatgaatcgtccttccttgatgcgctgcagcatgcgcgcgaacaggtctggatgttcctgttccagccacgcatactgttgggcggaactcatcgcgtacgtgaaatccggatcctcgtccatcagggcaagcacgttggacaccgtgcgggccactttacggtgggtttcgcgcacgggccacagccatgcggaatcgatatgcgcatggccgaccgcgacatgatggatgacgctggaatatgcgggttcggataataccccggcaagcttttccttggctggctccagagttccggcgatatcacgctcgtcatatgtgttgagtgatcgttgcagcgctttggccagctgccaatatcgaggatcatcatccttgagttccctcatcagcgaggtgacggtttccaagtccatcagatagtcgaacacgttttggttgaaagcgcacacgtccattgtggtgagcacatagtcggatggacgaccgtcggcacgctcctccagatccatcggcgcgaatggcaggtcagcttcgaccagtggattcgatgcggcctcgacatataccgtgaaacgaccggcatcgtcaagctccacattcgccacgccattggcatcgataagcggaatccagcaattgtctggattcaccgctttgatgacgctgccgtcagtgcgatagcataatccttccgcttggaagcccgggccacgatgtcgtttccgtcccagatctacaaccagttcgacggctctgcctttgaccgactcacggtcgatacgtccacgaacctcgaaccatgtggtaccccatatcgtgccccaggcaccaggaaccatgaagtcgagaaaatccactttgttttccttgacacgggcaagaaagtcggcgctctgttcgggttcgccttcattggcgaaagcgcgtaactgacaatgcgataatgtttcgtgcacatatggcacaagtcgttgccgcatcactcgatcggcacgtctgagttgctgatctggaagaagaaacatagctatcaccttggcacatgattcctatggtgtatccatggtgccacaacacaatctcaaatcaaaaaacatcaaagagaaaagtggttctcaaagcggacatccggtggagactccggataaggaccttcgacgagcccgaaaggcgttgccgggaggcccgggaggtgatgaaaaaatggggttcctggagcgacgcccgccgggaagcccggaaagagagcatgaaaaatgggcctcccgggagccaaaggctcgaccgggaggcccgatacgtttgaagcggcgcgccgccatgcgccaagatttcggagaaaaccaatatgttatttttgaggcttctgctgttttcgtgggttaggttctcggctgtggtaggcgtatgtcgagtccaccgcatcgggagcatctgagcatgcccctgcgcggacgcacgcggatctcgagcacgggttcgggacgcaatggggagtcggcgatgcgcacgccctcgaccaccgtgcctttgacgttgagaagctggttgaacatgctgttcatcaggcgctttttggctgtgtttttcttggtcgttaaacatcctactcaaaaagcgctctttcttactcccacaacggttcaacaacgaacccgcacccacgaaaacagcaatagcgccgcttttctactccagattcgcgtggtactcccacagggaatcgaggtcgatatcgcgtttgcgcaccatggacatggcgatggcgtctccgaccagcagcaacgactgctcgaacaggctggtcatcggctgctggctcggcttggtgccgctgccgggcttgccggcggccggcacatggacaaacagatcggtgtactgcttcatcgggcagtcctcgacgatgccgatgcgcgccaccttggcgccgaaggacttggccttgccggcgatgaacagcgggaatccggttttgccggaaccggatccgacgataagcaggtcctgcccgcagatggccggttcggtgatctggccgaccatcaccgtgtccacgccgaggtgggcgagacgtttggcgatggcttccaatgcgagttcgacgcggccgacgccgacgaagaagaccttgcgggcgttagcgatgagattcacaagtgcgtcgatctgcgtctcgtccatatggtcgagcacgtcggcgagctcttgcacgatgatccgctcgcagtcgcggaatgatgaggggaattgggtggcggcttcggttgcggcggtagttgtgatggtcatgatgatgctttcttgagtgtgggattgcggcaggcggagatgcctgtgggttgattgctcctccggtcggcttcgctgacggctctcctcggggaagggagcccggggctcggcgtggagggtgtgttttcgagctgggccgatggcttcgagggggactgagaagaaaaatcagcgagggttggccgtggtctcgccggtggagtgttcgtaggcgtccatggtgaggcgccaggcctcgcggatatcgggggagcgcttgaagatgccagtgttgccgagcacgaaggtgttcgcgccggcctcgcgcatggccttgaagttcttttcgttgcaggatccgtcgatctggatctcgtagttcagtccttgctcgtcgcggaatcgtgcaagccgttcgattttcttcaggatctcggggatgagcggctcaccgctgtagccgatttcgacggtcatcacggtgatgaggtcgatgcgttccagcaggttctccacgtcggcgaacggggtgagcgggttgatagccacgcccgcgccgcagccgttctcgtggatgatgcgcagcgtgcggaaggcgtgcgcgcccagcgattcgacgtgcggggtgagcatcgtggcgccggcgacgaccaactggtcgatccaatggtcggggtcggtgaccatcatgtgcacttcgttgcgcagtgtgctcagcggcagcatctgctcgatccaggaggtgcacagacccatactgggagagaagtggccgtccatgatatccacatggtaggagtcagccaccgtgttaaggtattcgacctgcggggcgggattgcggaaatcgctgcaatagagcgaaatcgcgaaatggggtgctgagaatggagccgtcattggtgttcctttggggtacgggaaaaagatgaatgtgttgttggtcgcgttttgggcgcgactggccaagggtgcggcgaatcgtccttcgcccacctggctgtttcagggaatggagtcgctactgcctgtcggtgcgcacggccacgcccatggcggcgagcgcgccggcgcagtccggcgtgccttcggtcacgatgacgtccagctcgttgcagccggcgattcgataggtggagatgcggccgaatttctccggtgtgatgaggctcatgaccttggcgccggccttgatgatcacgcgcttggtctccgcggattccagatacggggtggtgatgccgtgctccgggtcgatggaggagacgccgagcagcaccagatcgcaatgcagctgctgcagcgccgtcagggcggccgatcccacggtctccttggatttgtggtttatggtaccgggcagcatgttcacttcgacatggtcgtagtcggacatccacagcgcgacggccgggctgttggtgatcaccgtgccctcccagtcgcgcgggaaggcctgggcggccagatagttggtcgagccgccgtcgatgaagatcacgcggttctcgcagatctcatccatggccagttcagcgagccgctttttgacgtccgcgccaaggtcgacgcggttttcgaaacggctcagttccgtgtccggcttgatcgcgccgccgtgcacgcgctgcacggcgcccctgtcgtccagttcctgaaggtccttgcgcagggtggtctcggtgacgcccatctccttggcgaggtcggtgacgaccacgcggccgctgtcggcgacgcgcttgaggatgagctcctgacgttctgccttcatcatgctgggctccttcggctggtgtatgcggtggccgggcgatgatcgcattcggcgtgtcggcttccgtgtctcatcataacagagagttttcgttatttatcgattatgagtacattttcatttcgattcctttcgtttctgcgttgacaactatcgtaaccttgtgttataactttgtcaacaagcaaagcgaaagacttcagaactaaaacgaaaaatttcgaaatgcttggatggtttgtcgacacgctgatcgcttgacggcgaaacgctggccgataaccccataatgaaaacaaccgaacacagcagttcagacaaggaagtacaccatgaagcgctccgaaatcaacgccaccatcaagcagttcgaggccctgcttgatcagtaccggttccgcatcccgccctacctgtcctttaccccggaggaatgggccgacaaaaaccatgagtgggacgagatccgcgacaacatgctcggctgggacatcaccgactacggcgaaggcgacttcgaacacaaggggctggcgctcatcaccctgcgcaacggcaacgtgaaggacccgaagtacaccaaggtatacgccgagaagatcatgatgagcatgcccggacaggtctccccgatgcatttccactggaacaagatggaggatatcatcgtgcgcggcggcggcaccgctgtcttccacctgtacaacgctgatccgaagaccgaggagcgtctcgacaccccggtgctcgtgtgccgtgacggccgccgctactacgtgcccgccggcgaggacatcgaactcagcgaaggcgagtccctgaccttctacccgtacacctaccacgagtactacatcaaggaggactccgtgccgacccttgtcggcgaggtgtccatgtgcaacgacgacaacatcgacaaccgcttctacgagccggtcggccgcttccccgaaatcgaggaggacgaacccgcctaccgcctgctatgcaacgaatacccggcggccaaagaggactgagccggcgaagcccgtccgcaatcgtcgcaagacgccggtccgcgaggcgagcctgagggcggtccggcggcgatttcgcgagaccgccctccagcgctgcgcatcgcctcccgccggcggaggctacatttccctttttcattccggccttggctcactatgtccaaaaccagtttcaaaaccagtttcaacccaggatccatcatgtccaataccaccacgccatccgtggtcgccatcggcgaactgctgtgggatatgctccccgacggcagaaagccgggcggcgcacccgccaacttcatctaccacgtcgcccagaacggcgtcagaggcaccgccgtcaccgctgtgggcgacgacgaactcgggcgcgacctcgtttccatcctcgccgacaacgacgtcaacgtggccgcgcaggtcaacgactatcccaccggcatcaccgccgtccgactggatgacggtggcatccccgaatacgacgtcgtcaagggcgtcgcctgggaccacatcgaattcaccgacgaggtgcgcggcctcgtacgcggcgccgacgcgatctgctacggcaccatcgccgcccgcgaggcgtggggcacccgcgacaccatctaccggatgatcgacgccgcgagccccgacgccatccgcctgttcgacatcaacatccgctccggattcgtcaacaaggaagtcatcacccgattcctcgagggcgccaccatcctcaaaatcaacgacgaggagctgcccatcgtggccaacctgttcggacttgactcgcccggggacgacatcgcctctcgacagcgcgtgatggaggcgctcgccggcatgttcgatctggacgtgacgattctgaccgccggcgacgcctacagcatcgtaatgggacgtgacgagacctcgatcctgcccacgccgaaggtcgatgtcgtcgatacggtcggcgccggcgattcgttttccggagcgttcctcgcctacctgctgcgaggcttctcgattccgaccgcacaccagcgcgcggtcgaggtctccgcgttcgtgtgcggacggtccggcgcctggccgcaataccctgcggcgctgcgggaacggtgatcccgcagtccctcatcctgcggttccggccttggcgggcgttctcgcacaggccggggcctccgccacccatctcatcttcaacgaagaaggacccatcatgtcacaacgcaatatcgttccccgccttgctgccagcgccgcgctcggcggattgctctacggttacgacaccgccgtcatcaatggcgccaccgcggtcatcaaggaacattttcacaccggcgacgccgtgcttggcctcgccgtcggttcggcgctgatcaccgggtgcatcggcgcgctgctgtccgggcgcatcgccgacaaggtcggccgcgtgccgatgatgaagatcgccgccgtttgcttcctggtatgcggaatcggctgcgcgttcgcgccgaacatcgaaatcctcgtggcgttccgcgtgttcggcggattcgcggcgggcgtcgcctccgtggtcgcgccgatgtatatcaccgaaatatccccgaccaggcaacgtggcgtgctcggctcgctgcagcagctcggcatcgtgctcggcatcttcgtctccctgctggtcaacgcgctgctcgtgcacgtcagcggcggcgccggcacgatgatgggccccatgatgacctggcagtggatgttcctgtgcatgtgcgtgcccgctctgatctacggagtgctcgcgttcaccatccccgagtcgccccgttatctggtggcgcagggacgcatggacgaggcggccggggtgttggcgaagatcgacgacgccgaaatcgacgtgaacggccagctcgcggcgatccgcgcgtccctcagcgccgaccgcaagccctcgttccgcgatctcatcggctcgaacgggcgcctgaagccagtggtcctggctgccatcggtttcatgattctcaaccagttcaccggcatcaacgtcattttctactattcgaactcgctgtggagcgccgtgggcttcagcgaaaaggactccttcaccatcaccgccatcacctcgctgatcaacatcgcggccaccgtcatcggcatgacgatcatcgaccgcgtgggccgcaagcccatgctgctcgccggatccgtcggcatggtcgtggctcagggcgggctcacggtgctcttcggcaccgcaccgatggtcggcggctctcccgtgttgggaccggtctccgggcctctggcgctggtgtgcgccaatctgttcgtcgtcgcgttcggcgtgacctggggcaccacctcgtgggtgatgctctccgagatgttcccgaacacgatgcgcggcgcgggcatggcggtcggcaccgccacacagtggctgtccaacttcgtggtgactgtctctttcccggtgctgctcggcatcaacgtggggctggtctacggcctgttcgccttcttcgccttcgtctcgttcttctttgcgctcaaatgcatgcatgagaccaagggcgtggcgctggaggacatgcgggcatgacggtgccggacggcatcgaagggcgatgggccgccgacgatcggcgtcggaggcccggcgccggaccgataatcgcaaggagaatgaatcaatgagcgtcaatgaaaccaatgaaaccaatgaaaccggtgtgggcggcgcgcgtgccgatatgctggcccatatgggcagcctccagcaggccgcctacacgcgcccgatcgagtaccaggagggccgcgcccacggcctcaaggccatcgaggtgaagaacggcccgctgcgcttcgtgtccatggccgaccgggccctcgacgtctgccagttcgagtaccgcggcgaaaacctcaccttcctgtccaagccgggcctgaacggccgcaaccagttcgacaccaacgggctggaagcgcagcgctctatcatgggcgggctgttcttcacttgcggtttcgagaacatctgcgcgccgtacgtcacgcctgagggcggcaagtacccggccggcagcttcccgatgcacggccgcatccgcaccacgccggccgaacatgtgagctccgacgcccactggaccgccgaaggcgactacgtgctcgaggtctccggcgaaatgcgcgaggccgaactgttcggcgaaaatctggtgatgcgccgcaagatcaccagcgtgtacggccagccgtcgatcacggtcgaggatgaggtgaccaacgaatccttccgcgacgagccgctgatgtggatgtaccactgcaacttcggctggccgttgctcgccgaaggcgccgaagtcgtgatccccagccgcaaggccaccccgcgcgacgagaccaccgccgccgataccacgccgtggaacgaaatccaagcacccgaggcgaaccgccccgaaagcgtgtacctgcacgagctcgccgccgacgaccacggccgcagcttcgccgccgtggtcaaccgcaagctcggacttggagtcgtcatcgacttcgacgccagcctcttcccatacttcatggaatggaagtcgatgggtgcgggcgactacgtggtcggcctcgaaccctcgaactccagcgtccaaggccgcggctggcacgagcagcgcggcgacctgcatacgctggccccgcagggcaccgagcgcaaatcgctgaccttcaccgtcatcgaaggcgccgaggcgatcgacgcgctgatcgcgcgccgcgacaccctgctcggctgacgccagagccggcgccgatgccgtgacgttcgtttcttaggtattttccgaggcttctgctgttttcgtggattagatcgtgggttgtggtagtcggatgtcgagtccatcgcatctgagcatgaccagggcaatgaggttgttcacgtggcggaagccgtaggccatgcggatggtgaccttgatcctgttgtcgaacgccttgagcctcgcgctcgaatagcccagctcgatggtcctgaggatgtccggtcggcgccgccggatcctcttcgccagttcgacgatctcgggcatgcgtgaatgcgaggccaggaacacccagtgtctcaactcgcccctggcctgttcgagcgggtgcttgagcagggtcctcaatagttccttgagttgccatgaacggtagagccggccctcgggtccgtgttcctgatgccgtcgagcgcatcggtcatccaagagacgatgtggaacccgtcgagcacgcgttcggcggccgggcaccaccggccggtgcacgggtcgatccagtgggtcccgtcgccggtgacgaccctgatggattcgcgctgtccgggcgtcaacgccttgaagaacaggtcgaacacgtccccgccgtacccgccgtgagcccagatgaccctatgccgctcgtggtcgacgaccacggtcaggtacgtgtggcccttgcggtggctggtctcgtccacgccgatcgcgtgcaggccgtcgaacggcgggggcatcgccgttccgagccgttcggcgaccctatgggcgatgtctcccgcgatcctccacgcgatatgcagaaatctggtgaataagcttttgctcaggcgttcttcgtgattcatttctttggtcggaaaacagaatacgcgggaacgccccttacgcttacggaaccaacggctcgacgacgaactgacatccacgaaaacagcaatagcgccaaaacttgccgttccgctcgtcgatcaagccgttataactgttccgcacctgaatcatgcagacgcccggaaccttgccgatccgcaaatccgcatatcgttcgcctgcgcaacaccctgcggcctgaaccgcgttctccagcaggttgccaagaacaaccgtcagatcgaccgacttggcaaagtggtccactggagtctcgattcgtgacgtgaaccggaccccagcgcgttccgcctcatacgcgtaatactgcaacagtgcatccaattccggattactggcaagacggtaccgcgtacttggaggaacggttcgtaccatcttggcgatgtaatcacgcaattcgccaagctcgttcttctcagccagcaccgacagcaccgcaagctcatgacgaaaatcatgccgtagccgccgttcggcatcactatgctcccggtagatacggtaagcgcgttcatgcaattcatattggcgattgacgatactcagctcattccgttgacgttggacgagaatgattttggcaatgataagatacgttccaagtttcgttatgaacaacagcatcagcatcataaaattagccggcttcgcagtgctgatgtattcaggttcaggcgtgccgaatcgcatccacaatgcgatggcgctgaatccagccggaaccaaccacaagtaccgccagatataatccgcatcctcaacatcgaacaaatccagcaacgttcttccgaagaatacgaatagtacgcagatcagtgcaatcccaaccagcaagaccgtgagcaaatatcgccaatcatataccccccccccaggaaacagatgacgatcgacggcgttgcccatgacagtaaccgtgcccgacaggttcatgaacaacatcagaacaaacacaatcttgcgccaagaatcacgaatcaaaccgatcacaggaaatccccataacaccggcaacagtatcgccatcaacgccatgtacgcgttgtcatcgacatggcgatagcgcaatgagccggctaccacctgaatcaccacaagcaatgcgcatacagcaacggtggcgcgtacgcctaagcggaggcgtttgcggaacagcgtcagcgtgaatgccatgccgggcagacaatcgagcaacgcgaatatcccggccccgcatacgcccacattcatttacctgatccccttacctcaatccatgtcgaatctcttccggcgctctcaaacctccatcactttacatgcacccttcgtctcctccgtccggcaaatatccgcaaaaccatcgtgcacaccatctttgaaaaacatgacccgcacgtcaggccgacccgtataataagatgcgctgtcaagccaatgtgtggcaaaccggcaatgttccacgtctcggcgtcgtatgggaagtcatacgaacgataggacaccacaaggaacgtcgggggcattggacgaacgggggctgggcccttcgtatcgttttctgcccgaactccgtccgcagcatcaatccctagaaaacggtaaagcaacaggattcaagggaaatcgcaaggaatgaagaagacagtcctccacaaagcaatcgcacttctcggcgcaatcaccatgcttgccggcgtcgccgcatgtggtcacagcaacaatgccgacgaatcgggaaatggtctaaaaaaagtgacgttcatgctgtcatgggcgccagacaccaaccacatcggcgtctacgtggcgaagaacaaggggtacttcaagcaggtcggccttgatgtggacatcgtggcggtggcacaggccggcgccgaacaggcggcgaacaacggccaggccgatttcgcgctgtcgaatctgaccaacgtgggcatgtacaccaccaagggcgcgaagatcaaacaggttatgcaggtgcagcagaagccgagcgccatctggtgttcgctcgcctcgaacaaggcgatcaaatccccgaaggatttcgatggcaagaccttcgccacgttcggctcgaacgaatccgacgcggtgatccgccgcatgatccagacggacggcggcaaaggcacgttcgacaaagtgaccgtgggcacatccacattccagacgctgtccagcggcaaagccgattttggcggcttctacgccacttgggaaggggtgcaggccgatatgtacggcccgaagctcaactgcttcaccgagccggattatggcgtgccaggcaacgccgacaccatcggcattatcaccagcgacaagaccatatcctccaatccgactctcgtaaggaagttcgtgcaggccaccaagaaggggtatgaatacgcctactcgcatcccgatgatgcggccgcgattctcgtcaaagaagcccccgacgcgaatctcaagctcgctttcgtcaagaagagcatgaagaccatcgtggacggccagtattggggcgatccggcgaagatcaaggatggctcgttcgtgttcggcacgaacgacaccaagggcgcgcaacagtatttcgattttctcgccaaagaggacgcctacaccgattcgcatggcaagacagtacacaccgtgccggtggccaagaacatctcgaccgacgaattcctgaagtgagtctgatgtccgtcaaacgcaagctgattctcgatgtcgataccggcatcgacgacgcgctggctctggcgtatgtctccacgttcgacgacgtcgagttgctgggatccatcggcacctatggcaacgtgacagccgatacggccgtgcggaacacgcgatatgtgctggattggctgggattgcggcatgtgccggttctcgcgggctccacgcatccatcatgggccgattccttcatcgcggacgcgggatgcgcgcaattccatggaacggacggcctgggtggattcgggccggcagcggacccgtctacatccgattcggcgggagcgttcacgctaacatcgcgtaggctgatttccgtaggcggctacaacgtgcacgaccgccatgcgaatccttccaccgattcgctcacgctttcattcaccgcatgcgaccgtacagaaagcacgcctgcctcgccggaaggcgtacgattcatcatcgacatggtccgccggtacggcagggacgtcacagtggcggcgaccggaccgctgagcgacatcgacgcggcgctcaccgcagcgccggatatcgcggacggattacggctggtgatgatgggagggacgctcacccaagagggaaactgctgggatgcgaccgccgaaacgaacatcatccaggatccggaagcggcggatcgtgtgttccattccggcgcggacgtgaccatggtaggactggacgtcacacaccagtgtctgctgggaagcgacgcgaccgcacagtggcgccagcaggctgcgccgaccggcgtacggacgttccttgccgatatcgccgatttctcgatcgcagcgaatcttcatgcggatgcgcgtctcttctcggcaggcatgccattgcatgatccccttgccgcggccgtcgcattggatccaagtttggtggaatgcttcgatctgccgatgaaggtcgagacgcaaacgggcgatttccacggcacacgcggccgcaccgtcggcgatccggccggcctcatcgacccggccgtgccccgcgtacacgtcgcactgaccgtcgatcataaccgtttcgtggccgacttcacccgtagaatcgccggcatccggcgttgatgtgtgttgttttggacgaaatccggtttgatttcgtccaaaacaacacacatcaacgccgcggcacacgtgcctgctccaatcgatatgccaaaacctgggcgttgtccaaatccctgtagaacatgcgcaccatatctacaccgcgcctacttaggcactgctgtcgatcgcgttcatcatcgacgacctgccgaatggtccaccccgcagtcatcaacggatccacgtacttctgaaccccgtcgaactcccccgcgatcagggtgccgtcatctcgttcccagagaaaatccacccgatgcacacggcctggatggctcaggcaggggaactcgacctgaaccctatgcacaggaaaccccaattcgtccaaaacggcacggcactccgactcaccaccgttttcaacccttccatcaccttgggcaagtacggcacgaatgcgttccctgtcccgaagcatgggaatcgcatccacatattccaacatctgctccacggtggttttcccctgccgcaaagcggaatcaatcggcgccatcgcatagcgacgcggcatcatcgcagcgcaatcgacaagcgtacgaaggatagaggtcacgcgcgcaccatccacagccaccgtttccgcatcatccaacacatggaacctcacatacctctgattcctcggacggctgtttctgccaaccgcgacatgaatcggatgcaactgccggtacgagcaatccaaaccatgcatgaccgccgcgctcgcgccgcagaacgcccatcgctcatgccattgggatagcgaacggagaatgtgccgaagccgctcatgcgggtcgagccgatcccaatattccttgcctgcatacagaccacgatgcacccggacaatgctcccctgcttgactcgacgtacgaccaccttgatgtccgtatcccagaaaggacgcatgcaacaccgatcccgctgcgccttcgcaatcaggagattcagagaacaatgagtttccttttcgcccatccgtgcagtttagcggatgttggggaaaaaggaaaatgtgtgcttattcggacgaaaaccggtctgttttcgtccgaataagcacacattgacgggaacaaataccccctacttcttcacgccaccgaaacgacgatcgcggtggatgtagtggtcgatggagcgccacagcacatcacggccgcaatccgggaacagttccggcacgaagtcgagttccgcgtaggcggcttcccacggcaggaagttggacgtgcgctgctcgccggacgtgcggatcaccagatcgcaatcgggaatatccgggttgtacaggtgctcggcgatcatcttctccgtcacacgatcgccggagatcttgccgtcacgcacctcacgtgcgatggccgcgcaggcgtccgcgatttcggcgcggccaccgtagttcaggcagaacaccacgtcgatggtcttgttgttcttggttttctcctgcgccacttccagctcgtcgatgacggatttccacagcttcggacggcggccggaccagcgcacgcgcacgccccactcgttcatctgatcgacacgacggtggatgatgtcacgcgagaagcccataaggaaacgcacttcctgcggcgaacgcttccaattctccgtggagaacgtgtacagagacaggtagcgcacgcccgcttcgatggcgccggcgatggtgtcgaacaccaccggttcggccgcctgatggccgtcggtgcggatgagtccgcgctgctgggcccaacggccgttgccgtccatgatcacgccgacgtggcgcggaaccttgttctttggaaaatcgggaatgatcgacgggtcggaaaacggtgccgccggaatgtcaagggatttgtaatccacgttctcaaaagccatacccgctaatctagcaagcgcatggaacgaatcggccgttccaaatagtattcgccccattcttccactatttggtgggtttcccgttgaatcgacgcggccgccggaacaccgtccagctccccccaatcgccatcgacaagcgccgaaagccggcaaatcgcatcccacgacaccgcttccgattcgggggtgtggtcggcggcgcacatcaggccgccggcgggaatcgaaaaataccaggacagcgtggacgaaatcggctcgccacacaccacgcagacgcgcagacggggtgtccaaccagcgatcgccagcgcacgcagcacgtacgaatcaccgattgcggacgagtcgtgtgcatgtttggcaagcgcgttcaacgcgcccaataccagacgatattgcgcggccgcaggctccttttccgtggcgaccagcttgtcggcggtttcgcagatcacgttcgccgccgtatacgcttgaaaatcggcgcaaatcggccctgcatacgcggcgatcgattcggcttgggacacgacgtcgagcgaacgaccttccgcaatgagcagcgccacgcgcatgaacggttcgagtcggcctccgaaacgcgatttggtacggcgcacgcctttcgcgacggcgcgtactttgccatggtcacgtgtgagcaaggtgagtatgcggtcggcttcgccgagtttggcggtgcgcagcaccacgccttcgtcttgatacagcggcatcgcacctccttttcttgccgttcatcgcatcctgttatgcatacgctcgccgcacgtgcgcgttccgagatacattcgccccgtcagtagatgaacagcccccagaacgcgaacaccagcaatacgcagaacatggcggccacggtcagccagaacatcacgcgtccgaaccgcgtggaagccagcaccggctgccgtccgctgacgatttcgccgatagcacccttacgtggcggccactgcgcgatgcctcgatgggttgcctcttcgatcagccgcatgaacacgcgggaccatgcccacaccacggcgacgcacacgatctggatcaccggccagctccaatacatcacgcccggattctccactggggcactgccccatgccagtttgaccacacccatgatcacatcgccaaggccggcgcagaacagcacgaacgtggccatagtggcgatagtcaacgtgaccagcgagtttttgaacccttgcgcaagccccagccgataccgtcgtccgtgggcacgcgcccagatcttacgcatcagcacggcgagccacagcacgcctgcggcaagcagcagcaccagcatgctggcatgcaacgcgaccaggtagatggtcaggccgcgattggctttgaggtccaatggcactgcgattgactggtacattctggtgccggccacgcgttcgctggtctgtttgagtccgtgcgtggtgccgacggcccagtcgaccacatcgtccacgtacgcgtcggcgaacggggttccggaattggcttcgtcgccgagcctcagcacatggttggcgatggggtacgtgcgtatggtgacgtcccagttgccggcctggtgagccagatcgacgattttctccgtgccttccacctgcgcggtcatgacgtctttcgtgccatatgccaccaatgtcggaatggcatacgctttcggcgtcaacgtgtcgatgtcgaggttggtgagtccgaacagggacgcgtcgatattgaatacgcggcggacgatcgactggtagccgtcatgcgcgccgacgagcgcgaagtcctgtgcggcgaggaagcccagcgaataccgcggctcgtagaccatcggactgagcagcacctgaaaagcgacgtccggatcgcgctgcagcagatacgatgagatccatgtgctttcggaagtggcgtagatgcccactttggaggcgtccaccgtatccattttccgcaggaggttgatgacctggtcgtagatggcggcggaacccgggtagtcgcgattggcgtcgttggtggaccagaccggcttgtcaagcaccgccgtcacgaatcccgccgaagacaggtcggaggccatgtcgccgaaggaattgtcgcaggtgccatagccggcgccgtgcatgaaaaccacaccgggacgtccgttcccagcccctttcggtttgcggatcagcactttgatgttctgtatctcaccggtggaaggccgtttcgctttgatggtgacgtaccgtttcgccacctcgtaatcgccttttttcgccagtttttcgccggatggattggcgaaggtcacggcggtgttggcgtcaagcgtttcgatggtctgctcggtcggctcgtagttccatgtggatgccgtcaaattggccacggacaccagaatgcccagcagcatgatgaaaataggcaggttgaccatgagtcgccgcccgcgcgtccacggttgatgttgcggttgcggacgcgcgggcgatgaagccgattcttgccgtaatgactggctggcggctgatgattgacgttcctgctctgacacgccgctcattctaccggcctttgctgagaagcctgcgattgcatgctaccgacggcacgctggaacatggctttcagcagttgccgttttgcgtcaccggcacgaccaccggaccggtggcggtggcaggcaactggccgtcggcctccatctgcgcggcgatctcctgcgccttggcgagcagggtttccacgatctggtcttccggcacggtctggatgaccttgcccttgatgaaaatctgccccttgccgttgccggaggccacgcccaaatcggcttcgcgagcctcgcccggaccgttgacgatgcagcccatgacggccacgcgaatcggcgcggtcacgtccttcaacccttcggtcaccgcgttggccagctgaatcacgtccacctgggaacggccgcaggacgggcaggagatgatgtcgaacttacgcgggcgcaatcccatgtattccagcagcttgcagcccaccttcacttcctccacgggaggcgcggacagtgaaacgcggatcgtatcgccgatgccttcggccagcagcgcgccgaatgccaggcagcttttgattgtgccctgccaggtcgggccggcttcggtgacgcccaaatgcagcggccaatcgcccttggaagccaacagacggtacgtctgcaccatggtgaccacatcatggtgcttgacggaaatcttgaaatcgtggaagccgacgtcttcgaacatgcgcgcttccttcatcgcggacgccaccagcgcctccggtgtcgggccgccgtatttggcgtacagctccttatcgagcgaaccggcgttcacgccgatgcgcagggaaatgcccgcatccgtggcggccttgcagatcgaagggccgacctcgtcgaatttgcgaatgttgccggggttcacgcgcacggccgcgcagccggcgtcgatggcctggaacacgtacttgctttggaagtggatgtccgcaatcaccggaatcggcgattttttgacgatttccggcaatgcgtcggcatcatcctggcttggcacggccacgcgcacgatgtcgcagccggccgcggtcagttccgcgatctgctgcagggtggccggtacgtcagccgtcagcgtattggtcatggattgcactgaaatcggcgctcccccgccgaccggcaccgggccgaccatgatgcggtgggacttgcggcgcggatgcagcgggctttcgctgatggccgcgtcaccggttttgcggaacggtttttcgatttctggcatacgtgatccttgcatgtgcgaggcgcgctatgcgtcccgcgatggttcttacggcttgtgctctttacttgtttatcagcttgtcggcgcgggcgcgagcctcctgctcgagtcggctcatttcctccacggaagcgaacagcgggttgccgcgcagttcggcgtccatctcgtcaagcacttcgcgcacggtgtcgacgatgccgaggtatggcagacggtgttcgaggaacgcgtggacggcctgctcgttggccgcgttgagcacggccgtatgcttttcggacgattcgaggcagtgccgggccaggttcaccgcggggaacgcctcgttgtcgagcggctcgaacgtccacgtagccgccttcgtccaatcgcatgcggcggcgacgtttccgagacgttccggcgcggacaggccgagggcgatcggcaggcgcatgtccggcggcgaagcctgcgcgatggtggcgccgtcgcggaattccaccatggaatgcacgatggattgcgggtgcacggtcacgtcgatgcggctcggtggcacgtcgaacagtcggcttgcttcgatgacttcaaggcctttgttcatcagcgtggacgagttgatggtcacgaccggccccatgttccatgtggggtggttcaaggcctgttccggcgtgatgtcggtcatttggtcgcgcttccagccgcggaacggaccgccggaagcggtgacgacgagcttggacacttcgccgtgcgtgccggaacgcaacgactgccagatggcggaatgttcggaatcgaccggattgatctgcttgtcgcgtacctgcgcgctaaacagcaggtgtccgccggccaccacggattccttgttggccaatgccagctgggagcctgcctgcagtgccgcgatggacggttcgaggccgatggagccggtgatgccgttaagcaccacgtcggcgccggagcctgccatggcgatcaccgcgtcagggccggctgtgatgttgacgttgcctgcgccggcctgttccaacgcctcacgtagcgcggggacggcttccttgtagaagatcgcgacggttggcacatggaatttcgccgcctgctgcgcaagcagttcgacatgtgctccgcccgcggcgagacccgtcacggtgaagcggtcgagatgacgtgagatgacgtcaaggccttgggtgccgatggacccggtggagcccagaattactacggttgatggttgcatgggttatgcgctgctctccgtatgatctgccgatgttccggcattggttgggactatgtaagttgggactgtgtagtcgaggctgtgtagttgggattgtgtaaacgcgagaacaggctgacgattccgccagcctgtttcttaccgttggttcactcgaaggacgggaacgacagatccggaatatcgagattgtcgtcgttgcccgacgcagggaaaatcgacctgaaggccgggcttggttccggctttttgtcctcctgctgcttgtccgcatcgggttcggcggacggttcagctgccggggcaactgccggttctgcggcaggttcagccggagcggacggttcaggcgtgaaggatggcggcaccgaggctgcgagggagctcaggctcgtcgaaccggtggtgacctgaggcaagtcggacgcggacaggctcggaacctgcggcgtgaacgtgttttccgtctggttcgtctcattgatggtgtgggccagatgcgccaacgcggccaaagacggatcctgctgcggctcgggttcaaccggagccggcgggaatgccggagcggctggagcctgcgaatcggtcgcggtcggagccggagtctttggcgcggcatcttccatcgcatcatcggcaagcggatcgaacgcctgggtctcttcaacggcgctcggcgcggaagaagcggaatcggtctgcggctggaacaccggaggaaccaccggaaccgcaggcggagtgttcgtcggcgtggcaggcacgctcaccggggaggtgaccgcggacgtgaagatctcatgctcggccttgttcagcgcatcgaaggaatcctcttcgctcggcgtgacggttggcacagtaggaggaaccggagcagccggaaccgtggcggaaggagctgcgaacagcggtgcgatcatctgggtttcgccagctgcggaatcactggaagccggggcaacggacggtgcggccgcggccatcgcctcttcggagggttcgccgacgaaatccgcgacgcgcgcatacgattcgagtcgggtcagcaactgcgcgcaggcggccagatagtaatccacctgacgttcgtcgtatcccctcttgcctttgcgctgagtgaagatcacgttgctcaaggtctgggaattcgtgtcggcgatcgccttggcgtccgcttcactgacttcctcgacacccagctcgccggcggctttcgtcaggcacttgtcgatcacgctgtcgacctgcttgcggtcgtagctcggattcttgccctcgcccggcttgaaccgttggccgtgctcgcgttcggcatgcgcgtcgagcttcttgaacaggtcctcggtctgcgccttccatgccacacggccatgctgggagatttcccacgtggtctgcttgtcgaccacggcacgttccagacgggcaagcgcggcatccacttgggcgatcacatagccgcccttgaccagttcgaaggagacgttctgaatatcatgctgggtgagttgcgcgccctcaccttcatacagcatgtgcgcacgttcaaggaaagcatccacctgttccgcatcgtagccccactttcgcttcgcggcatgagcgattcccgatgcgttcttctcggtttcaggttcctgtgccattggcgttcgacctcctgctacacgtattaacgtcactactttacgtgattgattcgacgcagacgccgcaaaagatgaaaattcagtgaatcgacacgtgcggctcatcgctcacacggcggtttcgtaccgatcaagcggcatcatatccgccatgccgacacacgagtgcggctcatcgcgcggatacggtacagtagttcgttgcgggcgattagctcagttggttagagcgccacctttacacggtggatgtcgggggttcgaatccctcatcgcccacttttcgcaacgccgtgaaaaatcaaggaatcgcatatcatcccgcgtaatatcaacgcgcgcacccgtgttttgcccacattccgcccacgttttgtttgtgttttgccggaaagtccacgtaatagcgaaatcccccaagcccaatgggcccgggggattttcgtatacgcgagaaaaatcgcgaaaagtcttggtttacttgcccttgccgaacgcgcgcaggtgaataccgttccaatcggagctgacggtcagcggagtggcggcgttcatgccggcggtcttggccgcggactgcacggtgctggagcttgcggcacccggacgtcccggcttcggggtgagcacccacagcgggccgtcatcgccgagaaccgcataagcatcgacaatggtgtcggccagttcgtcctcgtcatcgccatcacgccaccagatgatcacaccgtcgactgcggagtcataatcctcgtcgaccagctcctcaccggtcagttcctcgatcttggcgcggatcgagtcatccacatcatcgtcccacagccattcctgtaccaggtcgccggcgtggaaaccgaattcttcagcgttatcagatgccgtttgattcacgttcgtcaatataccaacactgctcgaacatatacgttacgaacgccggaatcgcccacttttcgagatgaaacggcgatttccgcctgtatcacgcctatctccttccgccgcacgctcattgcttgacggtgcattgcggcagtgaaccgcctttaccatcgcggatggcgaccagcgcgtcgtacgcctcgtccaacgtgcccaccttcaccacgtggaggccctgtggcacgtgcccaaccacgtcggagcagttggattccggggcaaggaaccacgtggccccgtcacgcttcgcgccgatcatcttcaaccggatgccgccgatcgcgccaaccttgcctttggcgttcatcgtgccggtacccgcgatggtcttcccgccggaaagctgctctccggtcaccttgtcgatcagaccgagcgtgtacatcatgcccgcggacgggccgccgatgtcgtcgacgtgcatggacaccttcataccggacacgtcataaccgtgcgccttgaggaaccgcttcgcggccgtggccgcggcgttctgcgatgaggacatctccttgttgctttccttcgcatagtccttggcgctttgtccgacggggaacacggcctcctgcggaatcaccgtggccttcggattggcccatgccagcaacgcctgcgcgttggtcacaggatatccgggaacgcctgaggcgttgacggtgacgagcagtagtttgccggagtccttatgcgtcttcacgccggacacgtcgatgacctgcttgccttcgacttttccgagcacgtcctgggtcggtcccggctcctgcaccacgtacgcgctgggcgcaataagcaccagcacgcagagcacagccacgatcggtccggcgagatatcgccaagggcgaacatcgaaccaccgtccgacctgacgccaacgtcgtctgatacgtggcagaaggccttgagacgacccgttacgtgtgcttttggcgtgaactcgctgtgtttcctgcatatcggccatgcctcccatactatggaaggcaacgaacttaacaatcgcgtggaacaaaggcaggaaacggtatggatgagaatgcgatccgccagtggcttatcgattgcttcggaccgattcagggcgagatggcatggaaccagctttccaacatgccggaagccgtacgcgaccagctgatgagtcaggatccgagcacgctgcccaagcccgaagaggtcaagtccatgatgcaggcgttcaccgccggcggactcaacaccatgggagatatgcagcaggccgtggaacaggggccgatcaacatcaaactggcgaaatcgctcgcgttgcagcaggcgaatggtgccggatcggacagcagcgtgaacgccgaaaccggcgaaatcgcaagacgtgccatcagcgaggcgaacctgtggcttgataccgcttgcgagttcaacccggcgcaaggcgagacgcagctgctcacccgcgccggctgggtggaggacacaatcgacgcgtgggcgcagttcgcctcccccgtggccgaatcgatgaacgacgctctggcttcgattctgtcgcagcgtttcggcgacggcgaaatccagaccgagatttccggggttttcgcaggccccatcgaaattccgattccggacgagatgaagaatccggcgaagctgatgcgattcgtcggcaacacgtcgttcgccatgcagttggggcgtgccgccggcgacctgtcccatgaggtgcgcggcagcttcgatcagggcatcgcgctgctgaagaatcccgccggcggactgatcgtgcagaacgtgaccgaatacgcgaagtcgctggacatcgacgtgaacgaagtgatgggctatcttgcgctgcaggagcttgcgcatgccaggctgttcgcctccgtgccgtggctgatgccccgcttcgaggcgctgctgggcaaatacgcgcgtggcatcaccatcgacatggatgccatggaggagcagatccgtgaggcggattccatcgatccggattccatggccagcgcggtgaacatcaccaaggtggcgttcccggacactccggagcagaagcaggccatgaaggcgttggagaatctgcttgccttggtggagggctgggtggatgccgtcgtgtggcgtgcgggcatggcgcatattccgcatatcgaacagcttcgtgagatgttgcgccgcgaacgcgccatcggaggccctgcggaacgcacgttcgaaagcctgatgggcatgcaattgcgccccaagcgcatgcgtgaggcggccgcgctgtgggaaagcatcggcgcgcaggaaggccccgaggcgcgcgacgcgaaatggtcgcatccggatctgctgccgcaactgccggacgaacagtccgaggataactccaacgaagagaacggcgccgcatccgccactaccggtacggaacagaccacggcgcaacaggatattccggacagcatcgattgggatgccgaactgtccaagctgctcgacgaggaagagcacaagggcgatgacgccgatggcacgaacgacgccgacggtacagatgacgccggcgatacgaacgcttccggcgacccgcagtcaccggaagaagcgtgatttcctgcgcccgcgatcggacccatcgtcttcgcgggcgcgcgcataggacacgtcgagtgtgtcttcggcacgcgtgaccgccacgtacatcaatcgccgttcctcttccagaaggtcgccttcgggcggtgaaccgtatggaatcagcccttcggagcacccgatcaggaacacgtgtttgaattccaggcccttggaggcatggatggtggagatggtcacgcctttaacgtcgccgcctgcgccaagtgcttccaacatggccaagcgggtctgagcgtcatccgcgagcgcggagttctgccatccgctgtctcgtttgacgcggtagcgcaggtgttgttcgcccagtgcccggcagaggattttctgctgcgcgttgactcgggtgaggatggcgcagtcgcccggagatgctccctcgtccacgagtctgcggatgcgtgcagccacgccccgggcttcttcgagatcgctgttgtagacggtttgcgcgactcggcggccttggtctcgcttggagttgagtttgagatagtcggcgcgttgcggtgaggcttcgagcacgcggttggcgtagttgacgatctgcggggtggaacggtagtcgttgttgagtctgacgtcggcggtgaggggtccgaattcggaggcgaagttgagcaggttgtagctgctggctccggcgaacgagtagatggtctgtgccgggtcgccgaccacgcagatgttgcggttgtcaccgagccatcgggtgagcagccgatgctgcaggggcgagacgtcttggtattcgtcgacggtgagccatgtgatgccggagcggatgctggccgccacgtcttcgtcgctttcgatgaggtggcaggtgatgagcaggatgtcgtcgaagtcgatttcgttgcgattggttttttcggtttcgtaggctttgtagacatccacgaattggcttggttccagtcctgccggcggctggtggtggatggccgcgcagacgcgttcatagtcttccggcgcgatgagcgagattttgcaccagttgatttcggcttgcaggttgcgcacggtgtcgtcgtccacctgctgggtggtgactcggcgtagggaatgttccacgatttcgcgcggattgcgtgagatgaacggcatgggcccttcgcatacgtctggccagatccgacggagttgctgtagtgccgcggagtggaaggtggcggctttgacgtcggatgcgacgtcgagttgggatagtctgttgcgcatttccgcggccgctttgacggagaaggtcacggcgagcgtggcgtgcggatcccatgccttgatggcgcatgcgtaggcgattcttcgggtgacggtccgcgttttgccggcacctgcgccggcgatgatacggacgggtccgcgcacggcggtcgccgccatgcgctgcgcatcgtccagtccgtcgagaatcgcttccgctgttgcatccatatgctccattgtggcagattgcgtgacgagacggacgtcatcggcgcgattaaccgtgaattcgtggcaagtcgcgcccttattagccttcagtgtgtattaaggttggaattgtgaccgaacgaagcagatttatgatggccgccttggcgagcgcggcgatgccgaacgccaccatcgctggcacgcgtgacagcgagcaggtcaacgccaccgacaaggggtatggcattgatcatgccgtggtgcaggacgccgcgggcaagttgtatgacacgttcgcttcgaacacgccgaagggacgcaagcgtctcgctggtcgcgtgcgtgccgcgcagacgttgatgggcaaccgcgagttgggcggattggggttcgacgtcgatcgcgttctggcgttctccaacggcgaacaggagaggtccgtcacaggagacgtttccgtgatgatcgccacgcatcatgatggtcaggcacgtccgctgacgctgctgacgttggacgactgtgccagcgtgggcaccgcgttgggcgcgatacaccgtcttcgtccggattttctgcaggaggccggctatccggtgttctccacggggcagattcgcgcgcagctgaccgcatggatcaagcgtttgcgtcaggctggccatgtgccgcaggaaatcacgacgagctggtccgacgttcttgaaacggacggcctgtggtcgttcgccacctgtccggtgcatggtggcctgtccgacggcgatgtgctgttctcgggctcgtcgatcaccgccatcacgaactggcaggatatgcaggtcaatgatccggcacgtgatttggcgtggattttctccaagcttgacgagaaccaccgtaatgcgttgctcagcgcgtatggacgcatgctgggcaatcgtttggacgatctgatcatgctgcgcgccaacctgtggctgcagatggaacaggtgggcgatttcatcagcgcgttgaatcaggccgatagcgtcaagatcatgcagttcaaggcgcaggtggagcgtttggctcaccagttgggtatgctcaccgcgaagaaccacaggccgagcgagacgcgtcaggacgagcagaaggccggcaaccgtccgccgagcaccatcaccgtgggcacgttgctggacgaatcggaacgtcgcaggcaggcggcggcgcagcagaataacgatgccgacgcgaccggcgaacgtcatatcgacgcgaccgatatggatgatgacaggaccggcgatttcgatgtcaccggctcccagcccgtccgtaagacgaagcagatcgtcgatgacgtcacggaagcgttcgatgtgaccgccgccgaacatatcgcctccgccggcatggtttccggcagtgccgattcggacgatacgagcgaacgtgaggaatcccccgtcagcacgttcgttccggagcagtccgcgagggagcgtcacgagtcgttgccgtccagttcgaccattgtgatcagcacgttgcagaccgccgatggcagcgacgacacgaacgaggaggaaattcctcaagcccatagcgaagcggcgaccatgctcattccgctgctcgaacgcgatgaggccactatgcagaaggccaaagcggaggtcgaccggctgcaggccgaggacgccaccgatgagaaaccgcgcgtagaataagcgcatacattgcaaacgaatttgcacacgaacacccttacaaggagcatcatggatatcgaactgggcattcagaacgtggcgcgcaccgtcaccttcagcaccgagcagagcgccgacgaggtgaacaacgtcatcgccgaggccgtggagaatggcaagaccatcaacctgaccgacgacaagggccgtcgcatcgtggtgccggccggttctctcggctatgccatcatcggttccgaaaccaagcacgccgtcggcttcggcaatctctgatcgtcacctgcaaacgcgttggacacgttccaaatgaaaaagacgtcggaccatatcaggttcggcgcctttttcatattcgattcatgtatccggttcacgcttggaaattccatatccggatttcatgcggcatgtgagctgccgacgcgaccgatcaaatccacaccccgatgcaggatttcgcgtacggtgtcgtcgtcggtaaggttctcgcccagaccgttcggcttgcctttgccatgccagtccgagccgccggtcaccagcagatcgtgccgtgcggcaatcgtcagcaatcgttcgcgctgttccggaggattgccgcgatgccatatttccaagccgtccaagccgtcggcgatcatcgcgtcaagctgctcgtcgaacagcagccggcggttgcgttgcggatcgcccgcatgcgcggcgaccaccacaccgcccgcccccttgacggcggcgatgacctcgtgcgtcgacggcgacggcgtgggaatgtaatacttggatttggcgctcaccgcgtcggcgaacgcgtcggaacgcgtctcgtatacgcccgccgcgaccagcgcgtcggcgatgtgcggacggccgattgtggtgcgctccccttccttcacttgggcgagcacatcgtcccacgtaatcggaaaatcctgcgacagccgctcaaccatgcgtttcgtacgccgcaatcgcgccgcacgcgtgttggcgaacatgctggaaatatgctcgttggacggatcgtattggaaggcgagcatgtgcacggacacatcttcgtcgacggcggtgatttccgtgcccagcagcaacggcaaaccgatttcctccgaggcttccgtcgcctcgccccagccggcggtggtgtcatggtcggcaatcgccacaccatgcaagccaagcttccttgcctgctccaccagcgtgcgcggcgtctccgtaccgtcggaaaagacggtatggcaatgaatatcccaaccttgtgcgggtggttccgcgtaactcacgtgactcatatgactatcgtaagctcgaatccgcggtttttcgcgtagactgagacatgacaacgtttgtattttgattttccaaggattgacgatgagcgattttgaaggccaggccgctgtggacgcagccgatgacgaaacgagcgtcggcacagccgtcgccatggacgacgactacacgaagccgcgcgggtggcgtcacggcgcaacgtggacgtatctgatcatgctgctcgcttcggcggtggcattgctcgtatcgttcattctgtcggcggacacgctgaaaatggcacgcaatcccgggcagaagctcaactgcgatgtgaacgccgtgctgtcctgttccacggtggccgaatcctggcaggcggagatcgtgaagttcgccggattgagctttccgaacgcgttcttcggcattgccgccgaatcggtgttcgtgacgatcgcggtgatcggactggccaaggtggccgtgccgcgttggttcgcgctgtgcacatggcttggaggccttgccgcgttggcgtattcgtattggctgaccacgcagtcgctgttcgtcatcaacgcgatgtgcccgtggtgcctggtgctgatgttctccaccaccgtgcagttcatggcgttgtcgcatgccacggtggccgtgcaggacatgccgtccggccatgctggattgcgcaagtattaccggctgaatttcgatctgatggtcgatgtggtgtggattgtggcgctgatcgtggtcattctcgtcaaggacggcccgatgctgttcgcctgatacggtttgcatcgagccttttacgatgaaggccgaccctgcggggccggccttttgcctatccgcttttcgtttgctgccgcagcggttacagcagttcgattttgcctacgatggtggcgctgccggtaagcttcacgtcttcgtcggtcacgtcgacgcgcaaggtgccgccacgtacggtgatggtccaatggtcgatgccggttttggcacgcaacgtgatggcggtggcgcataggcccgtgccgcacgacagggtttcgccgcaaccgcgttcgttgacgcgcatggtggcctcgcccgcatcgtcgccttcgctttgctcgtcgatgcgcacgaactccacgttctggtccgacggaatctcgggcgcgacgaccggcttggtgaccagatcaaggtcttcgacgttcggcaggctggcgaacgcgtcttcaagtacggccacgacgtgcggattgcccatgtccacgaacgtgccacgtgcggaaccggacgtgcccggaatggtcacttcgtaaccgtcgacgtcgccacgcttccatgcgcccatctccacttggaacacgtccttgccaaggcccggcacatcgccgagcgaagtcaggatcttcacgccggcgcgggtgccgagatggaatggcttgccgcccggctggtcggcgatgccctgccgctgcgcgaacaaggtgatcgcacgtgtgccgttgccgcacatctcggccagcgagccgtccgcgttgcggtagtccatgaaccagtccgcatcgcccgccgcgcaatcggcgatctgcctttcgttcacatcggacaccgcctgcggatgcgccagacggatcagaccgtcgccgccgatgccgaaatggcggtcgcacaggaatcgcacttcatcggcggtcggctcgtgcgtaccgtcttcgtcgagatacaccacgaaatcgttgccggtggcgtgcgctttgtaaacaatgcttggaatgctcataccagttcactctacacgcggtaggctattgaaagcgtttggcgtatgcgcctgcgggcgtatgcgcgatggcaaaggaggacgtatggcttcaacggcacctatcggcgttttcgattccggtttggggggtatttccgtggcgcgtgagatccgccgcgacatgccgaacgagcatgtgctgtatttcggcgactccgcgaacgctccgtacggcacgaaatcgcccgaacaggtgcgcgaactgtccgacgtcattgtgaaacgattcgtggaacaaggcgtgaaagcggtcgtaatcgcctgcaataccgccacttccgccgcagccaacgaactgcgcgacacatacgacattccgatcatcggcatggagccggcattgaaggtggcttgcgaccgtggtcacggcaagcgtcagcgcgtcatcgtggccgccactcccctgacgttgcgtgaacgcaagttcgccgtgctgatggaccggttcaaggccgatcatacgatttttccggagccctgccccggtctggtggagatcgtggagcatgggcagcttgacgaccatgatgtggtgatgcgcacgctgcaccagtatttcgaccaatacaatctgtccacgatcgactccgttgtgctcggctgcacgcatttcgtgttctaccgcgattatttccgcgaactactgcccgatacggcggcgatcatcgacggcaacgaaggcactgtacgtcaccttggcgtggtgctcgaatcgttgggcaagctcgctccggaagacgcggaaggcggcatcgatctggccaattccgacacttccgcacgaatcgcgcagttggcgcagtcgctgcttgatcgctgagcgcgaatgtcccgacagaccgcgtaaagtcgaatgaaacccggcaaaagggacggacttgcgaaaggacgggcgcatatggccaacaggacagcgatgatcgacgtcggcggcggtttccgcgcgatttacggcgcgggcgtgatggaccgcatgctggaggacggcatacatgtcgaccattgctatggtgtttccgccggcagcgccaatatggtttcctacatttccggacagcacgggcgaaaccacacgttctacacgcagtacgcgttccgtaaggaatacgcgagcttcgacagctatgtgaagaaccacaattacgcgaacctcgattatgtgtacagcacgctgagcaaccacgatggcgagaatccggtggattacgaggcgtttgcggcgaatccgaccgaattcaccgtggtggcctgcaatgcggacgatggttccacgaagtatttcgacaagtcggacgtcggctacgacaattacgacatcatgaaggcgtcatcggcggtgccggtggcgtgcgaaccgtatgtgatcgacggcgtcccgtattacgacgggggcatcgctgatccgattccggtgcagaaggccatcgacgacggctatgaccgcatcgtggtgattctcacccgtccgaaagacaccgtacgcgaacagaagaaggatatcggcccggccacgatcctgaagcgcacgcacccggaggccgcggaaaagctgatgaaccgctatcagacgtacaacgacgaggtggcgttggccaaggaatacgagaaggatggccgtgtgctcatcctcgcgccggaaagcatgtacggcttgaacacgctgagcaaatcgttcgaaggtctggaacgcatgtaccgcgccggatatgcggcggcggccgcgattccagcgttcctggaaagctgaaatccgttcttccgcagcgctgtcatgcgtttccaacggttctaacggcaaccgtatgacagcaatcgcataatgcaatcatatggcagccgtcgtatgtgcgttacggcatcgcaacacgcgtaaccgggcggcggctatgctggaacgcatggaaaagcagaatcgtattttttccggctttgatgccgatgccatcgatcgcaccaccgccgcagatctggccgaagtcggttccgacaagtggacccgctaccccggctgtatcggcgcgttcatcgcggaaatggactacggcctggcgccgtgcatccagcaggccatcgacagcgcctgcgaccattgcaaactcggttacattcccgaaccgtggaagcgccgcgtggccgaggcgtgcgccggctggcagaaaagccactacggctgggacgtggatccggacatcatccgcgtggtgccggacgtgttggaagcgtacgagatcttcctgcgcgagctggtcggcgccggcaatgccgtggtcgtgccgacgcccgcgtacatgccgttcctgagcgtgccgaagctgtacgacgtcgacgtgatcgaaatcgaaatgcttcagggaaccgacgaaacgaccggcgagcgcgaatggctgttcgatttcgacgccatcgaacgcgcgttcgcggctggctgccatgcgttcgtgctgtgcaatccgcacaatccgatcggcaaggtgcttacgttggccgaggagcagcggctgtgcgagctggcggaacggtacgacgtgcgtattttcaatgatgagattcacgcgccgttcgtgttcgaggggcgtcatattccgtatccgaccatcagcgaggcggccgcgcggcagtctatgaccgccaccagcgcgtcgaagtcgttcaacattccgggtacgaagtgcgcgcaggtgctgctgacgaatccggcggaccgtgagatgtgggcggaacgtgcggagtggagcgagcatcagaccgccacgatcggtgcgatcgccaccaccaccgcctacaacgagggcgatccgtggttccaggacgcgctttcctacgtgcgacgcaatcttgggttgttcgatgagcagatgagcacgcggttctcgggcgttggctatattcgcccacgcggcacgtatatcgcatggctggatttcggcccgctcggcattgacgatccggccgcgtatttccttgagaaggcgaaggtggcgctgaccgacggccgttcgtgcggccgtgcgggagccggctgcgcgcgtgtgaacatggcgatgccgtatccgctgctggaggattgcctcaaccgcatgcatgacgcgttgcaggcggacggtttgctttaaagttttccgtctttcgtgtgtgaccgacgctatggtcggccacacacaccatattgcgggaaaagccgccgaatcattgcgattgcaacggttgcgctatgggcgaatagcagcatgttacgatggccgcacaccaccgtcggtggacgcgcgacgcgaatccagcgtatgcgtttcattgagaagaaggctttacgaatatgcgattcccctacagcggcaacggcacatggacgcccgactaccactgcggtttcattgatgccgtcaaacgttttttcatcggctacatggagtttcgggggcgttccagcagacgcgagttctggctcgccatgctgttcttcattccggtcagcgtgctgatattccttattccggctgccggaacggtgtccggaatactgtggatgctggccaccatggtaccgatcatggccatctccttcagaaggctgcatgatgccaaccgcaccggctggtggtttctgcttgggcacgtcggcaccattctggcccttgcgatgctggtcgtcattgcgttcggcctggtcatcatcgaaatcggcatgatcatggtcatcccccacgagccaccgaaactcgactttcatgacccgaacagcttcccgggaatgctgctcacgctgttctatgtcagcctcggcatggccggcatctcgctgatcatccaagcattcctgtactcgctgcccagcaagcccgagggcgtccgcttcgactgatgttctcagcggcatcccgcccctcttccctccctgcattaccctcttagcccttttgtatggaaacgttccatctcacattgagacagagcagtgagctcggttaacaaaactcctataatcacgtctattgtctttccgccgtcataagcgacggaatgtcaacatcagaggagaaaacaatgaagagaaacatgctccaccgcctggtcgccatggccgcggcgggaaccatgctgatgtcggtcgccgcgtgcggctcgtcatccgatgacaacgccgccaccagcaattccagcgacacctcgctgatttccgtgaacaacagcgagccgcagaacggtctgattccgagcgacaccaacgaaatgggcggcggcaaggtcatccgctacctgttcgaaggtctggtgagcttcgacgcgaagggcaagcaacatctcgaagtcgccgagagtatcaccccgaacgaggatgccaccaagtacacgatcaaactgaagaagggttggaagttcaccaacggcgaggcagtaaccgcccattccttcgccgacacctggagtttcgccgccaatgtgaagaacgcgcagaagacctcgagccgcttctccaccatcaagggctatgacgagctgcaggatccgaacgtcgatccgaaggccacactttccggtctttccaccccggacgactacacgctggtcgtcgagctgaacaagcctgattccgtgttcccgaccaagctcgcgcaccaatccatgttcccgctgccgagcgtggcatttaaggacatcaagaagttcggtcaggctccgattggcaatggtccgtacaagttcaagtcctggtcgcatgacaagaacatcatcatcgtgccgaacaaggattataagggcagccgcaaggtatccaacaacggcatcgaataccgcgtctatacgaatgaggattccgcttactccgacgtgctgtccggcaacctcgacgtgatggatcagattccacagtccgcggtgaagaccttccgtcaggattccagcgtgatcgcctacagccaggcaggatcctcattccagtccttcgtcattccggaacgtcttgagcatttcggcaacgacgaggaaggccaattgcgtcgtcaggccatttccatggccatcaaccgcgaccagatcgtcaagaaggtttacaacaacacgaagaccccggccaccgatttcacttcaccgctcgtccccgaatatgtgaagaagctggagaagaacggcgacaacctgaagtacaacgcttccaaggccaaggaactgtggaagaaagccaatgccatcaagccatggtccggcaacttccgaatcgcctataatgccgatggcggccataaggaatgggtcgatgccgtgtgcaaccagatcaagaacacactcgacatcgacgccgctggcgagccgtacgccacgttcagcgacgtgcgtaaccaggtgaccaaccgcaccatcaaaaccgcgttccgtgccggctggatgctggattacccgtccgctgaagattatctcaatccgctatatgcctccagctccgctgacggtcatggttcgaacgatggtgattacaagagcgcggaattcgacaagctcctgaacgccgcgctcgcccagaccgacgtgaagaagcgaaccgaggacttcaccaaggcgcaggaagtgctggccaaggatcttccggtgattccgctgtggaacgacaacgtcgccgccgcgtccgcgacgaacgtgaagaacgtgtcgttcgactacaccaacctgcctacctacaacaccatcaccaagtgacggcttcgttgtgacgtttcgctgccaatcggcaacgaaaaacgagtgggggttcgaatccttaatggattcgaacccccactcggcgttttgcagccgtttcgtttatttgcttacggcgtcaaacctatggcgtcagctctgcacgtagctgcccttcggggacttccaaccgcagttcatcatctcgctgttgaacaccatcgcaccgtcgccatgggcggggacgacgatcatgccaccgtcgccgtggtgacgggccacaccgtccagcgcggccttcgcagcctcgaccggatcttccttggcgtacagcacgcggtcggaaacctggtgtgcggcgacttccttgacgaacgcctcaccgatgccggtgcaggagatcgcaacggaatcgttgttggcgtaagtgccgcaacccggcagtggcgaatcgccaacacggcccggcatctggttggtgatgccgccagtggaggtgccggctgcgatattgccggacgcgtcacgtgcgacggcgccgatggtgccatgcttctcccattcgtcgccattggactgcgcctcacgcagggattcctgacgggccggggtgatgaagtactcgctgtcgcacagttcgatgccccactccttgagcaggttatcgcccggcttggcgaacatgacgtgcttggtcttctccttgatggcgcgcgccacattgatcgggttcttggacgtggtcagaccgcatgcggagccgacttcgccgtcaacgccggtcatcaggcaggaatccatggacacgatgccttcgctcgtcaacgcggcaccacggccagcattgaattcgggagcatcctccatgacacgaatggccgcgcagacggcatcttcggccggagcgccctgttccagcagcgcatagccggcttcaagggccctgttcagatcctgctccacctgggcgcgacgttccggcgtgtccttcttgccgcgattgccagcgcctgcgtggatcaccagaaggattccatccggatcagcctgggcaacccggaccgtcgactgcggcaatgctgcttcgtttgttgacatcttctctccttcagatatctcgcttatgtttgacattcgcagatatcttacgccggttgcggcaacgaagcgcccgacatgcgcaaaagcgatgccgtcgcgccgttacgcaatcaaaaacatatcgaagcgcgactgcgtcctttcttacgtttcatacttttgcaaatcgcaatctcgtatttcatggtgctcctccgttggtagtgccagtatgtgtcaagcgcatcgttccccggacaaaatcacgttcttaagcaaagccacgcttgtaaatcggaaacacaagtcgttgtggcccctacggattcatgtatatcgaaatggccgaaattattatccatcgcaaaaactctcgtaagcaacacttatcgagataaatgtagcttattttaacgttagctacacttatgcggataagtgtagctaacgcacatgcgatgcgactgatagattgacaaatacaatcatccccgcatgtgcggggaacacttgaaacgctggcgcagcttgttttcgagcgcgggatcatccccgcatgcgcgagggacacctgccgagtggctggtagtcctgcatgtcgtggggaccatctccgcatgtgcggggaacacggtgccgtggtggtagaattggattgctcgaagatcccacgcgaccagctttcaagactggaacatcagtcggggggttatcttcgggctttctatttcagttggatctgatgcagtcccgatatgtcgagcacccataactcgcggatatgtgtttcgtgccgttggagatcatccccacatgtacggggaacacacaatctgggcgcctgacgtccaaatttaagtgggatcatccccgcacgtgcggggaacacagcaccgttaccatatcgccgttgttatccgtgggatcatccccgcatgtgcggggagcacttcattatcagtgcgcgtggtctcggtaagacgggatcatccccgcatgtgcggggagcactgagccagttacaatgtccctgtagatggttggggatcatccccgcatgtgcggggagcaccagaacgcttcgaggctttcgcacgggccgttgggatcatccccgcatgtgcggggagcactacgtccatcggccacaattggactgggatgtgggatcatccccgcatgtgcggggagcacgttgttttgccaccgtttttttggacggtttcgggatcatccccgcatgtgcggggagcacttgcccgagtcggccatctgcggccacagccggggatcatccccgcatgtgcggggagcacagaatctgctgccaatcatgcaagatctcgacgggatcatccccgcatgtgcggggagcacttgtgcaagactttctgcaaggcttgagcacggggatcatccccgcatgtgcggggagcacagtttcgtggcgaattcgtagaccaccttgtcgggatcatccccgcatgtgcggggagcacaaccggggtagcagcttcggccaaagtcacaagggatcatccccgcatgtgcggggagcacggcaggcttgcgacgatgccttgcaggagtccgggatcatccccgcatgtgcggggagcacaacggttggaaagacaaagctgctctttatctgggatcatccccgcatgtgcggggagcacgagctgggagactttgcggcgttcctcgatcagggatcatccccgcatgtgcggggagcactccgtcaaacacaacgccaagggcaacgaccagggatcatccccgcatgtgcggggagcacgccgacggcaacaagaccatccagggaagcgcaaccttgccaaggttgagaccgcgggtccgagtcccgttgtccgctccagtatgaagcctcaccgattcggtggggcttttcgtttatacgtttgtcggtatccgacaacatgcctcgggtgggaagcaatcggcgcttcccacccgtctgtctttcggttctattcgcgcatgccatcccacgcgtagtcgagatgcatgaattcgggcaccttgtaccatttgaccggatagccggcgccatgcgcgcagaacaccgaatccggcgtgttctccaggtcggattccggatcgtaagccatgttctcgatcacctcgtcggcattgtggcacggctggtagccggcgaacacgcagcttaaatggccacggccgtgcgtgtacgcgttcacgtccatcgcatagtcacgcatttcggataccggcgccgtgccgttcaacaccatatattcgccgtcgtcggtaggcgggtcgaacgtgccggacatacgctggatgtcggccatcgcatgtccgaccatgtcctgcggcacttccagacggaagccgtaccaaggttcaagcagacggcaatcgcccttcttcttcgcttccatcaggccctggcgtatcgcacggtaggtggcttggcggaaatcgccgccttccgtgtgcttcagatgcgcacgacccgtcagcagcgtgattctcatatcggtgatcggcgagccggtgagcacgcccagatgctcgcgttcctggaaatgctgcatgataagacgctgccagttgcggtcgagcacgtcctcgctgcacacggtcgcatattccataccggagccctgcggcaacggctccaacagcacgtgcgtctccgcatagtggcgtaacggttcgaaatggccgacaccttcaattggcgaggtaatcgtctccttgtacagaatgccgccgggaccgaacgtgacatccaagccgaaacggtcatgcatgatctgctggatgatttccagctgcaccgcgcccatcagctgcagatgcacctcttcgagacgcggctgccacacgacgtgcagcagcggatcctcgtcctccagttcgcgcagggcgacgagacatttgtgaatgtcgcactcccccggttccagcgtgtacgtgagcaccggctggaggaccggactgccggcgtcccgctccatgccgaggccttcgccggggaatgtctgcgtcagacccgtgacggcgcagatggtgcctgcggggaccgtgtcgacggtggtggatttcgcgccggaatagacgcgcacctggtcggctttctcatgccattggccgtcttcggcaaccgcatccgcgtcgccggcgtgcgcggcgccgcttagcatcatcttggccttcagttcgccgccggtcaccttgagccaggtcagacggttgccttgcgcgtcatgagacaccttatatatgcgtgcgccgaattcgccattgtattgcggctcttgcgcgaaccgttcgaaacctgcgacgaactgttctataccgtccattttcagcgctgatccgaaatagcaggggaacagctcacggcgggcgatcatggcgcgaatggtttcgtccggcacggtttcggtgtcgagatacgcgtccatggccgtttcattttgcatggcgatctcctccatgcgttcgccggcaatcggttcggtgaagtcgacgcagccgtccgagaagcgtttcttgagttgggcgagcagttgcgttttgtcgacgccaggcgcgtccattttgttgacgaagacgaatgtgggcacctgatagcgattgagcagccgccacagcgtttcggtgtgcccttggatgccgtccgcgccggagatgacgaggatggcgtagtcgagcacggcgagcgtacgttccgtttcggcggagaagtcgacgtggccaggagtgtcgagcagggtgatggtgaggtcgggcgtggtgataacggccggttcagtgaagatggtgatgccacgctggcgttccatggcattcgtatcaaggaaggcgtcgccgtggtcgacacgtccgagtttgcgcacctggccagtggcataaagcagggcttcagacagcgtggtcttgcctgcgtccacatgtgccagaatgcccgcgacgattcgcttcatggtctcccctatcttcgcaagccaatggcttgccgttcaatggacaggaaagcccccgcaccgcatgaaacgacgcgagggcttgatggtgaccccggccgggctcgaaccggcgaccttgagattagaagtcacatgctctatccagctgagctacagggccaaactaaacacagtatagtcagttcgcacacggttgccaactcgacacggcaatcacatcgccttgagcacaatgccgacgatggctacgagcacgccgacgtattggatgccggccacgggcttgcgtggcacgccaagcaggccgaaacggtcgaccagcaatcctccgccgacctgaccgagcaataccagcatcaccgtcatgccggtgccgatatgcgcggacaggtacgcgttgcacatcaccagcgtcgcacccagcaatccgcctgcccacatccaccacggattgcctttcttcagcgcgtcgccgaggctgtaggtgcggtcgacgaatgcgacgacgatcgcaagcgagatcagaccgaccacgaacgaggcgagcgatgccttcaccggcgatcccaacgcgacgcccagcttgcccaacaacgccgtctgcacggccgaacacatgccgaacgcgatgcctgcgcaactccacagcacggtcgcggaacctggcacatgtacggcttttccgtcagtttcggatttttcggaatcgccggaattttccgaaccgccagccgggcgatcgatggcaggcctcaatcgcagattcggtccggcgacggcaagcaggaagccgaccagcgtgatcgccgcacctgcgatgcgcagcggggaaatcggctgcgcggtagtgccgaaccagccgaaagcgtcgatcagcaggcccatgacgatctgcccggtgactggcatgatcacggttttgagactgcccagtttcggcagcagcagcacattgccggtcaggaaagtgacaccgaacacgcccgcgaaccacatccaccatgggccgttcgccgcggtggcgggaatcagcggatacgggccaagcagcagcgtcaaagtcagcatcgcaatgaggccgacgctgaacgacaccagcgaggcgcgcaacggcgagccgatggaacggccgagccgcgtgttcaccgcggtctgcaccggcgtgatcagtccggagaaaattcccagcaatccttgcagcatgttcagccttcctacgtttctcggcacacgcttcccggcacagattatcacagcaccagaccatcagccgacgtaacaataaacccttgaaatccaatgattccaagggttttcatgcaatcccagcaaaaggtgcgaaccggcgaccttgagattagcggtcagggaaaccggccgacggccaaacgctactcgataatccagctcaggccgacgagcacgatgacgaacagcacgttcaccgcggtgtagacggccagataacggccttttttgtccgggtaggcgcgcgtcacgttcttgtagccgatcagcgacgccatggacgcgatcagcgtgcccaagccgcccaggttggtgccgatgatcagttcacgccactggtcgcagaagccggacagcagcagcgtggtcggcacgttggagatgaactggctggacaccacggccacttccagcggatgcgcgcccaccagcgaggcggccagctcgtagaattccggcacgcgtttcatgttgccgatgaagatgaagaacatgcagaacgtgagcggcagtccccaatcgacgttgcggaacacgcggcggtcgcatagcaggaacgccacgaacacgatgacgcacatcaaccacagcggaatgaaatcgctcaccgccagcaagcagacgacgaacaacgccgtgtatacgatcgtacgccagccgccataaccggcaccgtagccggtcacgcgaatctcgtcaggctgcggccggtcggaatgcggggcgagtacgttctgttcgatgccggaaccatcgatcgcggaaaattcggaaaccggtttgctgccgaaaatcacgcaggtgatgattatcagcagaacggctgcggtagcggaatacggggccatgatgccgatcatctcggacgtcggcatgcccgtcaacgctttcagatacaggttgtgcgcgttgccgatcggggtgagcatgctgcccacgttcgcgccgatggtcatcagcgtgccgacaagcaccgcatgctcttccatgtgcgccatcgtcaacaccgcgattgcgaacggcacgaaggtgaccaacgccacatcattggtgatgagcatgccggagaagaacggcaatgcgatcaacgtgagcaccaggccacgcgcggttttgacgtgatgcagcaggcgcgagccgatgatgcggaacacgccgatgcgctggaagccgcacaccacaagcatcagacagatcagctgcgagatggtgctggcgtggatgtagccggcgtattccttgtctggcggcacgatgaagcacgatatgagtgcgagtatggaagcgactacgagaatggtctcgttcttcaggaccttgacgaccaatcgccgcatgcattcctccgtcaatctcgtttgcaaccgccttgcacaccttgcaaaacccaagcgattttcatgcaaacgcctagaccactttacccaaaaatgcgactagcacgaaccctcggcgtgctgcttttccgaccattccaacgattttcatccactattgcttactgccgcatgcttttgcaaaccggcgaaaccgaaaacaaggcccgcaaatcttcacaaattaaccccgcgtgcgccaagattttgtctaaaaaccatcttccgttcgccttcgattcaccatatgggcgtgtcacgcaacgttgttgccgaaaacacgcgactgcaggtccttgcgcagcgtttccagtttggtgatctgtccgagcagttcgattttctctgcaccgtccggcagttgcgccatgcggcgctgggccgcgccgattttgcgcatgatgccggtatcaagcagtctgacgatcagttcggacgcgtaccgccgctcctcctgcgttggcttgcgcaattgcgccgattgttcctgcgactcgcctgtattgcggttcgcgtccgcttcgctcggcggcaatggcagcggcatgacggccagctcgttgatgaccgattcgagcatcggaccgcccgccttcgtcagattgtgcatccacagtccctgcggcacgtcttcccctggaagcccgcccgccgcggcgaccgcttggaacagcgtgcggaacaccggcgtcatgaaactcgacaaggtcaggctggcgaacatcgtcggatcgacggccaacggcacctggatcagcgtggccatgaactgctgttcgcagatgaacacggcgtcgtcgatgcgatagtagctttggtcggccgcgtcgcgatgctccaacgccttgcgtgcggcgggattcgcatacggattcgcgccacgttccgcatatgctggttcagccgacggccccgcattgttttggaatcgacgtttcggcgcgtacgcgtcctcgtcacgcatgttcagtttgcgacgctggtacgccacttcgcgttgcatgatgtccagatcgacgccgatgcgacgtaccgccttgcgtgagtacaggtcgagcagcgaacggtctcggatttgcgcgatcagcggggcgaccgccttgaccgcgcccatctgacctgtcgcgtacgtggtgtcgaaacggtcgattgccgaatcgatcacgaaatcgtacagcggccgcgcattggcgatcagcgcgcgcaccgcctcgttgccgcgtttgatgcgcagatcgcacgggtcgaggttgtcttcggcgaccgcgacgaacgcctgcgtcgaaaacgcggcgtccaaaccgaacgcgtggatcgcggccttctgcccagccgcatcgccgtcgaatgtgaacacgacacgcgagctcaacgcctgcccctccaccttcagggggccaaccagctgcaccgcgcccaacgaatcgtccgcgatcaatcggcgaatgatcttcgcatgctcggaacttgtgaccccttccgtgtcagggaagtgcgctacctctgcgccaaccgcccgaagcgagtgctaacttacgtggaatttcagcgaaatgcaaatcgtcggcgtgtcgcaatgtcttgcggaacccacccgactcctgtcagacagcgggctccacctgcggaaactccaaggttttcgcgtcgtggtcggcctcgccgtcatgcgccagcgcaagtcgcatctgatgccaaatcacattgccgtgcgtcgaatcggacagaccctcgtccacgaatcccaatcgtgaataaaaaccgacaagacgctccttgcaggtgagcacaatgcccttacgtccggcctgtgccgcgtcgagaatcacctggcgcagcagatagctggcgcagccgcgatgctggtagacgggtgccacatccacgccgaaaatcatctgccaaacgccatgctcgtcatgcatatcggcgtcgtcatacatggcatcggcaagattcggctcgtttgtggccatgccatcgacgaaaccaaccaacgtgccgtcctctacacgcgaggggaacggggtatcgtcgtcatcggtgttgaccaacagccagaaatggtccggataagcggccacgcgtgcggtaaggctttcgttgcttgcggcctccgcaggtgggaagcaggcggcctccacagcctcgatcgcgtccagatcctccatcgttgcatgtcgaatgagcatgtgcatactctctcgcaaggcatacccaatcttcacatttcgatatgcgccgacggcgcaatccgccagcatgccatactgtagaagaaccttggagggatcgcaggacgactgtttcgcgatacctgataagtccttatacgaaaaaccgataacgaaactggctcgtagtggcgaataaagcgatagtatgagccgcgttcgccggaacaaatacgaaaaatccgttgagaagagaaggaggcgcgcgtgttcgactggacgttcatctcgcactacgcgccgttcttcgtcagcggtgccgaaatgacgctgttcatttccgtcttcggcatcatcctggcgatcgtggtcggcttggtctgcgccggcatcgagatcgcgcgcatccccgtcctgcggcaggtcgtgcgcgtctacatcgaactgagccgtaacacgccgttgctggtgcagctgtacttcctgtattttggcctgccgaaactcggactcgtctggtccgcggaactgtgcgcaatcgtcggactcggcttcctcggcggctcctatatggccgaagcgatgcgcggcggcctggagaccattccggaagtgcagcgcgaatccgcatacgtgctgggcttgagcaaatggcagatattaagccgcgtggtcattccacaggccatcagcacctccattccaggcgtcgtggccaatgtgatcttcctcatcaaggaatcgtccgtggtgtccgccatcgcgctcgccgacgtgatgtacatggccaaggacctgatcggcatgtactacgacacctatgagtcgctgttcctgctgattgtggcgtatctggtgattttgctgccgatttccctgttcggcacttggctggaacggaggttcgactatgagcggcgctgagattctgctcgagccgggcgtgattccgcgtctgctacagggcctgtgggtcacggtgtggatcgccggcgtgtccgtggcgttgtccgtgcccgtcggcctgatcgtcggctggctgatgacgatgaaaaatcccgttgtgcgggtgctgaccaggatttatctggatttcatccgcatcatgccacagctggcgctgctgttcatcgccttctacggtttcgcgcaggcatggaattggaatttggatgcgaccggcgcatgcgtgttcgtcttcgttttgtggggcggcgctgaactgggcgatctggtgcgtggtgcgctcgaatcgattccgaaggcgcagtacgagtcgtcgtacgttttgggattgagcggctggcagacgttcacgaaagtgattctgccgcaggcgttgcgccggctgctgccggcttccgtgaaccttgccacgcgtatcgtgaagaccacgtcattggccgtgctgctcggcgtggtggaagtcatcaaggtgggccagcagatcatcgacgcgaaccgtttccagtatccgacgggcactttgtggatttacggaacgattttcttcatgtacttcatcgtgtgctggccgctgtccatcgtggcccgcaggttggaaaagaggtggaagcatgactgagcaggctgaacaggttacgcagaccgcgcaaaacagcgggaaatcgcagacaagccttgaaatcaggcatctggtcaagcggtacgccaatgccgacaagccagtgctggacgacatctccttcgacgtgccccacggcaaggtgttcgtcatcgtcggcccgtccggatcgggcaagtcgacgttgctgcgcaccatcgcaggtcttgagccgattcagggcggcaccatcgcgctgaacggcgagattatcgaaaccggcaagccgggcaccgaatcggccggccgcagcaagcgcggcagcgagctgcgcacgcgtgtcggcatggtgttccaaagctacgacctgttccccaacaaaactgtgctcggcaacatcacgctcgctccgacgctcgtgcagaagcgcgacaaggcggaggtcgagaaggaagccatcgctctgttggaacgcgtcggactcgccgaccgcaaggatgcctggccgcatgagctgtccggaggccaacgccagcgcgtggccatctgccgtgcgctgatcctgcatccggaagtgctgctgttcgacgaggtcaccgccgcgcttgatccggaaatggtgcgcgaggtgcttgacgtgatgctggaactcgccgattccggccagaccatgctcatcgtgacgcacgagatgcaattcgcacgagccatcgccgaccaggtgatcatgctggaggacggcggcatcgtggaacaatccgacgacgccgaagcgttcttcaccaatccgaaaaccgagcgtgccaagcgtttcctgcacacgttcgaattcgacaggcatcgcaagccggcggaaccgacgggaacttccgccgagtaatcgcaagttttgatagcagtcatccgtacaagagaggagtaaccatgaccgcatcaatcatcaacaagacaatcaagagcatcgtggccgcatcggccgcgttgatcatggccgcctccgtggctgcctgcggtcccaacgccgccaccccgagcgaggagaacaacgcctccaacggcggcgccaccacgtccaaggtgaccgcccgctccctggacgagatcaagaagtccggcgtgctcaaagtggccgtcttctccgacaaggccccgttcggctacatcgacaaggacggcaagaacgccggctacgacatcgtcttcgccgagcgtctcgccaaggatctgggcgtgaaggtcaagtacacgtccgtcgatccggccgcccgtgtggatgtgctcacgtccaacaaggtggacatcacgctggccaacttcaccgtcaccgacgagcgcaaggagaaggtcgacttcgccaagccgtacatgaaggtcgcgctcggcgtggtctccccggagaacgccgaaatcaccgacgtgagccagctcaagggcaagacgctgatcatcgccaagggcaccaccgccgaaagctatttcgagaagaacgaacccgacgtcaagctgcagaagtacgaccagtacgccgacgcctacaacgcgctgctcgacggccgtggcgacgccttctccaccgacaacaccgaggtgctggcctgggccaagatcaacaagggcttcaaggtgggcatcaccaagctcggtgacgaagacaccatcgcgccggccgtgcagaagggcaacaaggagctgctcaactggatcaacgacgagatcgtgaagctcggcaaggagaacttcttccacaaggattacgaggagactttgaagccggtgtacggctccgacgtcaacccggatgacattgtggtcgaaggcggcaagctctgattcttacctgacctgacggcggcctgccgtccgtcaatcctgtttttccaagccttccgtggcacacgccgcggaaggctttttcatgccgattccgggccggttatgtcacatccttcgaaaccgtttacagtccacgcgggtgtatgtttccggaggtttcgtaccatccgataacccctcataaataaacgctatggcgattcgcacgttgtataagcaacgtcgataatctccggcgcgtggcgctttccaagacacggttaagtaggaaccagcgatcgcgtgaacggcacgcggcaaggaaaccacaccgagggggtgcgcaccatgaccagattcaacactcagcttgtccacggactgccggtcaacgacaacaacaccggagccgtgaacccgccgatctacaactcgtccacctatgctttcgaatcggtcgaggccatgccccgctgggattacgcgcgcagcggcaacccgacccgcgagttcctggagaagcagatcgcgcagcttgagcatggcacgcgcggtttcgcgttcggttccggcctggccgccatccacgcggtgctgtcgatcttccaacccggcgaccgtatcatcgtcggcaagaacatctacggcggcacctactcgctgttccacgaatatttcgaacgttggggcgtcatcatcgaggaagtggacaccaccgattacaaggcgctcgacgctgcggtctccggcgaatccgccaagggcaatgcgcatggatgtccggccaaggccgtgtacttcgaagtgctcaccaacccgcttctgcaagtcaacaacgtgacggccattgccggaatcgcccaccgtcatggcgcgatcgccatcgtcgacaacacattcgtcaccccgtatctgcagcagccgctcgaccaaggcgccgacatcgtcatccattccgccaccaaatatctggccggccattccgaagtcaacgccggcctcgtggtggtcaaggacgacgagctgggcaagcgcgtctacttcgcgcagaaccgcttgggcggcgtgctcgcgccgaacgaatgcgattcggtgcgtcgcggcatccagacgctcgccttgcgcatggaccgtcagcaggagaacgcgcgtgcgatttccagctatctgttgctgcacccgttggtcaagtccgtgcattatccgggactgcccagccatgaatacgagctggcctccaacggtctcaagggcggcggtgccgtgctgagcttcgaagtggtgccgggcgtcgaccctgcggacgtgcttgacaacctgcatatcttccgtttggcggtgtctctaggtgcggtggaatcgcttgccgaactgccgtgccgcatgacgcatttcgaactgccgcgcgaggagcgtttgaaggtcggcatcaccgacgagctggtacgtctcgcggtcggcgtcgaggacaagcaggacctcatcgaggatctcggtcaggccttcgacatcgcgtatgagcactatctcaaccgtcatgccggcgagagtctgttcaccttcgcgcaacacgtatatgcctgaaagttttgccatcggtagggatttgaatattaactggcgcgctatctcacgaaccggacaggggaaagcgccccctgtccggctcgtggacgtatgtgggtcagctcctggacaggcgatggttggctcgtggacggcccttgcccagctcgcggacattgtctgcatacgattgcattctttggtaaatttttactcgggttcggcaatggttgcagaacctacgaaaggtcatgcgacaagacctttaaagagaaaccaaagaagggagtaatgccatgccgttccttgtagcgctccttgtcattgcgctgatcatcgcgttcctgttcctgtccacgttgttcatcgtgccgcagcagcaggcctacatcatcgaacgtttcggcaagttcaacaaggtgcagttcgcgggcatccacatccgtatcccgttcgtggaccgtatcgccatgaaaaccaacatgcgcgtcaaccagctcaacgtgcagctggagaccaaaaccctcgacaatgtgttcgtcacggtcgtcgcctccacccagttccgtgtgaatccggagaacgttgccaccgcttactatgagttgcgcgatccggccggccagttgcgctcctacatggaagacgccctgcgttccgccattcctgcgttgagcctcgatgatgctttcgcccgtaaggatgatgtggccttcgacgtgcagaagaccgtcggcaacgagatgtcccgcttcggcttcaccgtggtcaagaccctgatcaccgccattgacccgagcccgcaggtcaagaatgccatggattccatcaacgcagcccagcgtgagaaggaggccacccggcagcgcgccgaggcccagcgcatccagattgagacccaagccgctgctgaagcggagaagacccgtcttcagggtgaaggtcaggccaactaccgtcgcgagatcgccaacggtatcgtcgaccagatcaagagcctgcaggctgtcggcatgaacatcggcgatgtgaacaatgtggtgctgtttaaccagtacctcgacgtgctgcgctccttgagcgaatccaacaactccaagaccgtcgtgcttccagcatccacccctggcggatatcaggatatgtacagccagatcacgcaggcgatggtgacagccaacgaaaccgcggaacggagcgcgtacacgccgaagccgtcccatacggccgccccatcggtgccgcgtatctgacgaatattgatcgaatggcgtctttggccgcatgcgccaatcgcggggtatgcgaccaaagacgaaacgaatccctccttccatcggggagccgcgtgaatgtgacggagaatgcggaaacgatggaaggagggatcgcgtatgggtgcgtcgccgtaccacgacgcacatcttgtcatgggaacgcttctggacgctattccagtccgatgagcgccccgtgggccggcatggacgggcgttccgcctcatgccgcttcacggattggatctgtttctgcagatccatgactttcttttccaaccatgcgatggtcatggattgggagatgacgagcaggtcgcgctgatcggccgcggcttcattggcgaacgactgcgcctccagcatgatctgcggatctgctttccaccgtgcgatggcgcgttcgatgcgcttgctgccaacgatcttcggattgagtcccgcgctggcgaagatgctggtcggcccgttgccccgcaagtattgcgccatgcaacgcacctggaaatccctcgaataggtgatgcggtccatcgatgcccgctccaccgcgggcagggtgttgaggtagtagacctccgcttgtgtgaaacgacgtttcatgatgtccccctcatggtatggaaccgttcagcttcgttttcgattcgttgcgatgccttcattgtattttcgtcgtttcacggttcactgccatttggcacgaaacaagggtttctggcatgaaacaacatgttccatatcgttcaggcggggtttcttgaacggttttcgagtttcaggcacgcgcggaccgtggcttcagggtgttcccttaagggtggcgaagcgcggtgaaacactttagacttaggagcaattatcaacatattcccagaaaacgaggaggtgaatgtgccggtaggtagcacatccaacgctgggaaaaccggtcgcggtcccattatcgaggttaaaaacctacgcaaggaatatccagtgctcgatgagaccgtcgtagcactggaacgtgtcaatctcgccattccgcaagggcagatctgctgtatctatggcgagtccggatccggtaaatccaccctgctcaatcagcttgccggcatggaaaaaccaactaaaggtggtgtacgtatcacaggtgtgcccatcagcaggcttgacgaacggcagctggccgaattcaggcagaagcaccttggcttcgtgttccagtcgtacaatctgctgcccaacctcaatgccatcgagaatgtggccatgccactgatgttccgaggcgtgccgaagcgtaaacgcgagacgatcgcgcgtgccatgctcaagcgggtcggccttggcaaacgcatgaaccattatccgacccagatgtctggcggtcagcagcagcgcgtcggcatcgcccgcgctttcgtgacacgtccgcaagtggtattcgccgacgagccgaccggcaatctcgattccaaaaccaaaaccgaagtgatggatatgatttgctcgttcgcacgcgatttcaaccagaccatcgtgctcgtcacacatgacgacaatatggcgcaatacgccgatcgcatcgtcacacttcttgacggccgcatcatcggcgaccggcttacgtaacattcatgacaacgcatatcgacaactatgacgacaacagaagggccttccatgggcaacaacacaagaatcgcaacactgctcaacggggcaatctcactattggcggtggtcgccatcacgttggtatgcattgtgccgacggcgttcgccgaagatggtgccaatacttccgatgctccgggtgcgggagcggacaacagtgttgagcagattgctgggccggtgccgaacatcattatcaccaatttcacctatggcgacgggtcggtggcggtcggcagcaccttcaacctcggtttcaccttccaaaacatgggcaaagtggcggtgagcaacatggtggtcaccgtggacggcggtgagaattttgccatctccggcggtacgaacacgttctactacgatgcactgaatgcgggagctgcgttgacgcagaccgtgccgatgcagacactggccagtgcgaaaaacggcgcgcagggcatcgacatcagcttcaaatacgagtatgtggacggtgccgcacgcagctccaacacttccgacatcaaaatttccgtacccgtttcgcagcctgatcgttttgaattgaacgatccagtggtgcccaatatcgtcaacgcgggtgaggaaactactatcaccatggattacgtgaacaagggcaagggcgacgtttccaatgtcgaggcgagcgttgaaggcgacggtatcaccgccacgcaggccaagcagtacgtcggcaatgtggcgtccggcgcgtccggctccattggattcgcattcactgcggacaagcccggcgaaaccgaagcgaaactgacggtgacgtatgagaattccgatggacagccgcagaccaaggaatttccggtgaaaatcaatgccgttgaagctcctgttccggatgattccgatacggatgttgacgtccaggatcagagcatgccggtctgggtgtggatagtggcggcggccgttgcactcgtcgtgattgtactgacggtcgtattggtggtccgtcaccgccgtaagaaggcaaagcaggcggccgatgatgacgattgggattgggagcctgccgatcttggagccgataagcagggtaaatctactgccatggctgccgatgcgccgacgcaggtaatcgccacggcaggtggcacatcggccgcctccgtatccgcaacgtcatcttccactccatccgtcaaggagtaggcatgcgattttcggatatcgcacatacttgcgcgcagaatttgctgcggcgcaaatcgcgtacgattttgacggtgctcggcgtgatcgtcggctgctgctccatcgtcctgatgatttcgattggacaaggcatcagcgagcagaatgagcagatgctcaagagcatgggcaatctcaacgacattaccgtcacagctgccggcggctcgggcgcgtacgacagctctggcgtcggtatgtcgagtttgtcttcgtcggacatgacatcatcggatcatcaggccaagcttgacgatgctgcggtacagacgttccgtggcatttcaggcgtcgcggccgtgatgccacagcggtcggcgcagagcaccgtggatctcactgcgggagccggatcccgatacgtggctcaatatgcttctgtgatgggtacggatatgacccagcttgaagcatcgggatacaagctcgttcaagggcgtatgccgaagcgtgccggagaagtattgctcggcaaatacgcggcataccagtttatggataagtatcgttccgatgatgactccaggcgtatcgctcccggtgattatgagtgcgatgagaacggttgcaaggagagcgagggggagaagccgttcttcgacgtactgaccacgaaactcaatttgattaccggagccgattatcaaagccctgacgattaccgcaaaataggcagcacttcgatgagttccaccgattcaggcgacggcgatggtactgccagttcgcagaatcctgtggtttccatgcctctcaccgtggtcggtgtgttggacgcttcaaccaataattacgatgcattcagctccggtgtagtcatgtcgctggaggatatggacacattgcaggccaaaatcgacggcaaaaccaataccaccagccggaccaaaacaaactacgaccaagtggtggtgcacgctcaaaatatcaaggatgtgccgggtatcgaagcgcagatcaaaatgtctggctaccaaaccacgtccttcgaacagacccgcaaggagattgaaaagcagagtcgtggcatccagctcgcattgggaggcattggcgcggtgtcattcctggtggcggccatcggcatcgccaacaccatgattatgtccgtgtcggaacgcactcgggaaatcggcattatgaaggcgctcggctgctatgtgaaggatattcgcacgatgttcctatgtgaagcaggtgccatcggtctggtcggtggacttatcgcctgtctgatttccgccttggggtcgctgagcatcaatctgctgtcgtttggtggattcagtatggaaaacgtaggcaaagcgattatgggcggtgacgacgtgagccgaatctccgtgattccatggtggctgtttgtcgtggccgtgctgttttcgattctggtgggcatactcgccggtttggggccagctaataaggctgtgaagattcctgcgttggacgccatcaagaacgagcaatagcgattgcgattgacaataatgcttatggtcggccatgtgctgttcagcgtgggccggcatttcgcgattgttcaacgttccctgtcgatttttgacggtgccggctagttgcgtgattaacgggccaagacgcggcgaatgcgatcagccaccgcttccacagtcagcccgtaacgttcatcaagctcggcaaggggcacacgatcggtgaattctttcgatgcgccgaaattgagcgcatgcacagtggctgctttcggattagtggaattcgcgtagaaagcggtcaccttctcaccccaaccgccttccagctggccatcctccagggtgacgaccacacgatgaccgtcggcaagcacgtccagcagctcgccatccatcgcggaatactgctgcgcgtcgataagcgtcgcattgatatcgtcgtcgttttcgagcgttgccgccacctcggccgccaacggcagtgtattgcccaagccgagaatcgccacttcacgtcccggacgcacgatctggtaccgcgtgaaagggcaatcgccggtaatatcgatcgtcgtctcgtgcgcgtcggcacgttcggccgggtcgaacgccatatcggcggaacgttccatggcaagaatctgctcgccgggcatgcggatagccgtcacgccatgatcagacggccccgtggcccatgcaagcatgtccagcatctgctctccgctggtcggtgccagacaggtcacatcaggcgtgttggcgaacatcgtcatatcgaacgtgccggaatgtgtattgtccgcgccggaaatgcccgctccgaaaatcagcagcgtcgccggaacatgattcaacgccagctcctgctgcaactggtcgtaaatacgctggaagaacgtggcggaagtcgccagaaccggccggcctccagccttcgcgatgcctgcggcgaacgcggccgcatgctcctcggtaatgccggtgtccacataatgcgatccggcacgttcacggaaatcacgggtgatgccattcgaaccaggggtggcgggggagatgaccaccagtcccggctcgttttcgaaacgggactccaacgaagccatggccatctgaccgtagtatttgcgcgcgtcaagcggcttgccgagcgcgctgtccggatcctgccaatgattcgcctcgcattggccggcatgcggctgcggattggtctggttgcatccgtcggaaccatcctgcgcctcggtctcatcgctgaaacccaagcccttggtggtgtggatatgcagcacgacgggatggtcgatatccttcaagtcttcaagcgccgcgaccagcgtgtccacatcgttgccctgctccacataacggtagtcaagtccgaacgccttgaacagattcagctccgcggttccgttcgacgcgcgcagacgggcaagattgccgtacatgccaccgaaatcctcggcgatcgacatctcattgtcgttgacgacgatgatgagattaccgccctgttcggcagcgttgttcagtccttcgaaagcgatcgccgagctcaacgaaccgtcgccgatgatggcgatgacgttgccgatttcgcttgctcccgcagcggtatgttgcatatcacgtgttttggcaagaccgcaggcaagggagatggacgtgccggtatggcccagcacgaaggaatcatgctcgctttccaacggattggtgaaacccgtcacctcgccgaaccgcgactcgtccagatacgcctcggcgcgcccggtaagcatcttgtgcacgtagctttggtgggagacatcgaaaacgaaacggtcacgtggagaaccgaacacgcggtgcaacgccacggtaagctccaccacgccaagattcgaaccgatgtggccaccatgcttccgaccgtaattcaacagcgtggaacgaatctccagacacagatcacgcaactgttgcgaagaaagggcatgcacatccgccggagaatgaatcgaacccagtatgccagcggtcattatgcgcaactgtccttccctgaacctgtcttctttaccgcggaaaatcctatcccactgtatgcttctgccggggtgtcggttgtgaaatacctgcaaagtcttctcaactgcggcacaatggaaacgatgaaatgaatcgaaccaccgaaaaaccgcgaaggagcgctgaccatgaaagccgtatacgcagcaggaaccgattatgacaatccgctgtcgcaactcaaggtgggggagctggacacgcccgaaaccaagccgttctggagtaccatccacgtggccacagccagcgtgaaccaccacgacatctggagcctgcagggcgtgggactctccgccgaacagacgccgatgattctcggcaccgacgcgtcaggcgtgctcgacgaggacattcctgttcgcaaagggctgaaagccggagccgaagtggtgctctacaccttcgtcggcaccgacggcgccggcgtcatgccgggggagcggcgcaccatcctatccgaaaaatacgcgggcaccatggccgaaaccacccaagtgcccagcgccaacgtgttcgccaaacccgccaacctgaccctcgatgaggctgccgcgctcggcaccagctggctgaccgcctactcactgctgttcacatcggccaacgtgaaaccgggagacaccgtgctcgtccaaggcgcgggcggcggcgtgtccacagcggccatccaactcgcccatgcggcaggactggaagtgttcgtcacgtcacgcagcgaagagaaacgagaccgcgcgatcgccatcggagccgacgccgccttcgaaaccggcgcgcgactgccgcataaggtcgacgctgtcatcgaatcggtcggcgcggccacctggagccattccgtcaaatccgtacgccccggcggcaccatcgccatctgcggagccaccacaggagaccagcctggagccgaactgacccgcatcttcttccaggacattcgcgtgcaaggcaacaccatgggttcgcgtgacgatttcgcacgactgctcaaattcgtggaacacgccgacctgcaccccgtcatcgactccacctacgcgcttgccgacgcgcccgcggcgttccgcaaagtggtcgacggcgacgttttcggaaaggtcgtgctgcacatcgagccaagtaagtaaagtaggcggtgttctggaacacgtaagtctacgtaaatccttcggaggttttgatggcagacaacaagcctgaagtcgcggtgatcatgggatcggcaagcgattgggagaccatgaagcacgcatgcgagatgctcgaccagttcgaggtgccgtacatgaagcaggtgatttccgcgcaccgcaccccggaactgatgggtgagttcgcgcacaacgcccgtgccaacgggctgaagatcatcatcgccggcgcgggcggcgcggcccacctgccgggcatggtcgcggcgcagaccacactgccggtcatcggcgtgccggtacgctcccacgcgctgtccggctgggattcgctgctgtccatcgtgcagatgccgggcggcattccggtggccaccaccgccgtcggcaactccggcgcaaccaacgccggcctgctcgcggtgagcattctgagcaccaccgacgagcgactggccaaggcgctgcaggactatcgtgactccctgaaggaaaaggtggctgaatccaatgcccagcttgtctgaggaaaccaacggccgtatcgaacgactgatgcccggcgcgaccatcggcatcatcggtggcggccagctcggccgcatgatggcgctgtccgcacgctacatgggcttccgcatcggcgtgctcgacccgacacccgactgtccggccgctcaggtcgcggatttccaagtgaccgccgaatacgacgacatcgccgccatccgcgaactggctgaaaagtccgacgtgctcacctacgagtttgagaacgtggacgccgacgccatcgatcaagtgcgttccctcgcggcggccccgcaaggcaccgatctgctgcgcgtcacgcaggaccgtgtcaacgagaagcggttcatcaacgaccatggcacgcccaccgcgccgtggaaggctgtcaacagcgtcgaggaacttgaagcggcacttgatgagatccactatccggctgtgctcaaaacccgttccggcggttacgacggccacggccagaccgtgctcaagtccgaagccgacttggagcaggtgcgcgcccgcgccgaccatgacggcagcttcccgccaagcattctggaaggcttcgtcgatttcgcgttcgaagcgagcatcctcgtcgccggcaacggcaaggattacgtgaccttcccgatcgtgcgcaacgagcatcgcaacaacatcttgcacatgaccatcgcgccggccgaagtggacgaaaccgtggccaaggaggcgcacgagctggcgttgcgactggccaaaggcttcgaactcgccggcattctggccatcgaactgttcatcaccaaagacaacaaggtcatcgtcaacgaactggccccacgtccgcacaattccggccactacaccatcgaggcctgctcgttcgatcagttcgacgcgcacattcgcggcattgccggctggccgctcgaacagccgcagctgctcaagcccgccgtcatggtcaacgtgctcggccagcatgtggcgccgacccgtgcgctcatcgccgaccatcccgaatggaacgtgcacgactactgcaaggcggaagtgcgccacgaccgcaagatgggacacatcaccgtgctgaccgacgacaccgccaaaaccgtagccgaccttgaagccaccggctgctgggacgacttgaagaaagcctgacatcataagtaatgagtgaacatatcgtgcggcagacccgccagaaagacgccatccgcgacgcgctgaacggctgcgacgaattcatctccgcgcaggagctgcaccgcaagctggaagaccgtggcgaacatatcggactcgccacggtctaccggcagctcaacgccctggccgaggcgggccgcgccgacacggtccgcctcgacggccagcagctgttccgcctgtgcggcgacgacggacaccatcatcacctcgtctgtacgaactgcggcaaaaccgtggaaattgaatcgccttccgaaagctggctgaaaggcatctccgacaagtacggcttcaccatcgaacggcacacgctggaggtgttcggcctgtgcgaggactgccggaaggcggacaagtagcggctgtctgccgtatttccgttggaatcgtatcgccatcggcgcaatccaatcgtaaaaatcgtaaagaaaaaacgttggacgttgtctttttcagacgcgtatatgacaatagggcattgcaaacgaactaagtggggttatgcgtgaccaaagcaacatcgaaaaacgagccgattgaggagctcgacatcgctaccgtggacccgatggccaagaaagcgggcaaggagttccccggctggctttacggcgtgctattcgtgctgttcgatgcggtgggcgttgccgccctgcagatcggtgtcagcgaatccgccactcgagtccaactatcgaacaacatgtggctcaccggctggggattcgtcggcaagatgttcaccagcgctaattttgtggctgtgctcaacctcatactgtggggcgtcctgtacgtgatcctgctcatgctcaccaaccgtttctgggtggccacgccgatatttctggcggtgacgttcatcgtcgccgtgattgagcatttcaaagtgtcgattcgatacgaggcgattctgccaagcgacctgaacttcctcaaagccgacgccggcaatctgatgagtttcatgccgtccggcgcgcaatggaccattctgatcgcggtggcggcgtttgccgcgttcgtggcgctgttcgtcttcctgaaccgcctcgacgcgcgtcacggcagactgtttcgcggctccgacaagcaatcccgttccgtgaacgcgatcgcaagactgctgctgatcctgcttccaggcctgttcttcacgctgtattcgatgcaggtgagcaccgtcggctcgtgggccaaaggcttcgccaccgtcatgggggacaagccctccatgtgggactccgtatacgacgcccagcgcaacgggccgctggtggcgttcacccgtcagctcaacccgaaagtcatggtcaagccggacgactattccgaagagaccatgaagcaggtcgcggcccgctatgagaaggccgcgaagaagatcaacgcgaaacgttccgcgaacatgaccgacagcaccgtcatctacgtgctgtccgaatccttctccgacccgtcacgcgtgccgggactcaaagtcaacaaggattccatgccgaagatccgtgagatcaagcagaataccacgtccggcctgatgctgtcctccggatacggcggcggcaccgccaacttggaatacatgggactgtccggcctgagcatggcgaatttcgattcctccctgaccagcccataccagcagctggtgccgagcgagcattggacgccgacaatcaaccagatgtggggcgccgcaaagaactccatcggcctgcacccgtacgaatcgtctatgtattcgcgcgccaccaactacaagaagttcggcttctcgcatttctatacgttgaccggtccggacgtcatctctcatcaggacaagatcgacgattcgccgtacgtctccgacgaggccacctacaagagcacgctggaacaggtgaagaaaaccaagtccaaccagttcctgcaggtcatcaccatgcagaaccacatgccttaccacaagtggtacaagcataacgatttcaaggcgacctccaccacggacaaaccgttgaaggacgacgagcaggagtccatcgaaacctatcagaagggcgcttcgctgacggatgatgcgaccgccgatttccttgccgaactcgacaagctcggcaagccggtcaccgtggtcttctacggagaccatctgccgggcatctactcgtcggcttccgctgatgacggcaactcgctggcgttgcatcagacggactacttcatctggtccaacaaggcttccggcacgcaaggcaacaagatcggcaacgccgactattcgtcgcccaacttctttgtggcgcaggccgccgagcatatggatgccaaggtgtcgccgtatctggcgttcctcaccgaaatgcactccaagatctcggccatggaaccgccggtggtcaacaacatccaaggctgggaccgtattccggaaggtcagaacatctaccttgactccaagggcaatcccatggccgaaagcgatttcgacgccgaaaccaaacagctgatggcggattacaagctcatccagtacgacatcaccacggggaagaattacctgaaagacacctccttcatggacctgccgtaacgaggacggcgcgcctgccgcacggctcgacactcgacgtaccgttgtgcgccttcgtgtcgtgccgcacggaattcgcgcacgtcctcgtcacggcaggagtgtggtgggcgacgacgcgcctgccgcacaaatcttaaaacattgaggggctgttccaaactattggaacagcccctcaacggctattggttcagcgcagccaacacaccatcatcacgcgttcagcgctttgaaaccgatgtcgtgacggtagaacatgcccttggtgtcgagcttgtcgatgatcgcgtagaccttgtcctgcgcggccttgatgtccgcagcggaggactcgaccagcagcacgcgaccggagttggccacgagaccatgctcgccacgtgcgacgcccgcatagtagacatgggaatcgtcatctaccgtgatctcaggaatcgcggcacccttgaccacgttggtcgggtaaccttcggaagcgatcaccacgccaagagtggcattgtcctcatcccacgtgaattccggggtttcgccgttgagaatggcgctgatgccggcaccgagatcggacgtgagcttcggcagcaccacttcggtctctggatcgccgaaacgcgcgttgaactcaatgaccttcgggccgtcggcggtggcgatgaggccggcgtacagaatgccggtgaacggcgtgccctcgtcggccatggcctgaacggtcggcttgacgatggtttcgatggcggtgtcgatcacatcctgaccgatctgcggaaccgggctgtaggcgcccatgccgccggtgttcggacccttgtcgccatcgtaggcacgcttatgatcctgcgaaatcggcatcggccagaaatcggtgccgttcacaaagctcatcagagagaattcctgaccctcaaggaaatcctcgataaccaccttcgcgccggcgttgccgaagcggtggtccacgaaaatgtcctccaaagcggcgatggcggtctcctcatccatcgccacggtcacgcccttgcctgcggccaggccatcggccttgatgacgatcggcgcgccatgctcgcgcacataagcggtggaacgctccaaatcgtcgaacgtctggtacttcgcggtcggaatgtcgtgacgttccataagctgcttggcgaagtccttggaaccctcgatctgcgcggcggccttgttcgggccgaacgccttgatgccggcggccgcgaaatcgtcgacgatgccttcgataagcggcacttccggtccgacgaacacccaatcgtaaccattgttcttcacgaaatcgatgagcgccgcatgattggacgggttgagctgcgtggtgcggatgccgtcaagttccatgcccggattgcctggagccacagtaacctcgctgacgctgtcgccacgcatgagcgcgtgggcgatggcgtgttcacgcgcaccggaaccaatgaccagaaccttcatatttcctcctgttgtatcccttatggggaagagtgccaatctcaagaaataatatcgggggtgcctgttcggctacccccgtatgttcgtttactgcagttcgacgtcctcgccggtcttcttgacgatattgcccagcacatagccggcctcgccattggacttcagcagttccatggtcttatcggcatcttcggcgctgaccgccagcaccatgccgatacccatgttgaagatgttgaacatttccatatggtcgatttcgccggccttctccagcacgtcgaagatcggcagaaccggccaggagccgaggttgatatgcgccgcgagaccatcggggatcatacgcgggatgttctcgatgaagccaccgccggtgatgtgcgcgacgcccttgaccacgccggccttgaacagcggggacagcgtcttgacatagatcttggtgggggtgagcagcacgtcgccgagcttctcaccgccgagctcatccagctgggtgtcgacggtgtatccggcctgttcgaacagggccttgcgcaccagggagaagccattggaatgcacgccggtggagggaaggccgatcagcacgtcgccttcgacaatcgaggaaccatcgactatggcggacttctcggccacgcccacggcgaaaccggccaaatcgtactcgtcctcgtcgtacatgcccggcatctcggcggtctcgccgccgatcaggccgcaatcggcctgcacgcagccgtcggccacgccggagacgacctgctcgagcagagccggatcgttcttgccgcaggcgatgtaatccaggaagaacagcggctcggcgccttgggcggcgatatcgttgacgcacatggccacgcagtcgatgccgatcgtgtcgtgcttgttggccatcttggccacgaccagcttggtgccgacgccgtcggtgccggaaatcagcaccggctccttgtaaccgagggaagcgagatcgaacaggccgccgaagccgccgatgccgccgaccacgcccggacggttggtgcgcgccacgtgggacttgatacgcttgacgacttcgtaaccggcctcaacgcttacgccggcttcctcatatgcttttggcatatctaacctttctcgggtctcagtgttcttcttgggatgaagtggtggtgtattcgttgccctcgtacttgctcttgtacaaagcgaattcaggcagacggacacgatcctcgggggtgagcgacttcaggaagtcggcttcgtaatcgtccaaggcggtcggatagtcgccgttgaagtaggccacgcacaggccgccatacggtgcgtccgcgccaaggccgatggattccaccaagccgtcgagcgacaggaacgccagtgaatcggctccgatgtagtcgcggatctcgtcgacggacttcttggccgcgatcagctccttggtggtggagatatcgatgccgtagaagcacgggtatttcagcggtggcgagctgatacgcatatgcacttcggccgcgccggcctccttgagcagctgcacgattcgcttggacgtggtgccacgcacgatggaatcgtcgatgacgatcacacgcttgcccttgaccacgccacgaacggcggacagcttcatgcgcacgccctgctcgcgcagttcctgcgtcggctggatgaaggttcgcgccacatactggttcttgatcagacccatttcgttgggcaggccggcctcttccgcatagccggaggctgcggacaatgaggaattcggcacgccgatcaccatatcggcgtcgaccggcgattcctgcgccagacgtgcgcccatgcgcttgcgggcggaatgcacgttcacgccgtagatatcggaatccgggcgggcgaagtagatgaattccatcgagcagatggccagctgcgtctgattcgtgtactgcacgatcttgtagccgtggtcgtccaccaccacgatctcacccggacggatgttacgtaccaattcagcgccgacgacgtcgagcgcgcaggtttcggaagcgagcacatacgcgccgttcttcatcttgccaagggagagcggacggaaaccgttcggatcgagtgcgccgatcatggcgttctcggtcataatcagataggcgaaaccgccatgcacgatgttcagcgcttccttgagcttgtccataaacgtgcgttgcgtggagcggcggatgaggtgcatcagcacttcggtgtcggaattggaatggaagatcgcaccctcatcttccagcttgcggcgcagggacaggcaattcgtgagattgccgttatgacacagcgccatatcgccgtcatggaaacggaagatgaacggctggatgttgtcggtgccgccggagccggcagtggcatagcgcacatggccgatcgccctgtcgcctttgagtcgtttgatttcacgctcgtcgctgaatacctgggtcagcagacccgttccgcgatgaccgatgagatgaccgttatcgttggagacaatgccggcaccctcctgaccacgatgctgcagcgcgtgcagaccgaagtaagtgagtcgggcggcgtccgagtggccccaaacgccgaaaataccgcattcctcgtggatgtcttcgagttcagctgacaagccaaagctccttccaaaaccatggagacaaggggttcgctaccgtccaacagtatcaatgggcggctacaagagtcgggttttgtccagttctcagacggtatatggaaccggacatgcaatcgaacagccgttcgaaaaagctgttatgatggaagacgttgaaaacgcgaatcacggtcgtcggggtgcgggaagtcccccgtatgagccattgcatggaaggagcatcatggccggacggatatacgtggcaatcgacctcaaatccttctatgcgtcctcggaatgcgtggaacatggattccctccgctatccacacacttggtggtggcggaccaggagaggaccgacaaaaccatctgccttgcgatctcgccgtcgttgaaggcatacggtctgcccggacgcgcccgcctattcgaagtcaaagcgaaactgaaggaaatcaacgcggtccgtcgcgccgcggctccaggcggtgtgctgacggggaaatcgtatgatgcgaaggcgctcgcggccaattcgaatctggccgctgacgtgttcatcgccaaaccgcgcatgtctcattacttggcgatgagtgcgaaaatctacggtatttatctgaaatacgtttcggctgaggatatccacgtctattcggtggacgaggtgttcatggacgtcaccggctatctgcgcgcctatggcaaaggggtggaggagatgacccgtgacatcatccgtgatatccacacccagaccggcatcaccgccaccgcgggcatcggcacgaacatgtatctggccaaagtggctatggatatcgtggccaaacacatccaggcgggggaggacggcattcgcatcgcccggcttgacgagatgtcgtaccggaaattgttgtggaatcaccggccgcttaccgatttctggcgtgtggggcgtgggtatgcaaggaagctcgaagcgcacggactggcgaccatgggggatatcgcgcgctgctccatcgggcgtgccgacgaatactacaacgaagatctactgtacaagatgttcggtgtgaacgccgaactgctcatcgaccatgcgtggggttgggaaccgtgcaccatcgcggacatcaaagcgtacaagccggcggggcacagcttgagttccggacaagtgctgacgggaccggtgggttttgatgccgcccggcttatcgtgcgtgaaatggcggatacgctgtctctggatttggtggcgaagggcgtgaaagccggcagagtgggattgatggtcggctacgacacggcaagtcttgatccgaaacggcttggcaaggatgtttccgctgatttgaaggcgattgccgaacatgccgcggcaacatacgacggccctgtttcgatcgacaggtatggccgccgcgtacccaagccggccaccgggtcgatcgcattgccggagccgacgtcggctacgtcgcgtatttgcgacgcggtcgataagcttttcctttcgattgtcgacaggcgtttgctggtccgtcgggtgaatgtggtcgctgccgatgtgctgaccgacgagcaacttgaggaaaggcggcaggcggccgcgtccgaatatacgcagcctgatttgttcgccacgatggaagcgccggtggattccgcttccgctgatgcggccgaatgcgaggctatgcgttccgccgatggtggttccaaggattcgccgcaaggggacgccgaactgcatatgcagcaaacgcttctggacatcaaacgcaaattcggcagaaattccatcatcaaggccatggatatgttcgatgacgccacaggccagcagcgcaacaagcagataggaggtcatgcggcatgagccttacggaaacccatcgctacgacgacatcatcgatctgccgcatcaccaatcgcagacgcatgcccatatgagcatgcataaccgtgccgcccaattcatgcctttcgccgccctgaccggttacgacgacatcatcagacaaaccgcgcaatccagcgatgatgcggtggaacgcgccaacaggcccgtcgatctcgacgagggttacctttccgcctgaagcggctgctatgacgaatgtcgcggattgctgtatatgaaagggtggattcggaatcatgagatttcgaacccacccttgattatgtgagcgtgaaaagagtcttgatgctcaggcggtgaagtattccacgccggctgcgaacagcggctggtccttttcgccgggcacgttcacgaatgtgccgttgctgtagcgctcggagtggcccatcttgccgaacacgcggccgtccggactggtgatgccttcgatagccagcagcgaaccgttcgggttcacatccaggtccatgcccggcacgccatcctcgtccacatactgcgtagcgatctggccgttggccttgagctgagcgagcacgtcatcggaagccacgaaacggccttcgccatgggagatggcgatggtgtgcatgtcacccacggcggtcttcgccagccacggggagaggttcgacgccacgcgggtgcgcaccagacggctctggtggcggccgatggtgttgaacgtcagcgtcgggcattcggcggtcatcggcacgatgtcgccgtacggcaccagaccaagcttgataagcgcctggaaaccgttgcagatgccgagcatcaggccatcacggttgttcagcaggtcgcgcacggcctcggtcacggccggagcgcggaagaacgcggtgatgaacttggcggagccgtccggttcgtcgccgccggagaagccgccaggaatcatgatgatctggctcttcttgatctcctcgaccaaagcggcggtggactcggccactgcggccggagtgaggttgttcacgataagcgtgctcacgtcggcgcccgcgcgttcgaaggcggctgcggaatcgtattcgcagttgttgcctgggaacacagggatgatcacatgcggcttggccacaccggtgccggtgtatacggtcttcttcggagcgttgaaggacatggtttcaaccgtcttgcccttctcctcgcccttagaacggtacgggaacacggattcgatgccgccctcccacgcgtcctgcagctcggccagatcaagcgtctcgccggcggccacgaacgaatactcctcggtggtttcgccgacctcgctgacttccaccaggttggacacggccggaaccttcgcgttgtcggcaagctcgatgatgaaggagccgtaggatggaacaaacaggtcgtccacggtaatgccgtcggccagcttcacgccaatctggttgccgaccgtcatcttgaagatcgcctcggcggtcgcgccatagcccggcgtggacacggccagagcatcgccgaaatcggtgagctcctcgaccgcggagaacacctccagcagcgaatccttgtccggggtgagaccgtcggaatgataacgcggggcgatgcggaccacacggtgaccggcacccttgaactccggggaggtggcgcgcttcatattgcccacggccacggcgaaggagataagggtcggcggaacgtcaagctgctcgaacgtgccggacatggagtccttgccgccgatcgcgccggcgcccagatccacctgagccatcaaagcgcccagcacggcggccatcggcttgccccaccgttccggctcgtcgcgcagcttctcgaaatactcctggaagcttaggtacgccttctcatgttcgaagccggcggcaaccagcttcgaaagcgattcgaccacggacaggtacgcgcccgtgaactggttctgctccatgatgtacgggttgaagccccacgccatcgcggaagcggtggtagtctcgccgaacaccggcagcttggcgaccatggccatgttcggggtcagctgcttcctaccgccgaacggcatgagcacggtgcctgcaccgatggtggaatcgaagcgttcggaaaggcccttgttggaggccacgttcagatcggtgagcatggtgtgcatgcgctcggcaagcgtgccggtcttccacggggtggtgtagccgtgctgcgcctcgacatgcaccacctgatgcttcggagcgccgttggaggcgaggaattcgcgggaaaggtccacgatcgtgtcgccgttccacaccatcgtcatgcgcggatcctcggtcacggtcgcaatgacctcggcctcgaggttctcttccttggcgtagccgaggaactcgtccacatcttcggcggccacgtccacggccatgcgctcctgggattcggagatcgccagttcggtgccgtcaagaccctcgtacttcttggacactttgttgaggtccacgtacaggccgtcggccagctcgccgaccgccacggacacgccaccggcgccgaaatcgttgcaacgcttgatcagacggcacgcgtcaccacggcggaacagacgctgcagcttgcgctcaaccggcgcgttgcccttctgcacttcggcgccgtcaagctccagcgattcgacgttatgcgccttggaagcgccggtggcgccgccgatgccgtcacgaccggtgcggccgccgagcaggatgaccttgtctcccggagccggggtctcgcggcgcacatgatcggccggagtcgcggccacgaccgcgccgacctccatgcgcttggccacataaccggggtgatagatctcattcacctggccggtggccagaccgatctggttgccgtaggaggagtagccggccgcggcggtggtgacgagcttacgctgggggagcttgccctcaagcgtttcggaaaccggcacggtcggatcggcggcaccggtcacacgcatcgcctgatacacgtaggaacggcccgacagggggtcgcggatgcagccgccgatgcaggtggccgcgccaccgaacggttcgatctcggtcgggtggttgtgcgtctcgttcttgaacaggaacagccaatcctcgtcatggccgttcacatccaccttcaccttgacggtgcaggcgttgatttcctcggattcgtcgagattcttcagaatgccgttcttcttaagccacttcgcgccgatcgtgcccatatccatcaggcataccggcttggcgtcgcggcccagctcgtgacgcatctcaagatacttgtcgaacgcggccttgacggtggcatcgtcgatcgaaacctcgtcaagttgcgtgccgaacgtggtgtgacggcaatggtcggaccaatacgtgtcgatcaccttgatctcggtgatcgtcgggtcgcgctgctcctcggtgaagtgctcacggcagaactgcaggtcggccagatccatggcgagaccacggtcctcgatgaactgctcaagctcggcgtcgctcatagaacggaagccgtcgatgacttccaccttgcctggcaccggcacctgggtcttcagcgtggtcttgacatccagagaggcttcacgggcttccaccggattgatcacgtaatgcttgatggcctcgacatcggcttcggaaagttcgccttccaacgcatacaccttggcggaacgaaccgtcggacgctcgccttgggagatcagctggatgcactcgctggcggaatccgcacgctggtcgaactggccgggcagatactccaccgcgaacacggtgtcggaaccgaaatcaggcaggtcggcgtagacgttgtccacctgcggctcgctgaacacggtcggcgtggcctgggcgaacagctcctcgctgatgtcttccacgtcgtaacggttgacgagacggacgttcttcaaagcttcgatgccgagaatggtgcgcaactcgttggcgagctgctgggccgcgacgtcaaagcccggcttcttttccacgtacacgcgaaaaaccatggtcaactccttgaaaaaagaggggttattggatttggattgacaaaagaatgaaggattgcgatataacaaggaagcccgcatccggctttcgcttcagatgcgggcttgcaaacgcattactctgcgacttcgatgccctcggacttggcgagctcggccaagcggctttcgatctcctcgtatgccgggatgatgtcgcccaggtcgcggcggaacaggtccttatcgaggtgctccaccttgccggaatggtcgcgctgatcccacagacggcaggaatccggcgtgatttcatcggcgagcagcagcgtgccgtcggaggtgcggcccatctcgatcttgaaatcgaccagcttgacgtcgatcttggcgaagatttcgatcagggcttcgttgatgcgacgggcgagcggcgcgatttcggccagatcctcgcgggtgcacacatcgagcgccaccagatcgtcgtcgttcacgaacggatcgtgcaggtcatcgttcttcaggaagtactccagcaccggttccttgagctcgatgccctcttcgacgcccaggcgggagcagaagtggccggccgcggtgttacgcagcacgatctcgagcgggaacatcgtgaccttcttgaccagctgggaggtctcgcccacgcgtgccaccaggtggctgtcgatgccgcgcttcttgagcagatcgaagatcaacgtggtgatgaggttgttcagcctgcccttgccggcgaagtcttccttcttttcgccgtcacctgcggtagcggagttcttgtattcgacccagaggacctccggatcgtcagttgcgtacagttgcttggctttgccctcgtagagcttttccaacttctccattactcgcctttcctggtgtgtgggaggtagatagtttggtgaacttgacggttaacaagataccaacgggaggctacaatcgcgcgacttttgggcgcgttccggcagcctcgtctcagcatccggcgatagccgtcaaacgattgcgatgtcgagcgattcggccacgttcccggctttggcgcgcgcatccgcctcgttgccgccgatggccagcgcgaccgccatgcgtcggtgcccatgcacttccggcttcgcgaagatacgcaggtcggtacccggttcggcgagcgcggcggcgacgttgcggaattccgcttcgccatcgccctggacgacgatcgcatggcttgctgcgacggtgccttgcggaatcgacagggcgacatgttcctgtgtgatcggcaggccgaggatcgcgcgcgcgtgcaatgcgaattcgctcaatcgctgggaagccatggtgaccatgccggtatcgtgcggacgaggggagacctcgttgaacagcacgtttccgtcggtcagcacgaacagttcgacgccgaacacgccccagcctttttcgccggatgccttggccttcgccaccagaccttccacggcggttcgtgcgatgtgctgggcctgttcgagcacgtccggcgtgaaggtggccggctgccaggattcgcggtagtcgccgctttcctgacgttgtccgattggagcgcaggtcacgatgccggcgctggagctgacggtcagtacggtcagctcgtagtcgagtggggcgagcgcctccacgatcacgcgtgacacgtcgccttcgtcgtgtgcgcggcggccttcctgcgcttcggtccaagccgcgtcgatcgcttccgcggaacgtaccacggactgtccgtggccggaggagctcatgatcggcttgaccacgcatggatagccgacgatttgcgcgccctcacgtagttcttccagagagccggcgaaacggtacggggtggtcggcagtcccagttcctcgtgtgcgagcacgcgcaggcgttcgcgatccatgcagatcgccgcgatttcggcgcttggcaccacctgcgcgccacgttcggcggcggccgcgagttcggaggtggcgattgcctcgacctccggcacgatgatgtccggctggatttcgtcgaacagcgcgcgcagctggtccgcgttggccatgtcgagcacgcggtattcgtgcgccacctgttgtgccggcgcgccggcgtaggaatcggccgcgcacacccatgcgccgagtctcatcagttcgatggtgacttccttgcccagctcgccggagccaaggaacagaacacgggtcggatgcttgccaagcggagtgccgagggcacgattctcttcagtcatgacttctattgtgccatcggcgtaggatggaacgcatgtccgagaatgagaagaatgaaacgcaaccccccctgaccattgccatggtggtcgacacgtcggggaatcgaggcaatggcacctcgaattcggcgttgcagtgggcgcaggagctggagcgccaggggcatcatgtccgtttggtgggcatcggcgcgcccgaatatcccgcgcgcgtcaatcatgtgccgttggtcagctgggtggcgaagaagcagcagatgcagttcgccgagccgagcgacacgctgtttcgcaaggcgttcgatggtgtggacgtggtgcatatctacacgccgttccgtttcggccagcatgcctgcaaggtcgccaaacagatgggcatcgccgttacggccggctaccacgtgcagccggagaacgtcacgtattccgcggggcctttgaaatatgtgcccggcatcgactcgttcatctactggctgttcgacatatggctgtaccgcaagatcgaccatgtgcatgtgccgaccgaattgggtgcgagcctgctgcgctcgcatggatacaagtcgaagctgcatgtcatctccaacggctacgaatcgcggttcacgccgaagcggcagcgcaaggcggacgagccgtcgccggtgccgttccgtatcgtcgcgtcgggacgactgaccaatgagaagaaccatgtcgcgttgatccgggcgatcgcccgctgccgtcacgcgcaggacatcgaattggtgatcgccggcaccgggccgcttaagaagaggttgcagcgtatggccggacggctgttgtctcgtccggcttcgatcggattccaccggaatgccgacatgccggcgttgctgcgttccggcgatctgctggtgcatccgtcgatcgccgatctcgaatcggtgagtgtcatcgaaggcatggccgccggtctggtgccggtgattgcctcgtcgtcgctgagcgcggccggccagttcgcgctgctggacgaatcgttgttccccgtggacgatgtggacgcgctggcccgtcgtatcgactggtggatcgaccatccggcgcagctcgccaagtggggcggcacctacgccaaacatacgaaaaccaattattcggtggaatcgtccgtacgtaagttcgtcgcgatggaacgtgaggcgatcgccgataaccgtcgctgaatggcgcctgccgcaatcgcaatacaatcgttatacataagcgaaaagccgggagcgatttcccggctttccttgttttgcggactgtcttttacagcagtgcgaccagctcgtccacctgcttgtcggtcgtggcccagctggtgcagatgcgcatcacggtatgcgtgtcgtccgccttttccgtgaagccgagacggacgtcgcgttgcagacgttcggaggtctcgttgtcgagcgtgacgaagatctggttggtcggcgcatcgaaagtcagcgtgtagccacgttccaccagcaccttgcggatacggtccgcggcatcgttggcgtggcgggcgatgcgcaggtacaggccgtcggtgaacaacgtgtcgaactgcagtcccagcagccatcccttggccagcagcgcgccatgctgcttgacgatcgtcacgaaatgcttcggcatgttgccgtgcgtgaacaccacggcctctccgaacatcgcgcccaccttggtgccgccgatatagaacacgtcggcgagacgcgcgatgtcctcgatcgtcacgtcgttgccggaggcggtcagcgcgtagccgagacgcgcgccgtcgatgaacaacggcatgtcgtacttcgtgcagatcttgcggatcgcctcgagctcggccagcgtgtacagcgtgccgtattcggtggcctgcgaaatgtacacgcagccggggaacaccatatgcgtgtagttgccgtccgcgtagaacgtggcgcagtattcgtcgagttcatccgcgtcgattttgccgtcatggtgggggagcgtgagcactttgtggccggtgaattcgatagcgcccgcctcatgcacgttcacatgtccggtggtggccgccaccacgcccgcatacggtggggtgatggcgtcgatgacgacctggttggtctgagtgccgccgacgaggaagaagatttcggcgtccgggcatgcgcaggcctcgcggattttggctttggcgctttcgcagacgtcgtcggtgccgtagccgggatactggttggtcgcggtttcggcgagacgggcgatgatttccggcgtcgcggcgcaggagtagtcgttttcgaaagacagcatggtcgttccttttgttgtgggttgcttgcgatcgggaaagtctggttccgcgcgttcggccgccgcggatagcaaaaaacctcggaatttcttccgaggtttcaccggggtggctaacgcggctcgaacgcgcgaccttctgaaccacaatcagatgctctaccaactgagctatagccaccatgttctcacttccatgcggaagcgcaacgaatggatactatacacgattttttggatgtgcgcgcgtcggcgtgttgcgcttccggccgtcaagtgatgttcattatgtgaacggaatgttacgcacttgatgggtgggtgcctaatttgtaggcaattccaacggaagatgtcacgacggggtcggcggaaagtcggtcccgttttgttttccccggaaatgacttccatggaaacgtgattgagaaaagaggaaacgataatgcagaagatcaaggcgtttggtgattggctcaccaaatggttcaccgtgatcgtgatcgtatgggccgtgttcaactacttcgtgccgcaaaccagcctgtggggcaagtcctacaccggatacttcctgggcatcgtgctgttcggcatgggcctgacgctgacgctcgacgatttcaaacgtatcctcacccagccgctgatggtcgtcgtcggcacggtggcccacttcgtgatcatgccgttggtggccgtgctgctgtgctggatcttccgtctcgacggcccgcttgccgtgggcgtgattctggtcggctgctgcccgtccggcacctcatccaacgtgatgagctatctgagccgtggcgacgtggcgcttgacgtgtccatcggcatcctgtccacgctgtgcgcgccgttcatgattcctctgctgatgcagtggctcgcctcccagtatgtgaccgtgccggtcgagtccctgttcctcaacgcggtcaaggtggtgctgttcccgatcgcgctcggtgtgatctgccacgccatcttcaaggagaagatcgagaaggtcacggtggcgctgccgatcgtgtcccaggtcgccatcctgctcatcatcggcgtcgtggtcgcagccaatggttcgaagctgttcgtggcatcctcgctgcttgccatcccggtggtcatcctgcacaacctgtgcggctacgcgctgggcttcggcttctccaagctcatgtacaaggtgtatccgaagggcttccgctacgcgcagcagaaggccatcaccttcgaggtcggcatgcaggattccgctttgggcgccacgctggccctgagctccttcgcgtccaacccgcttgccgccgtgccgtccaccttcttcagcgtatggcacaacatctccggttcggtgctgtccagctggtggcgcgagcacgatgacaagcatcagatccacccggattccgacaatggcgagaagggttccgcggccaaggcttcggaagccggggacgccgtcaaggatgagtccgaggaaacggtcaacgcctgaatgtgattcgtggcatcggccaggcagcctctgaaccgtacagaacggttcagaggctgttctgttttgacctgtttttccatggcgatgttagattgtgttgctttgcgctgaagttcggttaagtattgaaaatattgggatttaggggtgttttgccccgtgtcatatgttcgtttgcggtatactaaaggtgaaggccggagttgcagatcggtcgagaattcgtcaggtcgcaatgaagcgccgatggccgtgaggcccatgcgcaacgccttcaagatataactgaagaacaaccgaatatagcgattcgagatggcggcataggcagtacggcgaggacgccgggccgcatggggttatgaaaagactcagaggtttgaagcgatgcgcgcaaggtggcgcgtgggagagtggctccgatgccaggatggcgtcggagccactcttcgtataacggccgttgctgtcgcgacacgattatccagcattgtccggcaggcccgtatactggtaatttgtgtgtgccaacggcatgccttatgtaacaggcgtgcgggttgggatatcccggaactcgattgcatcacgcgcagcaatgcggcggtgagagagggacgggccatcgggccggtggactgtggctatctttacgattcagtgtcgtggagtgtgggtgcagtgcggcggtcacacgaaaccaagagaaaccactgaatcggagaattcaagttgcctactattgaacagctcgtccgtaagggacgtcaggcaaagccgaagaagtccaagactttggcactgaagggaagcccgctgcgtcgtggcgtgtgcacccgtgtttacaccaccaccccgaagaagccgaactcggcactgcgtaaggtcgcccgtgtgcgcctgagctccggtgtggaagtcaccgcatacatcccgggcgaaggccacaacctgcaggagcactccatcgtgctcgttcgcggcggccgtgtcaaggatctgccgggtgttcgttaccacatcgttcgtggcgccctcgatacccagggtgtgaaggatcgcaagcagggtcgttccctgtacggagcaaagaaggcgaagtaagagatatgtcacgtaaaggaccttccaagaagcatcagctgctgccggatccgatctacggttccaccgttgtggcacagctcatcaacaagattctgcttgacggcaagaagtcgatcgccgaggacatcgtctacagcgctctcgacatggtcaaggagaagaccgaccaggagccggtcgccgttctcaagcgcgctctggacaacatccgtccgtccctcgaggttcgctcccgccgtgtcggtggcgctacctaccaggtcccggtcgaagtgaagccgggccgcgccaacacgctgtccctgcgctggctcaccgacttctcccgcgcccgtcgcgagaagaccatggctgagcgtctggccaacgaaatcctcgatgcctccaacggcctcggtgcttctgtcaagcgccgcgaggatactcataagatggcagaggccaacaaggccttcgctcattaccgctggtaattagtcgagaacgagagttaaggaacaatcatggcactagacgtgctcaatgatctcaaccagatccgtaacatcggcatcatggctcacatcgatgccggtaagaccactaccaccgagcgtattctgttctacaccggtaagaactacaagatcggcgagacccacgatggcgcctcgacgatggacttcatggctcaggagcaggagcgcggcatcaccattcagtccgctgctaccacctgcttctggaaccgtcagacccatgacgagaagcagaagttccagatcaacatcatcgatacccctggccacgtggacttcacggccgaggtggagcgctccctgcgtgtgctcgatggtgctgtcgccgtgttcgatggcaaggaaggcgtggagccgcagtccgagaccgtgtggcgtcaggctgacaagtacggcgttccgcgtatctgcttcatcaacaagatggataagctcggcgctgacttctactactccgtcgacaccatcaagaccaagctgggcgcgaccccgctggtcgtccagctgccgatcggcgctgagaacgacttcgccggcgtcgtcgacctgatccgcatgaaggcctacgtctggaacgacgtttccggcgatctgggtgcccactacgacaccatcgacatcccggccgacctgcaggacaaggctgagcagtatcgttccgagctgctcgaccaggtcgccgagtccgacgaggagctgctcgagaagtacctcgagtccggcgaactgaccgaggacgagatccgcgccggcatccgcaagctcaccatcaaccgtgaggcctacccggtgctctgcggctccgccttcaaggacaagggtgtgcagccgatgctggacgccgtcgtcgactacctgccgagcccggaggacgttccgtccatcgtcggcttcgacccgcaggacgagtccatcgagatcgaccgcaagccgaccaccgatgatccgttctccgcactggtcttcaagatctccacccacccgttctacggcaagctcgtgttcgtgcgcgtgtactccggttccgtcaagccgggcgacaccgtcctcgactccaccaaggagaagaaggaacgcgtcggcaagatcttccagatgcacgccgacaaggagaacccggtggatgccgccgaagccggcaacatctacaccttcgtgggtctgaagaacgtcaccaccggtgataccctgtgcgacgagaagtccccgatctccctcgaatccatgaccttcccggatcctgtgatcgaggtggccgtggagccgaagaccaaggccgaccaggagaagatgagcatcgctctggcgaagctgtccgacgaggatccgaccttccaggtgaagaccgacgaagagtccggccagaccctgatctccggcatgggcgagctgcagctcgacatcatcgtcgaccgtatgcgtcgtgaattcaaggtggagtgcaacgtcggtaacccgcaggttgcataccgcgagacgatccgcaaggccgtcatgaaccaggaatacacgcacaagaagcagaccggtggttccggccagttcgcaaaggtcctgatgaacttcgagccgctcgacaccgagaacggcgagacctacgagttcgtcaacgaagtcaccggcggccacatcaccaaggaattcattccttccatcgatgctggcgtgcaggaagccatggaatccggcatcctcgccggcttcccggtggttggcgtcaaggctaccgtcaccgacggccaggtccacgacgtcgattcctccgaaatggccttcaagatcgcaggttccatgtgcttcaaggaagctgccccgaaggccaagccggtcatcctcgagccgatcatggccgtggaagtgcgtactccggaagagtacatgggcgatgtgatgggcgacatcaacgcacgtcgtggttccatccagtccatgaccgactccaccggtgtcaaggtcatcgacgccaaggtcccgctgtccgagatgttcggctacatcggcgatcttcgctccaagacccagggccgcgcaatgttcaccatgcagatggactcctacgctgaggttccgaagaacgtctccgaggagatcatcaaggcccagcgcggcgagtgacacgcgctgccactgaagtggaaactgtctccagtcagcgctagtattttgtagcgctgactgggttcgggctccaaagtggcacaaacccgtcaaacccagtaaaatgtagcgagtgccttgaagtgagttcaaggcttactacgagacgtccaggaggacaaacacatggcaaaggaaaagtacgagcgtactaagccgcacgttaacattggtaccatcggccacgtcgatcacggcaagaccaccctgactgcagccatctccaaggtgctgcacgaggagtacccggatgtcaacccggagtacgacttcaaccagatcgattccgctccggaagaggccgcccgcggtatcaccatcaacatcgcccacatcgagtaccagaccgagaagcgtcactacgctcacgtcgactgcccgggccacgccgacttcgtgaagaacatgatcaccggtgccgctcagatggatggcgccatcctcgttgtggccgccaccgacggcccgatggctcagacccgcgagcacgtgctgctcgctcgtcaggtgggcgtcccgaagatcctcgtcgctctgaacaagtgcgatatggtcgacgacgacgagctcatcgagctcgttgaggaagaggtccgtgacctcctcgacgaaaacggcttcgatcgcgattgcccggtcatccacgtgtccgcttacggcgcactgcacgatgacgctccggaccacgagaagtgggttgagcagatcaagaagctcatggacgccgtcgatgactacatcccgaccccggtccacgatctggacaagccgttcctgatgccgatcgaagatgtcttcaccatctccggccgtggcaccgtggtgaccggccgtgtcgagcgtggtaagcttccggtcaactccaacgtcgagatcgtcggcatccgtccgacccagaccaccaccgtcacctccatcgagaccttccacaagcagatggacgagtgcgaggctggcgacaacaccggtctgctgctccgcggcatcaaccgtgaccaggtcgagcgtggccaggttctggctgctccgggctccgtgaccccgcacaccaagttcgagggcgaagtctacgtgctgaccaaggacgaaggcggccgtcactcgccgttcttctccaactaccgtccgcagttctacttccgtaccaccgacgtcaccggcgtcatcaccctgccggaaggcgttgagatggtgcagccgggcgatcacgctaccttcggcgttgagctgatccagccgatcgctatggaagagggcctgaccttcgcagtgcgtgaaggcggccacaccgtcggctcgggccgtgtcaccaagatcatcgagtagtttctacccgacatcaagacacgcttgaactagcgttttaaagaaacctcccaaggatgcgaatccgagggaggtttctttatatatggaagggcaatgctccaaagtatgcacgccgtggcataataagcaaggctttttgtaagcttttccgtcagatgaagaaataggtgagttaatttggcacagactaccaatgacatcaagaacggttctgttctgaacctcgatggccagctgtggaccgtcatcaagttccagcacgtcaagccgggcaagggccccgccttcgtgcgcaccaccatcaagaacgtgctttccggcaagatcgtcgacaagaccttcaacgcgggcatgaagatggaattcgaaaccgtcgacaaccgcaacctccagtactcctatgaagacggcgacaacttcgtcttcatggacatgaccacctacgaccagatcttcattccgaagaccctggtcggcgaccaggccaagttcctgctcgaaggcaccgactgcgtcgtgtccttccacgacggcaccccgctgtccgtcgagctgccggcttccgtcgtcctgaccgtcacccacaccgagccgggcctgcagggcaaccgttccaacgccggcaccaagccggccaccgtcgaaaccggcgccgagatccaggtgccgctgttcatcggcgaaggcgagaaggtcaaggtgaacaccaccgacggctcctacctcggccgcgagaactgagagtaaggacagcgaagtttcatggcacgttccaccgctcgcaagagggctctgaacacgttgtatgaagcggatgagaagggacaggacatcctgtcccttcttgctgagcgcatcgagcagcccggcgctcagaccccgctgcccgactacgccatcgaaatcgtccgtggcgtggcggagcatatcgccgccatcgacgccatgcttgacgaacattccaccggttggaaggtcaagcgcatgggcgtcgtcgaccgcaatatcctgcgcatcgccgcatgggagatcatgttcaacgatgatgttcccaacatggtggccatcgatgaggcgttgagccttgccaaaacgctgtgcgacgacgattcgccggcgttcatccatggtctgctcagcgcggtgagcgccgatgcggaagccactgaagtggccgaacaaccgaccgaaccttcggctgaataaagccgaaagttaagcgattcggccgggtcgcgagtcctaaccggccgctatccttggtacgaataccttgactataagggggttttggtgaaccagtatgattccgaagccgtgatgtttgaccctcaggatgccgttcttgttctcgaagacggacaggtgtatgtgggcgagccatacggcgcgatcggcacgaccagcggggagatcgttttcgcgaccggcatgaccggctaccaggaaacgcttaccgatcccagctacgaccgtcagatcgtggtacagacgttcccgcacatcggggacacgggaatcaacggggaggatccggaatcctccagaatctgggtcgcaggctatgtggtgcgcgatcccagcccgaatgtgagcaactggcgcgccaccggcagccttgacgacgatctcgaatccaaccacatcgtcggcatcagccatatcgacacgcgcaagctggtacgccacctgcgttccgccggtgtgatgcgcgcggccatcttctcaggcgacgcgctgctcgacggtgacggcaaactgcgcaccatcgactccatgctcgacgaggtcaaggccactccgcagatgaagggcatgagcctctacgacgaggtcagcaccaaggaagcctataccatcgaaccctgcggcgaattcgaaggcaaggaaccgctgttcaccgtggcggccgtcgatctgggcatcaagtccatgaccccgcatcgcatggccgaacgcggctgccgcgtgcatgtggtgccgtccaccatcaccttcgacgagctccagtcccttaatcccgacggcgtctttttctccaacggtccgggcgacccggaacaggccgatcctgaagtgaatctgctgcgtcaggtgctcgacgccggatatccgttcttcggcatctgcttcggcaaccagctgctgggccgcgcgctcggcttcggcacgtacaagctcaaattcggccaccgcggcatcaaccagccggtcaaggatatgaccaccggcaaaatcgaaatcaccgcgcacaaccatggcttcgccgtggatgcgccaatcggcgaaaccgtcgacgcgccattcgagaacggcaaatacggcaaggtgttcgtcagccatatcgatttgaacgataacgtggtcgaaggcctgcagtgcgtcgatatcccggcgttctccgtgcaatatcacccggaagccgccgccggcccgcacgatgccgcatacctgttcgatcgtttcgttgatctcatgcgttccgtcaaggagggaacccgcaatgcctaagcgcacagacatcaagtccgtgatggtcatcggctccggtccgatcgtgatcggccaggccgcggaattcgattattcgggcacccaggcctgccgcgtgctgcgcgaagagggcattagggtcattctggtcaattccaacccggccaccatcatgaccgatccggaaatggccgacgccacctacatcgagccgatctccaccccgatcctcgagcagatcatcgccaaggaacgtcctgacgcgttgctgccgacgctgggcggacagaccgcgctgaacgcggccatggcgctgggcgaggcgggcgtgctcaagaagtacaacgtcgagctgatcggcgcgtcccttgacgccatcgatcgtggcgaggaccgcgaactcttcaagaaggtcgtggaggaggccggcgccgaatccgcccgctccgacatcgcgcattcccttgaggaagtcgacaagatcgccgagaagttcggctacccgctggtggtccgtccgagcttcaccatgggtggtctcggctccggcatcgcgcacgacgaagacgagctgcaccgcatcgccggcgccggcatccactattccccgaccgacgaggtgctgatcgaggaaggcatcgaaggctggaaggaatacgaactcgagctgatgcgcgacaagaaggacaatgtcgtggtcgtctgcccgatcgaaaacgtcgacccggtcggcgtgcacaccggcgactccatcaccgtggcaccggtcttcaccctgaccgaccgcgaataccagaagctgcgtgacatcggcatcgccatcatccgtggcgtgggcgtcgacaccggcggctgcaacatccagttcgccgtcaacccgggcaccggccgtatcatcgtcatcgagatgaacccgcgcgtgtcccgttcctccgcgttggcttccaaggccacaggcttcccgatcgccaagatcgccaccaagctggccctcggctacacgctggacgagatccagaacgacatcacccagtccacgccggccagcttcgagccgaccatcgactacgtggtcaccaaggtgccgcgtttcgcgttcgagaagttcccgggcgccgatccgacgctgaccacctccatgaagtccgtcggcgaggccatggctctcgcgggcaacttccaggagtcgcttggtaaggctatgcgctccatcgacaagcgtcacatgggcttcaactgggatggtgacaagccgtccgaggacgaggtttcccagctgctcgacgccatcaaggtgccgaccgagcaccgttatctgcagattcagcgtgccctgtggggaggcgccaccgaagagcagatcttcgcggccaccaagatcgacccgtggttcatccgccagttcgcgctcatcaacgagactgcgctggaagtcaagaacgcggagaagctcaccaggaagctgctgaagaaggcgaagctcgccggcctgtccgacctgcagatcgcgcacctgcgccgtctgggagacgagggtgagaacaccatccgtgagctgcgttggtcgtacgacctccgcccggtgttcaagaccgtcgacacttgcgccgccgaattcgacgcggcaaccccgtactactactcctgctacgcggatgagaccgagctgcgtcctcgcggccgcgaggccgtgatcatcctcggctccggtccgaaccgcatcggccagggcatcgagttcgactacacctgtgtgcacgccgtgcaggaactgggcaagaactatgacacgatcatggttaactgcaacccggagaccgtgtcgaccgattacgacatgtccgaccgcctgtatttcgagccgctcaccttcgaagacgtgctcgagatctacgaggccgaaaagaagatgggtccgatcaagggcgtcatcgtccagctcggcggccagaccccgctgtccctggccgcccgactgaaggccgcaggcgttccgattctcggcaccacgcctgaatccattgatctggccgaaaaccgtgagctcttcggcgaggtgctgaagaaggccgacatgaacgcgccgcgctacggcaccgcgctgagcctggacgaggcccgcgaggccgcgcacgccatcggatacccggtgctggtccgtccgagctacgtgctcggcggccgtggcatggaaattgtctacgacgacgcccaattgcgcaagtacgtcgatcgcgcattgaaggaagcccaggccgacaccgtcgtgtccggccgtctgccttcgccgctgctcatcgacaagttcctgcaggatgccgtggaaatcgacgtcgacgcgctgttcgacggcgaggagctgtatatcggcggcatcatggagcacgtcgaggaagctggcgtccattccggtgacgccgcctgcaccctgcctccgagcacgctgtccgatgaccagatccgtcgtctgcgtgaaggcacctacgccattgccaagggctgtggcgtgcagggcctgatcaacgtgcagtatgccttcatggccaacactctgtacgtcatcgaggccaatccgcgtgcctcccgtaccgtgccgttcgcttccaaggccaccggtgtggcactggccaaggccgccgcccgcatcatggtcggcgaaaccatccagcagcagcgtgacaacggcctgctcctgccccacggcgacggtggcgacatccatcgtggccagcaggtggccgtcaaggaatccgtgcttccgttcaagcgattccgcactccgctcggcaagaccgtcgacgtgctgctcggaccggaaatgcgttccaccggcgaggtcatgggcttcgaccgcgacttcccgcacgcgttcgccaagagccagctcgccgcatacgaaggcggcctgccgaccagcggcaacgtgttcatctccgtgaacgacaccgacaagcgccagctgccgctgttcgccgcgcgactggtcgagctcggcttcaacatctgggccaccgaaggcacggcatccgtgctgcgccgctacggcatcgattccaagatcgtcgacaagatcagcgtgcgtatggactccgatccagacgacccgatcaccacctaccatgcggagggcagcgtcggcaagaacgtcgtccagctgatcgaggaaggcgcgatcgacctgattctcaacacgccgaactcccgcggttcccgttccgacggctacgccatccgttcggcggctatcgcagccgacctgccgcagttcaccaccatgacggaattctccgccgtgttgatggctatcgaggcggtgcgcaataatgattatcagatcatgagtattcaggatcattccacgcagctgttcgaattggaaagccgtgactaatgatgagtagccccagcagtgaggaagtgaatgcccagcgttcggatttcggtctgcgactgagcaattcaatggccaaatacggcccgttgtgcgtcggcatcgacccgcatcggcagctcctcactgactggggctataacgtcgacgcgttgggtgcggaactgtattccatgcgtatgctgcaggcggccaatggccgtgccgcagctgtcaaattccagttctccatgttcgaacggtacggttccaaaggcatcgccgcgcttgaacgcgtgctctatgcggcacggcagatgggtgtcatcaccatcgtcgactgcctgcatggcggcctgccgaccacgatttccgcgttcgcggacgcctatttcaagccgggcgcgccattgctggcagacgccatcaccctgctgccgtattacggcgcacggtcattgggaggcgtcatcaatgacgcgctcaacaacggcaggggcgtgttcatcgcctcgttgacgtccaaccaggaaggcgccagcctgcagacggcgattcgtcaggcaggcgaatacaagggtaaaacagtggcgtacggcatcgccagcactgctcagaaattcaataagggcaatgatggaatgggttccgtcggccttatcatcggtgccaccatcgggcagtggatcaacgattcgggcgtcgatccggccaagttcaccggaccgattctttcccccggctacggatggcagggagcggagacacgtgatttgaagaccgtgttcaaaggcaccaagggcaatgtgctggtcacggtatctcgttccatcgccacgcatggtcccgacatcgcaaaattgaccgaagccaccgcgtcggtcgccagggatattcggcaggcattgaccgaggctcaaaacgagaacgccgatgatgcggctgacggagacgccgaataatttctttttctgaatagtttcctttttggaaaacaagacataaccaagagtggggatggaatggctgattctcaacatggacgtttgattgtgctctgcggacccgccggagtgggcaaaggcactgttctggggcgcgtacgcgaacagcaccccgaaatctggctgtcggtgtccgccacgacacgccagcctcgtccgggcgaagtggacggcgtgaactatttcttcatgaccgaacctgaattcctggccaaagaaaaggcgggggagtttctcgaaaccgccgacgtgttcggcctcgcccactacggcacacccgtgaaaccagtcgtggaacatctggaacgcaatatccccgtggtcttggaaatcgacctacaaggagcccggacggtcaaacggcgcgcgaaggaactcggcctcgaagtgcttaccgtgttcattgagccgccgtccttcgaagaactgaaacgtcgtctgatcggccgtggcaccgaaacccctcagcagcaggccaaaaggcttgagaccgccaaggtcgagttggccgctgcgccggaattcgacaaacgcatcgtcaataacgtggtcgacgaggccgcagacgagctttggcatatcatcgccgaagagttcggcctgtaatccgtcaatccgactatccagccaataaaaaccggcatacgaaaagggcctgcacgaaatcgcgcaggcccttttcgtatgtttgaatcaggcgagaccggacagcttgtcgatcagctccggatcacgggtcgctcccttgtcagcggagcgggcgaaggcggcgtaagccttcagagcctgagaaaccttgcgatcacgatgggcgacatagccatcgccggcctccagctcggcgcggcgctgagccagctcctcgtcggaaagctcgacgttcaccgtacggttcggaatgtcgatgttgatgatatcgccgttcttgatcagagcgatcgggcccttgttcgcggcctcaggcgcgatatggccgatggccagaccggaagaacctccggaatagcggccgtcggtgagcatggccacctgcttgccgatgcccttgcccttcacgaaggaggtcgggtacagcatctcctgcatgcccggaccgcccttcgggccttcgtaacggatgaccagagccatgcccggcttcaacgtgtcgttgaggatgacctcgatggcctgctcctgggattcgacgaccagcgccggtccgcggaacgtccagatctccttcggcacgcctgcggtcttcaccacgcagccgtcaggcgcgaggttgccgcgcagcacggccagaccgccttcggtgaccgccggatggtcgatatcgtggatggcgccgttgacacggtcacgatcgagcgaatcgaacagcgcggtgtgcgtccacggttcaggggagacgatgtggcccggagcggccagatacatctgcttggcttcctcggtgcaggtgtcgcgcatgatgtcccagtcgttaagcttgtcttcaaacgacttgtaatcaatggaatgcacgtcgcggtgcagcttgccggcacggtcaagctcgccgaggatgccggtgatgccgccggcgcggtgcacatcggaaatctcccattcgccggacggcgacgccttgcagatgcacggcacggtgtgggagatacgctcgatgtcatccagtgtgaagtccacgtcggcggactgcgccatggcgaggatatgcagcacggtgttggtggaaccgcccatggccacatccatggtcatggcgttctcgaaagccttcttggtggcgatggaacgcggcagcacggaatcgtcgtcatcgtcgtaatactgcttggcgatctttaccacctgctcggcggcgcgcttgaacaggtccttgcggtaggaatgggaggccagaatggtgccgttgcccggcagagccagaccgatggcctcggtcaggcagttcatggagttggcggtgaacatgccggcgcaggaaccgcaggtcgggcagacggtcttctcgtaggcgagcagatcctcttcgttcagattgtcatcggcggaggcgtacatcacgtcgatcagatcggtgttcttcttcacggtgccgtcgggcagcacggtggtgccggcctccatcgggccgccggaaacgaacacggtcggaatgttgagtcgcagcgcggccatcagcatacccggcacgaccttgtcgcagttcgggatgcagatcagcgcgtcggcgcagtgcgcgttcacctgatattccacggtatcggcgatgatgtcgcggctcggcagggaatacagcatgccggtgtggcccatggcgatgccgtcatcaacggccatcgtgttgaactcgcgcggaataccgccggcttccttgatggcatcggaaatcagacggcccactttgttcaggtgcacatgtcccggcaggaactcgtcgaaggaattggcgatggcgatgatcggcttgccgaaatccttgccatccacaccggcggcgcggtagagggcgcgagcgcccgcgaatactcgtccattcattagttttgcagatcgcatttccatgcctcctattgtgctggctaaacgggacacgtgttttgtcaagagtcactatgtggaaattttcggaaacccgtgtgattcccttacaggttggataactacgctggcggagaaggcctgtgggagaggcaaggttgaggtccagtggattgcctatactaatgattttggaaaagaagcttttggcttatctgatgatttggagataatcactatggcattcggcactgagccaaccccgaccggtcttgcggatccgccgatcgacgatttgatggagcatgcggactccaagtacgctctggccattttcgcggccaagcgtgcccgccagatcaattcctatttcacccagctcaatgagggtctgctgcagaacgtcggcccgctggtggaataccagaatcaggagaagccgctgtccatcgcgttccgcgagatcaacagtggtctgcttgaggaaaccctcggcgaggacgatctgaccgaaggcaactgatctacacggttcccatagagggactggcatcatttttcattcgccccgatacctgagcggtgcgctttgaatagtcaacaattaactattgattgcgtctgtgaaggacggggcgtttttcgtgggcgatcacaggatgcgaacggttgggtgttcgcgaaaggagcagccgtatggctgaattgaagttgatttccgccgagtcggtgacggagggccatccggataaggtctgcgaccagatttccgatgcgattctcgacgatatgctcgcgcaggatccgcattcccatgtcgccgtggagacctgcgccacggtcggacagttcttcgtgttcggtgaggtgaccagcgaaggctattccgacatccagaacatcgtgcgctccgtggtgcgcaatatcggctacaccagctcccgcgtgggacttgacgccgattcctgcggtgtgacggtgtcgcttaccgagcaaagtccggaaatcaaccagggcgttgcccggttgagtggtgaggaggagtcgaaggcgtcccgtgaacagcggtatgaggcgcaaggcgcgggcgaccaaggcgtgatgttcggctatgcgtgcgacgagaccgacgtgcttatgccgttgccgattcatctggcgcaccgtctggcgtatcgtctcgccgaagtgcgcaagagcggcgaggtgccgcatcttcgtccggatggcaagacgcaggtgaccatcgaatacgacgacgatgaccatcccgtgcgtctcgacaccgtgctggtctccacccagcacgacccggaagtggaccaggcatggcttaaggaacagctcaccgaacatgtgatccgtccggtgctggatgacgtgctcgccgaccgtgtggcccacgacgaataccgcgtgctggtgaatccgaccggctcgttcatcctcggcggtccggcagccgacgccggtctgaccggccgcaagatcatcgtcgacacctacggcggcgctgcccaccatggcggcggcgcgttctccggcaaggatccaagcaaggtggatcgttccgcggcctatgcggcacgctgggtggccaagaacatcgtggccgccggccttgcccacaaggtcgaggtgcaggtcgcctacgccatcggcgtggccgatccggtgtccatcaacgtggagacctacggcaccgagatcggtgtgacccgcgagcagatccagcaggcggtgcgcaaggtgttcgacctgcgtcccgccgccatcatcgacgagcttgacctgaagcgtccgatctactccaagaccgcggcctacggccatttcggtcgcgaggatgccgacttcacttgggaagccaccaacatggtcgacgaactcaaggaggccatcaaggcttgaaaacgcggccgacgtcctacgatgaaacaggcgtcggcgcatgcgttacccttgcattatgaccaatgaggatgccgagcagctggcgcttgacgggcttgccccgcgcaagcggcgcaaacgcgcgcccgccgtcaaaacgccagccgccgaacatcccatagcccaagtggtgctggacatccaggccacacatctgggacagaccttcgactatttcgtcgaggaaaaatactctgcggccgcccaacccggcgtgatggtgcgcgtccgcttcggcgggcagcgggtcaacggcatcatatggaaacgcgccgataccagcgccacacccgaatcatcgatacgttacatcgaacgtgtggtcaccgaccgtgtgctcgttcccgaatccatgcgcgacgatatgacgcgcatcgcggacgcgttcggcggcacgcgcgccaatatcctccgcctggcagtgccgacgcgcgtggcaaaagtcgaaagccagctgcgcgtcggcaatcgcgatgccgcaggaaccgcggcgggcaaacaacggctcgccgccgtcgaccaggagatatacggccagttgcaacgtcaatacggcaacatcaatctgctgcatgacgcgctgcaaggcagacgtttccaatcgttcgtcttcgacctgctacccggtgccgaccattggcggcgctgcgcggcatggatggtggccgcggcgctcgctcagaacaagccggcggtgctggtgctgccgaccatgcgggagatcgccgacatgactgagaccctacggtcggtcggcttgaaaccattcgctccgactggggccgcgaacggcgtctatgacggcgatttcgcggtgctcaacgcgcagatggcgccagccgaccgttaccgggcatatctcgcgatcagctgcggacaagtgcgttgcgtgctgggcacgcgcgccgccatgtacgcgccggtggaaggcaacgcgctgttcctcatccttgatgacgtgtgctaccaggacgccgacggcatgatgccgtacgccaacgcgcgcggtgtgcttcggctccgcgcgaaatcgcataacggcgtgttcgtcgcgatggccaatgcgcgcagcgcgcaaagccaatgggaaaccgacgcggcgcacgtcggagacacgcaggtgagcggcttcagcacgcccatacacgcgttgccggccgtgaccaaggaagcgtctccatggattcgctggctcaatcgcgacgagctggcacgactcgccgatccgaccatcggcgcacgcgtgccacacaccgcggtccggatactgtccaaagctttggaaaccggtccggtgctgctgtccataccgcaggacggcatcaccgaagcgttaagctgctcgaaatgccaccgccaagtgcgatgcgcgcgttgcacgggaccattggaacggttggcggacggaacgattcgatgccgctggtgcggcgctgccaccgtgcaatggtcatgcccgacatgccataacgagcgcatgcgcgtggtcagggtcggcgccgccggaaccgcgatggaactggccagactgttccgtggcgtgccgatggtgctgtccacgccaagccagccaagaggcgtcgtgtccgatatcggattcgctccgcaactggtcatcgccacgcccggcgcggagccgcgtgtgcgcggggagagtccggcacaatgcgaataccgtgccgtggccatcctcgacgcgtggaccagtttgtatgcgtccggcatcgacgccgatgtggacacgttgaccggatggatgcgcgcggtgtcgctgtgcgcgccgcggacccgtggaggacaggcgctgctgatcggggaaacagatcccgtgctcgcacgatcgttgatgctgtggaattcgccgatgcttgcccaagtcgaagtggaggaccgcgcccagaccgcgctgccgccggtattcgccgcggcctgcgtgtggggccgacgggatgcggttgggacgatgttgaaacgaatcggcgcgttggccggcggcgacatggccaccatcgacacgatcgccggtacgatgccgtccgtcttggggccggtgccgattccgcagccacgcaccatcgattcacgtgaattggaaggcaccgcggacagggtcaaagcagtcgtgcgcgtcccacagggcagacgtgccgaattggcgttgcggctgcgttcggcaagcgcccgccacgtggcttcacgcgaacctggggaactgcgattccagatggatccgaaggaacgcatctgacggacgtcccctcaacgtgaaacactggaacgactgatgacgttgacgttaagaatggagaaacgcatgaaaggctggccgggagagccgcaaatggaatatgacgtgcttatggccgacggcaacgccgctgcgaacgccggccggcagatcaccgacgtgatcttcgatttcggcaacgtgcttatctattgggatccggcggcggtgatgaccccacggtactcggacggactggtggaacagttcctcgacaatgacgtttccggcttctacgacatcaacaacgaactggacgccggcatgtccaatgacgatggcgtggctctgatgcgtgaacgccacggagaccagtgggccgatatgatgcggtactatctggacaatttcgtcgattcgctgaccggcgtggtgccaggcgcgcgcgtgctcatcaacgatctgaaagcagccggcgtccacgtatggggcttgagcaactggcagaaggacctgttcccggtggcgctcgaccattacgacattctgtgcagtcttgaggaccgcgtggtgtccggttacgtgggactgcgcaaaccgcaccgcgatatttacgattacgctctaaaacagttcggcatcgacgcttccggcgcgctgttcgtggatgacaaggcgatgaacatcgtcggcgcgaacgaagccggcattcgcggcgtacggttcaaggatgcccgcgcgttgcgcaccctgctgatcgacgcgggcgtggcgattcccgcggtacatgaaaaataacgacatacgcagattagacagacggttgtgcttgcggtcgctatgcgggatcgacgcatacggtcgcatgcattgatggatatgaaggtgaggagattcgtctcatgttgaaagtgctgttcgcaggtacgccggatgtggcggtgccgtcgttgaaactattggcccaggataccgagcatttcgaagtggtggccgtgctcaccaggccggacgcgccaaccggacgaggtcgcaaactggtggcgaatccagtcaagcaggccgcgctcgaactcggtctgccggtcatcgaatccgatccgagcgaggaaacgttcgtgtccgagcttgcggccaccggcgcacaggccgccgctgtggtggcgtacggcaagatcctgaaacaggacgtgctcgacgcgctgccgatgggctggtacaacctgcatttctccctgctgccccaatggcgtggcgccgctccggtgcaacgttccatctgggcgggggagaaggtgacgggcgccaccgtgttccgtatcgtccgtgccatggatgccggcccgattctggcgcaatccaccgtggaaatcggcgcgcacgaaaccgccggcgagcttctgagccgtcttgctgaagatggatcacgcctgcttgcggcatcgttgcaggccatggccaacgatcagatcgctccggtggagcagcctgccggcgcatatgaggtggctcagaagatcaccgttgaagacgcgcatatccgcttcgacgtgccggtattcgccgccgaccgccagattcgcgcatgcacgccgaatccgggagcctggtgcgaactgcatgcccatgcggacgccgaaccggcgaccctgcacgtattgcgcgcgcagccggccgacatgtccaatccgaacgcaccggcatcgcttgaacccggccatatcgtggccggcaagaagaacgtgtgggtcggcacctccaccgagccgctcgagctgctggaagttaaagcgcaaggcaagaaagccatgcgcgccgccgactgggcccgtggcgcccacctcgataacgccttctgtgagtaagatttttgtttctactgtaagtatgtgagtagctgcggcgtccgcgaccggcgggcggcatgcattgacgacacgctccgggccgctcaggccaagtctttacggtcttacaacgcatgccgcccaccggtcgctcgtaggtgcggaaaagttatttgagataatcgaggattttcgccagatcacgttcattgagccggtgcggagcatctttctgcactttcggtttggcgcagaacgccacgccaagaccggccgcatgaatcatcggcagatcgttcgcgccgtcgccaaccgcaacggtctgcgccatatcgatgcccatccgcgcggcccacgcgcgcaacgattccagcttcgtatccttcgtgacgatatcgcccagcacgtgtcccgtcagcctgccatcggcagcctccaaacggttcgcaatccaataatcgagatgcgcatcggccgcgagacggtccacaacctcgtgaaaaccaccggagaccacgccgaccttccaatcatgcgcgtgaagcgtgtcaatcagttcaagcgcgccatgcgtgaaatgcacgcgatggtagacctcatcgaaaatcgtggtcggcagacccttcaataacgccacgcgtgcgcgcagcgcctcgcggaaatcaagctcgccgttcatggctcgagcggtgacggacgctatctgctcgccgactcccgcggccacgccgagctcgtcgatgacctcttcgtcgatcaacgtggaatccacatccatcaccagcagtccgggagcggacagcgtgggcagggatgccatggatgcgatgttcggcgtttcttgttcaagcatggttccgattgtcggaaatcattaggacaatgggtattcttgagggttgaacgtgttggaaagcgaggtcgacatgaacgatcatgacgaagagacgctcgcgtcgctgcagcaggccaacgaccagctcatggccaagaaccatgcgctggtcaaggcgttgagccgcgccacgcaggaaatgacgaaaaccaaggcccaattgaaccagctggcggggcctcccatgactttcgccaccatggtccgcgtgcattcagccaaaacggacgggcagggcgtgcagcatgccagcgccgaagtggctgccggcgcgagacgcatgatcgtgccgatcgcggcgaatctgcaagcttccaggctcgaaccgggacgtaccgtgctgctcaacgagaacatggtggtggtctcacagctcgacaccgacacgctgggcgcggtgcgctcggtacggcaggtgtgcgatgacggccgcctgctggtcgcggatggcggcggcaacgtgacgttggtccgatgctcgggaacgcttgccaaacaggccatcagcgcgggcgatcgcgtgaacgtcgacgcatctctgcggttcgcgctttcgttggttccccccgaaaacgacgacgatttggttctggaagaagtgccggacgtcaccttcgccgacatcggcggactggacgagcagatagaacgtatccgcgacgccgtgcagatgccgttccagcatcgcgaactgttcgaacgctacgacctgaaaccgccgaaaggcgtgctgctgtacggtcctccaggcaacggcaagacactgatcgccaaagccgtggcgaacgcgctcgccgaaggcaccgacgcgggaagtggcgtgttcctgtcggtcaaaggaccggagctgcttaacaaattcgtgggcgaatcggaacgtctgatccgcatgatcttcaaacgcgcccgcgaacgagcggccgacggcaaaccggtcatcgtgttcatcgatgagatggattcgctgctgcgcacccgcggcacgggcgtttcgtccgacgtggagaccaccatcgtgccgcagttcctgaccgagctggacggtgtggaatcgctggacaacgtcatggtgatcggagcctccaaccgcatcgacatgatcgatccggcggtgttgcgccccggacgcctcgacgtgaagatccgcgtggaccgtccgggcatccagcaggcgacccagatcgtccgccactatctgacagacaagctgccgttgtctccgaacgtggatgcgaaggcgttgatcggcgtgctggtcaacgacatctacgcgcaggacgagcatcggcacctttgcgacatctgcgacgaccatggccagtggcgtccggtgtacctcgccgacgtggtgtccggcgcggtgctcaagaacatcgtggaccgtgccaaaacctatgcggtgaaactgtccatcaccaccggacaggctgcggcgatcggcatcaatctgctggccaaagccgtggacgaagaatacggtgagacccgggacgcgctgctggatgcggatccggaacagtggagccgcatcaacgggcttgaacccggacgggtgaccggcatcagaccggtggcatgaatgccggccggcgtatgaatgctggacggtatggtatggaacgcaatctaaatacggaaaggaacggcgcgatgagcgttcgcagggtcatgggcacggaaacggaatacgcggtctccgcgccaggacaaggccgctacaatccggtgcagctctcattcgacgtggttggcgccgcctcggatgcgtcacgcagccatatccgctgggactaccggcaggaagaccccgtcaacgacgcgcgcggcaccagactggaacgtgcggcggcccacccggacctgctcaccgacgccccacagctcaacatcaccaacgtgatcgcccctaacgggggtcgtatctacgtcgaccacgcgcatcccgaatactccgcgccggaaacaaccgaccccttcgaagcggtgcgatacgaccgtgccggcgatctcatcatgcgcgccgccgcagccaaggcaagcgagacgacgggacggaaaatcgtgctgcaccgcaacaacgtcgacggcaaaggagccagctggggcacgcacgaaaactacatgatgctgcggtcggtaccgttcgacctggtgacacgcctcatgaccacgcacttcgtctcccgacagatcttcatcggctccggccgcgtcggcatcggcgaacatagcgaaaacgccggctaccagctaagccaacgtgccgactacttccatatgaaagtcggtttgcagaccacattcgaccggccgatcatcaacaccagagacgaatcgcacagcaccgacgaataccgcagactgcacgtgatcgtcggcgacgccaaccgcatggacgtgccacaggccttgaaactcggcaccaccagcatgctgctgtggctgctcgaacacgccgacatggccgaaatcgacttgaacgaggcgctggaaccgcttacgttcgccgacccggtggaagccatgcacacggtatcgcacgacctgaccctggccgccccactaccattggaaacaggtggaaccaccaccgcatggcagatgcaggtcactttgcgtggactggtatatgcggccgcggcaacggtatacggcaccgacacatccggagagccggcatggcccgaccgctccacccgcaacatcatggcgatgtgggggcaggctctcgccgacgtcgccaccgtacgccatgccgacgatgacggacgactgacgatgcgggaacaggcgtcacgtctcgaatggctgctcaaatggcagttgctggagaaactacgccgcaagaccggttcggattggaccgatcggcgcctggctgcggtcgatctgaaatgggccgcgctcgatccggccgattcgattttcacccggcttgccggacagaccgaacgactggtgacggataagcagcttgccgaggcggtcggccaagcgccggccgacacacgcgcatggctgcgcgcggagatcatacgacgtttccccgaacaggtcgttgcggcgtcgtggtcccaccttacggtgcgcggcgagtcgtccggtgatgaaaacgtggagaattcgatggtctcgttggacatgtccaatccgttgaaattcacggaatccttgtgttccgaagcgttcgagcatgtccacactgcgagcggaatcgtggaatccctgcgttgaatctcatgttgtgcgggtaccattgccgtaggtgatggcagaggccatacccatagtcgatgaaccacacggcaggacgcttgagggagaggatgcgtccaagccggttatgaggaaacgaaaaggcatactacatggaattgaggcaagtggccctcgaagtggcccgtatcctgcaggatgcaggcaagcacgcgttgaacgatcaaatgaatccgcgtgatctgaaaagttttgaaataacggacaatcatctgagcttcacctccgacatcgataagcggttggcgcaattcatcagcaaccgcatcacgtatgtggatgtgttcgatggtttctggcagttccgtccggaagaatgccatccgggggaacggtattggtgcgttggcggcatcgacggcgcgatcaatttcgtgcgcagcatgccggaatggaccatcaccgtctcactgttcgagttcaacgaccaatgctccgcgcagccgatcctttcggtggtgcatgctccggcgcttggcctgacctacctggcggtgcgcggatccggagccatccgcatccgcaagacgccgcttggagacaaacgcgagaagatcatgccgtccaccaccccgtcccttgactatgcggtggtgagcttcggcatgtcccatgtgccggaggaatccaagcgcgcgcttgaagtggtgtcgcgtatctccggccgtccggccgacatcaagcgcgttggcccctcctccttggatttgtgcaaggtggcggacggtacatatgacgcgtatttcgaagcgcatctgcacaagtgggacgttcccgcggtttccgccggagccgtcgtggtctgggaagcgcaggggcatctgagccggtggaacggcgatcttgtccactggcgtcaggaaaacgacgtactcgccaccaacggtctgattaccgatgatctgcgccagtatttggcataagactgattgactgccccacacctgggttaaggtgtggggcagtatgctattcgcaggagaacccgcaaagacgctttcggagaaaggaagagccatgccccagaaatttgagcagatgcaatccgccgaacaaaaacatgacgaggatgagaccattgcgcaggctggcacccagatcgatgacacggtcgatgcgcttgacgcggtgctggacgacatcgaatcggtcctcgaatccaacgccgaggaatatgtgggcagcttcgtccaaaaaggcggcgagtgatgccgcagctgcgtgacagcggcaaccattccacagcgccgcttgacgcccataccaaggacgaaatccaatccttcgcccgtattttcggcatcgaaaccgaatacggtgtgagcgtgaccggttcggaccgcccatgcgacgccggacagacggcgatgatgatgttccagccgattgtggccgaagcgagatccaccaacacatatattgaaaacggttcaagactctaccttgatgtcggctcgcaccccgagtacgccacggcggaagcccgggatccgatggacgcgctggcattggatgcggccggcgaattggtgatgagggatcttgccctggacgcccaacgtcgtctgcgctccatccagggagccggctccacggtccatgtgttcaaaaacaatgtggattccgccgggcattccttcggctgccatgagaattacctggtgcgacggttcgtgccgttgaagacgatcgaacaggagctgctgccgttcctgatcacccggcagctgttcaccggcgcaggacgtatgggggagcagggcttccagatcacgcagcgtgccgatttcctcgatgaggcggtctcatcggccaccacgcgctcgcgtccgatggtcaacacgcgcgacgaaccgcatgccgatcctgacgcgttcagacggctgcatgtgatcatcggcgattcgaaccggtcccagtgggccacgatgatgaagctcgccaccacgcatctggtgttgtgcgtcatcgaacaggccgggcgcgaaggcaaggattccgggttcgcccgattctccttcgctgacgccagtgcggccaaccataaggtaagccgtgacctgacgggcgtcgaagcgtccttcgacatggcagacggcactgtcatggaaggcggtgccgtagcgattcaggaacgttatcttgaaatcgtcgaacgattcgttggacaacatcccgaagtgtgctcctcgttgccgcgcacggacgtgcatgaggtgattcgccaatggaggcgtgtcatagaggcgttccgctcgggggctagcgaaacgttcgccgacaaggtcgattggcttgccaaacgacggctgttcgacatgctccgcaaccgtgcggggagccgactctccgtcagcaagttggaacagttggacatggactaccatgacgtggccaacggcgcgctgtacgcctcgctgtgccgtcgcggagccatgcgcacgttggtcaacgagtcacaagcacatgaggccatcgatgttcctccccacgatacccgcgccgcactgcgtggacggttcatccagtcggcacgatcgcacaacgcgcaatattcctgtgattggacgcgactatcgctgacctcgccgaacaggatggacgtgacgttgcttgatccgttcgacgcacaaccgtccgaccggttcctcgcgatactagaggctttgcagtagccaaaagcctgcgatggaagactcgtctccaccgcaggcttttgatattggttggtcggattgtaactgccgctcagacttctccacggtatttggccatcatctgcgactggagttgttgcgcgcttggcggcgtccatgtgatcgcgtcggcgcccgcatcaatggtggcgagaatacggtcttcacgacctccgcccgaagccagaatcgggatttccggatgatgcgcgcggatgcttgccacgacttgcgcggttcttgcaccggctgccacattgatgatggccgcaccggcaagaatcttgcattcggtgatttcatcatcctccgtgaccgtggcgatgacggggatgtccaccatcgacatggtcgtttcgatggtttccgccggtgccggcgcgttgatgactacgccggccgcgccctgcatctccgccaccatggccagctctgccacacgcggaccggtggtggtgcctccacccacgccgacgaacagcggcatctgcgccacggtgagcagcgcctgcgtgatcaccggttcgccggtgaaagggtacaccgcgaggatggcgttcgcgttcgtgttgcggataatgaccgcatcggtggtataggcgaacgatttgagcgtatgacctttgacggtgatgccgccgcaacgctgcgtgatgatttccggaaccctggcgttgggggaggtgagtctgccttcgaccttcgccgtaccgtaggtgcttcgcgacacgtgcggcacggctgaatgctgctccacagccactgacgcgctgggggtgaatagcgaacgcttgttgagacggatgagatccggatcgtccgcaccggaatcatgttcctgcccgacgctcattcccgcacctcctcatccgtatggttcagcatgaggaattcgtggatcgccttgcggcgttcggaaatctcctcatccagaagtttggtatcggtgttgtcgatgatacgctgcagcagttcgccgagagtggaaagttcctcgtcgttcaggcagtcgagcatatgaacgtcggcttcgatgggtttggacggcttgggccgtggaaccgttccccgtcttgccgcgtcgacgttccgcacgtgtgtggtggcgcgagccacggtccgggcacgtgtcgttttgagcttggtgtggatgagcaggatgttgagtttgtggatttcgtcgatgatctgtctgcgttggtcgaccatgacatcccccttcatctagtcatattgtctagtatcatagcgcatagtgtgggatgacattgcctttgcctgttataaaaagaaaaaagagaggttccaaccatccgtggttgaaacctcttatataggtctgcgtggtcgacttacttggcgacggccttcttcagcagggagccggcagagatgcgaacgccgtaggttgccggaatctcgatggtttcgccggtgcgcgggttgcggccggtgcgggctgcgcgcttgacgcgctcggcggagaacaggccggtcagcttcaggccttcgccggactgcattgcctcgacgaacacgtcctggaaagcgttcaccgcagcctcagcctgagccttggtcaggttggacttctgggcgatcttcgagacgagatcagacttgttgtatgccataaagcatccttcttgagtcaggggatattccgcttatgaacatccacgttcattgcaataatagcgcacgcatgtgccaaaaatgccattttccaagggttttggcccttttgattcagcatagggggagaaaaaaccctaacggggggttgggctagatcaaattatgcctgtccagccatttcatagccacggctcccattggaattctcagccaatagaaggcgattcggtagacgagagtagcggagacggcgatggtggaggggatgcccacggcggtgaaggccacggacaacgcggcttcgaccgcgccaaggccgcctggtgtcggcactgcggaaccgagcgtattcgccagcaggaagatgaatgtggtctccaccggattggtgtggcatccgaaagccatcaatgcaatccagaatcccaatccggtcgaaatgttgagcaccaatgcgccgaggatgccgaaggccagctccttcgggtgggacaacacgttgacgagactgcgtgcgtaggacttgacgatgggcaggtacttctccgtgacgatgtgccgcaccgggggaatggccatggccgcggaaatcaccaatgcgacgatggtgatcaccaaaatcagcgtgttggtgggaatcatgccggacagtgtgttgcgtccggtgaagatgccgatcagcagcagcagaatgatggtggtgccgccctgcaccgcccatacggcgctcatgatggcggtggccgcggtattgcggtagccgctcttgcgcaggaactgcaggttgacaaaggccgggccgacgccggcgggcatggagaccgcggtgaagcccgaagccatttgggaacagtacaagccgatcggattgcgtttatcggcatccatgaaacagccaagggtcatggccgatccgaaccaagccagcagtccgaacagcacgcataccagagccatggcgatgttggcctctttgaccgccttgatcatttcggccggttgaatctgggtgaacaccacatacacggcgacgaccagcagcgcgatcgcgatgaaggaacggaaactgaaccgcgacagcgtaaccgtttccatggaatccgcgacctcctgcggagccaaagccgcgatacgggaacgcagcgtgttgagcatgtgcttgtcgcaggcgggcagggcgcgtatcgccgccggaaccgccgccttctggatgaatggcgccaggtcgatcagttgctcgtcgccccacgtcctgcgggcgcatgcgatcgcacggtcgatgccgttcagcgcgccgagcagaaccagcagctgtactttgtccagcgcatagtttggcggcgcgctgccatagtcgccattctgccatcctgcgatcaccggctgtccgttttccatgcgcgacaacgtttcgggagtgattcgacgatgggtgaagccgtgccggtgcgcttcggacagataggtcatgaacaattccatgtcatggtcggacatggtgttcggattgcattccaagggcatgtggtcgcggtgaaacaccagaatggacgattcgctgctgtctgcgactccgtagactcccggcaccgtcaatccggcgttctgtaggccgagaatcatcgcgtaatggtggtggatggcgtcgaaggaggaacggtcacggcgcatggagaccccggtcagcctgacccattgccatagctggttgagatagcctgccatatgcacttggttatcgagaacggataccgtgtattggtggccgtcgacgtcgatggcgtcgtagatgcgtgagttctcggtcagatcatcgtccaatgtggtcttcagcatgccggaatcggtgtaggtcgcgagcctgcgggagagcgacgccacgtcgatgccgatggaacggagcgcctgcgccacctggttgccccaagctccgttggtctgtgtgccgagcatgaaacggatcagcatgcccaaggcacgtcccgcggcaaaggagaccagcacgccggaaagcgaattccatgacagcaccacgaacagcacggcgaccgtgtagaggatgttccagccccatttggtgccggaacgggtgcgacgcggtccggcgacggtaaggaatgaggccatcgccgcataaaaatcgggaagcagtccggttcccacggaagtgccgttggacatcatggacatgatgagggtgtcattgcccgagccgctgataagagcggatatgccccatatcgcagcgaaaccgagaataagggcgatggcggaaaccacactttgcagccattccttggcgatgagcagctggataagcacgctgacggtaatgaaaactatggcgatctgctgcaacagcgatgtcggcacatccatgagccaactgaccacgtggcccgcggaacgcacgtcggactccactccggaggtggtgccatgcaagtagatggagaacaggatgacggccgcgctgacaagcacggcgaacagcgcatggagcagatccgcgaaatcgcggttccgtttcggcggaacatcctcaatgcgcgtttcgtgtttgctggttgggaagtcgtgagacactattgacctgctttataggtacgtgggtgaatacgtccgggtgacatgcacctattatcgtctccgatgatacgccttggggcggctgtgtgaaaacacagccgccccaaggcgtatcatccgcaagatgagtgtggcgatgcgttgtcagcggtcgaagtcaaccagcttgctggcaactccggtgtatgtcgccggagtcaacgccttgagacgcgccgcagtggcttcgtcgaaggcctgctggtcgatgaaccgttcgacgtcatccttggagatctcgtgaccgcgcatgagctccttgaccttctcgtacggcttatccatacccggcagtcctgcaagctcgcaggcgcgcatggcggtctggatcggctcgccgagcacctcccaattggaatcgagctcggcctggatggcaacatcgttcggatggatggagttcagaccacccatcagattgttcaacgccagcagcgaatagcccagcgcggagccgatgttgcgctgcgtggtggagtcggtcagatcgcgctgccaacgcgattcgaccagcgtcgccgacaaagtgtccaatagcgagcaggagatctccagattggcttcggcgttctcgaaacgaatcggattgaccttgtgcggcatggtggaggaaccggtcgcgcccttgaccggtacctgcgcgaacacgccacgggagatgtacatccacacgtccacacacaggttgtgcaggatacggttggtgtggctgatggtaccgtacagttcagcctgccaatcatgcgattcgatctgcgtggtcaacggattccacgtcagacccatacggttggtgacgaactcgcgggagacggccacccagtcaacatcagggcaggcggccagatgcgcaccgaacgtgccggtcgcgccattgatcttaccgagatattcctgggccttgaccttgttgagctgacggttcagacgatacacataaacagccagttccttgcccagcgtggtcggcgtggcaggctgtccatgggtcagcgacagcatggccttgtcgcggtaggcgtcggccttctgtgccagatggtcgacaatggcctgggctgcgggcagccacacctgctccacaccgttcttcacgcaacgggcgatggacaggttgttgatatcctcggacgtgcaggcaaaatgcacgagagtcttcaatccggtcagctgggtgtcatgacccaacacatcggcggccttctccagctggtcgtcgatgtaatactccacggccttcacatcatggtgggtcttagcctcataagcggcatgctgggcaatgccttcggctccgaaattctccggaatggaacgcagatacgcctgctcatcatcggtgagcggcttgacacccggaacgatggtctgattgccgttgccctcgaaaccgttggcaagcagaatcatccactcgacttcgacgcgcatgcgctcgcggttcaacgccggttcgctcatgtattcgacaaggggagcggtctgcttgtggtagcggccgtcaagaggggtcagtgcgattgcgggggagatgtcagtaagcttcatagacaacagcatacgttcagccgtgaaccattggtcccgtcatttgctgatgcgtccctcataatactggacctcctccagctcgccttccacgacctcttggaaatgacggtcatggtccagcacggatttgtttccggtgtcgtaggcgtaccggtatcccgcttcatggtatttcgggtagtgcgtggagttcttctccccagacgaatcactgacttcggctcctggaaaagccctcttcggcgcatcctcctcatggacggagcatcgtatggtgagccagttctccgtatgggggttggcctccccgtcaagtgccgcgatgccttcatcatccatctcgatggcggtgacccgtgttttctcgggaatctcgaaattcgctatcggggagccaagcgtggcgatatgttgtatgtcgtatttgtcttggaaatccgtcgccgccgctgccgcgatgatgccgccctgcgaatggccgacgatttccacgggatcatccggctggatgccggcctgtttcatggtctcatccaggaaacggaggctttccgcggttccgcgctgccgctcatcggcactcatcagctcgaaattggtgtaccagtccataggcgaatcgtgattgccgtcggtcccgggaatgatgatcctccaagcatatgtgccatcggctttgcggtacttgcagcatgcgatggttccgtattccagaccgctttcacgttcgccgttgagaggtccttcggacagccgccgttggtcggcgatggcgtccttcgtgcttgtaccgcctctgaccactttggttttcggatacacacgggttacggagagattgtctccatggtctttgtcgaagtacggtatgagcagtctgtcgattttcttaagaccgcgattgaccgagcctttgccggaaagcccctctgctatagccgctcccggtttggtgaccatgaataaggttttcgtgatgtattccaggatggacgtgtcttttgaaggccgttcctgtatgttcaatcggctcgcatgctctccgaggacgctcacgaagctttcctgcatccatgcggtggattccacaagatagaatttgttgaatttcccctctttggcgtaactgcgtcttacccccatcagtgcgctggcggtcaaggcgagaatcgcggattcccgtgatgacatgaaaagccctcgcaacatgatattcagccctttcctgctggcttcctcagcttgggcgtataaggattgggcttgtgcgatcaatgaggatagctcattaagctgggatgccatggattgcagggcctcggcatgcgcttcgcaacgtccgagcagctgccggtacggcaattcgatatggtcctgcgccgtacaccgtggacttgcctcggtcaaagcggacaggagcggtgtggcgcgagggtggattttgagttcatagcctgcggcaatgaaggatctacgggaagtgccaagacgattcgcttggtctctgaggattcttgaagcattgaagtattcccggtattcggcggtggtgaatctctttccgccaacgatgcgggccgtcactcgttggttcatgccgcacctgccgaccagagaagacgtgacgtggcgatcatatcatcacgtagcagagcggattgccgtgcgatgcgatcgagacgggtgcggtattcctcggccgcggtgccggtccagtcggccagtctgttggaggctattgccgcatcaagtccatcgagaagccgtgacgcggtaacaagtttcgcattgatcaatgtttgggtggtccgcacgccaattcggcaacgacaggacattcccgacagggatgccaacgaattgaaggctgcgacgcctggggcggcaccaagaaaagcatttgaaacgttcatggcagccatttgaccacattcggcgttgacgccaatcggaaaacagagcttgtggtcaaagaacgagtctatgaaaaaccgtcggcgtgtcgttattggaaaaacaacgaaaaccacgtcgacggcatgtggataactatattcgaaaaagccccctaccagggtttggtctgcgaggatgacgtgcttgggttctttttcgcagccgaacctgaatcgtcattgggatccgattgcgtggattgggcgttctgagccaatagctcctctattttccgacgttgttcgtcggataggttttcgtcgttcttgtgacttgatttacccgattcctgagcgtcggcggtgtttgaatccgtggaagcggactgatcgctctgctcggctttgatcttcttggacgcgtgatccgtaagctggctggaaacatgactgttatgctcgattgattcgcgcacttggggcagcagcagcggcttcatggctgatgcctcgttgaattgggcgtccgtctgctgttgcctggtgtgcagcttgtcccaatcggcatcgtcttttctgctggtcgagatgttctcctgcaggctttgcgtggcctggttgtagctattgacggctgcgagattcactatggcccatagggcggccatgaccagcaacgccgccatgacggccaaaacgatgcgaaccgtcagcgaggcacgcggtttcatggttgttctggtcatagcaaactcctcgactgaattatccaagcccccaattcgcatgcgagcagcagcagcgtgacgatggccagtggccatacgacgggcatcgtcctggtgcgcttcttggtggtttgggtgactcgccacttatcggacgcttccttggacacgccgtcacgcatggtgttggaggcgttcaacaccagcgcggtaccgctcaactcgtcggcgatggacgccatctcatccttgttcatgcgtgacactccgggtttgccggtatcagggtcggtgacccactggtccgcatttccatcgacgccgtcggcgattacgggaatgttgcctccctgctcgctgccgatggctacggtgaaggcatcggataggtatcgtcgcaatgatgagaacgtgcgccgtgcctttgacgaggtctgttctccatcggaaaacaggtacagcacgatcgcatcatcgggatgctgatcatgaatggacttgcaggtcagcagcagctggtcgataggggcatccaacgtcgaaccggccgaaacggaagtcgcctcgggcgcgagtgtatccgcccaattgtcgatcgcgttcgaatccggggtcaacggcacgtccaacgtgccggaagctccgaatcgcaaagcggcgaaactggaattgggatatagcgcggtgacgtccttcacggcttgttttgccacgtcgagacggcttgactgttcggctgaaccatattgcgcgtctttgacggccatggaaccggtcacgtcaacggccaccaccacgtcggtggcgttcaccgcacggctattggtctgcgccacgatactgggcgtcaatgccatgaccgacaccgtcagacaaagcaatacgcgccgaacgcatgcccaaacggtttcgtcgctgtcagcgcggcgacgaacatgcaatacgatctgcgcaatggcgcaggccagcagaaccacggcgacggctccgccgacaggccaacccaaagcaggggaaagcgtcagatggttcatctcctcaacctccaagccaatgccagccagaccatcaaaacgatggccaaggccagtgtccaccatccgggagcatccaccatggcggccttgttgctcgactcgttttcatggttccgccgagattcgatttccttgaccagcgaagagacggatgctccattcgattgggtgagaaacaccccatgatgagcttcgatggcggatttgaattcctgggtggtctcgtcggcctcgctctgcttcggtccggaaaacaatccatccacggtgatttgggcctgcttggtcaggttcagcgcctcgtcaagcgtataggttggttttccggaaacgacgttgtccgtggcaagcacgatggatgcggcgcgctgacgctcggcattgtcggcgcttgcgttcccataggcgaatccgggaagcatggccgcgcagctcaccacgccatcgccaatcagcgaagtggactccttacggttctgcgtgccttccagccagtcggaaatcgcctgataatcgctgtccttcatcttgtcgatatcgtcttgggactcgacgcctgcgaggatgctgctggttttgtcaagctgtttggacaccagttcgtagtcgtcggtcaacggaaaaacggtacgtgacgtcgaattgaagatgctcaggccgattctctcgcccttgaagctgtcgacgagttgacggtaggtgtcgatgacctcgcggtcgtaggggagcgccgagccggaaacatccaagcacagcacgatgtctcggctgctggccttctcctcgccttcatccacggtgctgggacgtgccaccagagccgtggcgagtgccaacgcgaccactagaagaatcaccgccaaacgtgaaagaaccctccactggcggaataatctcgatgcggattccgtgttgaggtcatcatccaggctgaaggtgcgggcactctcgatgtcatcggttttgtggcgcgcggccaccagcaacgtgacgccggcaacggccagcaccacgatgacgcctgccagaaagacccaaggccaatgccatgacagttgcatctatcgccacctttccacaagattggccacccattcgccagcctgctcgaccgtggcctgcctggcgatgtgattgcgctcggcatccgcgaattccggcggatacaatgcctcgatggtttgcctgagcaaggtgagaccctgctggttccccgtggtccgaggcgtctcttcgatgtcggtgagcgtctggttgcgcacgtccgttccggtggcagtggaagcaaaatccctggcgattgcggccagctgtgcgaaagcctcctcgcgctccagctccccctgggcatggcgggacacaacatcatcgatacgctgatgccagacggttttgccggcaagcgcgtcatgtcggccgcgattgactatttttgcgggcttccggctcggccgggcaagccagaccacaagagccaccaaaacgacggcaagcaacagacagaccgcgatgacgacggccaaaccgttctcaagatgaatctggtccttgatgacgaggtcatcctcggcaaggaagagcatcatgccttgtctcccaacgacaatacggacggggctctcaattggttacgtgtggactgggccaaagccgtggaaaccatgcgcacgaactcatggaacatgcgttcgctggaatcggatcggattaccgtcgagccacagcgattcagctcatggcgaatggacgcagccaggtattcgcgatgcgttcgcacttgcccagctgtgtttcccctacgcaggaacgcaggcacgcgtcgttttccagccccgtcaagcaccacgcgcgcatggctgacatcaaacggattgatggtggccacatcgatgagcaccatcggatgtgtccttgcaatcgtgcggatggcgctcaaatgccgttcctccaacgcatgctcctcggtggcgatgacgaccagcgcctctttgtcccgaatgcggcgcgcgtattccagcaacgcgtcgatattgcggggcctggtccactcgcgctgcaatgccgtatccaaggttcgttcgaactgcgccaggccaccgttgaacggcacccgggtgatggaagcgctgtcgccgaacaccatggacacttcgtcgcctcggcgcaggctgagcgcggcgaacatgcataaggcatttgccgccacctggtacgcctgttccgaggaagggcatgtggcggtcatttcctgtccgacgtcaagcagcaaccatgccttcgaagtggagggacgctcacgctgcaccaccattggacgtcccgctcgggcactggtcttccaatcgatgcgtttcgcctcgtctcccggctcataggcgtggatatccacgacatcgtcggcgccgaagcgtttgttcgatgcgtgcgcgccttcgagtatgccgagagccttgcgtaccgtcggcagactcagcgtggttccaagcgtctcgatttttctgcggatcggatcgtcggaacggatctggtcgatcatggaacggggaccgcctgcacgatcgaatccaccacctggtcgctggtgacgccatcggcaagtgcttcgaacgtcatcagaatacgatggcgcaacacttcgtgggcgaacgtcttcacatcctcaggaatgacgtaatctcgtccctgcaggagcgcgttggcctgtcctatgcgcaccagcgcgatggacgcgcgcggcgaggcgcccagcctgacgagcgaggaaagtccttggacgggcttggttccagcgccacgggaggtggccgcgatatcgaccgcatactgcatgatcgcatcggacacgtgcacacgacgtgccgcggaacgcaggaattcgacgtcgctgatggaaacggtgtcaccggtgagcgcgtgctggtctacggtatcggagccgcggcgggtcagcatggcgagcatgcgttgctcttcctgcgctgtcggataggtcagtacggccttcatcatgaaacggtccatctgcgcctcgggaagattgaaggtgccctcttcctcgattggattctgcgttgcgatgaccatgaatggtttcggcagcgcgatgcgttggcctccgatggtggtcgcgccctccgccatggcttcaagcatggcggactgggtcttcgcgttggaacgattgatttcgtcgagcagcacgaaattggcgtggatcgggccgatctgcgtggagaatttctgcgtggcgaaatcgaagacctgagtgccgaccaggtccgaaggcatcagatcgggagtgcattgcacacgtttgaacgagccggacaccgaagtggccaaggtctgcgcggcagtggtttttgccagacccgggacggattcgatgaggatatgaccgccggccaccaaagtggtgatcagcgattcacgaagattgtcctgtccgaccagggtctgcgcgaaacgtccgcgaatctgcgaaccgatgttcctggcgcgtgcgatgtcttcggccgacagcgtggttggtcttgcggctgcgggcatggggatgggtgccggtgctggcgccggattctttggagggaataaagccatggttgctactctaacgggtcaagctgacgggagggtccaatccaccggctgttctcctgcttcgattagcgcctgattggcgcgggagaacggtttcgagccgaaaaatccgtagcgggcggacatcggacttggatggggggatttgatgatgaaagcgttggtgagcaggggctccaacgtctgcgcctttcgtccccacagaatcgcgaccagaggcttgacgctgccgtcaggccggcggcgattgttcaatgcgctgatggccgcgtcggtgaccacttcccagcctcgcccctgatggcttcccggctttcccggttcgacggtcaggcatctgttgagcagcatgacgccctgcttggtccagggtgtcaggtcgccgttggccggcatgggcacgcccagatcgtcggtcagctcggtgtagatgttcgccagactgcgcggaatgggcttgacgtccggtgccacgcagaagctcagtcccaccggatggcccggcgtggggtagggatcctggccgacgataagcactttgatgtcgtcgaatggaatggtaaacgcgcgcagaatgttcctgctggccggaaggtacttacgtcccgccgcgatttccgacctcagaaagtctcccatgagatgtatctggggttcgacatcggcgagggcctgggcccatccgggctccacaagatccttcaatggtttgatatgagtcatactttcccactgtacgacgtgccctgtggatgtccatgccgattccatgcggaaacgtgtcgaatacgcgcaaaatcgacgatgctgattgtgggctgactgcacgggccggtacactggggcggtaagtgtgagaaatgaggttgcagaaaatggctaagcaggacaaggagacctacgaatcctacgccaaggatatgttcgacaatcctccggcgggaccgatgggcgtgcaccgtggcgcacgttccatggcgtccagggctctgccgtatgtgattgtcgtgattgtggctctgctcgccggcttgctgttctggggagtctattctggtgagatcagcaacctgagaatgccttggtcggccaaggaggactcttcatcgtccgtctccacggcggataaggcggataagaagacggacgacacgtccaaagacgccaagacggagaacaagaagtccgaggacggcaagaagaccagtacttcggatggccagtcgaaggacgcttcggacgccaaccagaacgcggaacagaataacgatcagaacaatggccaggatgcggcttctgagcagagcgtgaatctggccaccgagatccgcgtggtgaacgccaccagcatcaccggttacgccaagagcaaggccgatgccctgacccaggccggatacaccagcgtgacgcccagcaatccgaccggcaacgttcccagccagacggttgtctggtatcagaatgaggccgacaaggcgacggcggagaatgtcgcgcagacgctgggaatctccaatgtccagcagagcagcggattggtcacgccgatcgttgtggtgctgttgaactgaaaaaacgccgtccgaaccggtttggaacctcgcccgaacataggcgaggttcttttattttcttggaaatccggcgtttttcaagttgattcgatgcgactgacatcttgctcacagcgcaaagaacgtcatcgggtttggcactctcgacgtgagagtgctaatctgcgaattagcactcgacgagtgagagtgataactagcggctgacggctggttctgattgtcgctccgaaggtggaaataataccgtgtagccatatgtggaggaacaatggcaaagatgattgcatatgacgacgaagctcgtcagggaatgctcgcgggtctcgacaagctcgctgacaccgtcaaggtaacccttggtccgaagggccgcaatgtggtgcttgacaagacctacggcgctccgaccatcaccaacgatggcgtttccatcgcaaaggaaatcgatctggacgatccgtatgagcgtatcggtgccgaactggtcaaggaagtcgccaagaagaccgatgacgttgcaggcgacggcaccaccaccgcaaccgtgctggcccagtccctggtgcacgagggtctgaagaacgtcaccgccggctccaacccgatcgcgctgcgtcgtggcatcgagaaggcttccgaagccatcgtcaaggaacttgtcgcggccgccaaggatgttgagaccaaggaccagattgctgccaccgcaacgatctccgctgctgatccggaagtcggcgagaagatcgccgaagctctggacaaggtcggccaggatggcgtcgtgaccgtcgaggacaacaaccgcttcggcctggaccttgacttcactgaaggcatgcgcttcgataagggctacatcgctccgtacttcgtgaccaacgccgaggaccaaaccgccgtgctcgaggatccgtatatcctcctgacctccggcaagctcagctcccagcaggatgtcgtccacatcgccgagctggtcatgaagaccggcaagccgctgctgatcatcgctgaggacgttgacggtgaggctctgccgaccctgattctgaacaatatccgtggcactttcaagtcctgcgctgttaaggctccgggcttcggcgaccgtcgcaaggccatgctgcaggatatggccatcctgaccggtgctcaggttgtgtctgatgagctgggcctgaagctcgactccgtcgacatgtccgtgcttggcaccgccaagaaggtcatcgtctccaaggatgagaccaccatcgtgtccggtggcggctccaaggaggacgtggccgctcgcgtcgctcagatccgtggcgagatcgccaacaccgattccgattacgatcgcgagaagctgcaggagcgcctggccaagctggccggcggtgtcgccgtcatcaaggtcggcgctgccaccgaagtcgaggccaaggaacgcaagcaccgcatcgaggatgccgtgcgcaacgccaaggccgccattgaggaaggtctgctgcctggtggcggtgtcgctctggttcaggctgcggccaaggctcagaacgatgtcaagcttgaaggcgacgaggctaccggcgcggccatcgtgttccgcgccatcgaagccccgatcaagcagatcgctgagaacgctggcctgtccggcgatgtggtgatcgacaaggttcgctccctgcctgacggccagggcctgaacgcagccaccaacgagtacgaggacctgctggccgcaggcgtcaccgacccggtcaaggtgactcgttccgctctgcagaacgcagcttccatcgctggactgttcctgaccaccgaagccgtggtggccaacaagccggaaccgccggcagccgctccggcagctggcgccgacatgggctactgatcgaaagaccggaagcttccataagctcaaatagctgatatgaggcccgcttcccgatggggagcgggcctttgcttatctggaaggcgccttacgcgcgctttctactgcgcgaacaaacgcgacgcctgcatttcggtctccgaatacaacgtggaggcctgcatcaatgcgcgctggattgattcaagcgactgctccatctgctgctgcgcggcacgccactgttcggcgaccgctgtgaactgcgtcgcagccccgccgcgccaaacgctctgcagattgttgagattgccgtacatgccctgcacggcctgtcggatggattggatggaggcgttgacggcggcgctcgaggactgaatctgctcgctgtcgacttgatactgtggcatgtgccggtcctttcaatgatgattggtgtgtttctccatgcgatcgcggttggcgcaaccggacggtacagtggatgctatgtcatcagtgagcgtgtgcaacgaaaaaaacggagctgtggtcggagaacatatgcatttgggttccgtcggcgtgtcgcgaaacggcggcagaacggcaaaaggttggaatatcgcgatttgcatgttgctggcgagcgtgctgggtttgtgtttgatgctgtggataactccgccggtccatgcggatgacagtgccggattgggcattacagccacggacgacatcaccgacacgcagaatctgctcggttcgaatgtctcggagatcacggacgccatcaaccagacgaaaaaggagaccggcgtcaccgtccgtttggtgtatctggacagtttcaacgccaagggcaagccggataaatgggtgagcgcgctgctggaatcgttgaacccgaaaccgaataccgtgatgttggcggttgcctcgaatgacggtaatctggtggtggccgtgtcttcgaactcggaggaatggctgaagaagaagtcgactgtcgacgcgctgtccgatgccgcgcaaaaaccgttgatggaaagcgatccggactgggcgaagtccgcgaccgacatgatgaatcagatttcggtgcagaaaaagacctcgacttcgtcgcggaccatatggattggcgtgggaggattcgccggcgcgctgctgcttctggtggtgcttctggtggtgttccatatcctgcgcaagaagggcgtgatcgggcatcggcgtaagggccgccatagcggccgtcatggtgcggtcgccgaacgtatccaaccggtcaaagagtggggcgccgaatcggaaaacgaggattatgtcaatccggataccgcttcaacgcaagattcaaaatccgttcaggaaacatccagtgaagcgagcgatgcttaagccatgagcaagcctattgaagcatccattgtcgttgtcgatgacgagccgtccatccgagagctgctggtggcgtccctgcatttcgccggtttcgaagtgaacacggccgcttcgggatccgaagccatcgaggtcatcgaaaggctgcagccggatctgatcgtgcttgatgtgatgcttccggacatcgatgggttcacggtgacccgacgcatcaggcaggaaggcattaccacgccggtgctgtacctgaccgctcgcgatgacacccaagacaaggtcatggggcttaccgtgggaggcgacgactatgtgaccaagccgttcagcctcgaagaggtcgtggcccgaatccgcgccatcctgcgtcgcacccagcagcaggtggaggacgatccgatcatccgtgtgggcgatctcgaaatcaacgaggactcgcacgacgtgtcccgagccggacagccaatcgacctgagccccaccgaatacaagcttcttcgctacctcatggacaatgaaggccgcgtgctgtccaaggcgcagattctcgatcacgtgtggcaatacgattggggcggggacgcggccatcgtcgaatcgtacatctcctatcttcgcaagaaggtcgatggcatcgtcatcgaggatgagaacggcgacaagcacaaggtaacgccgctgatcgaaaccaagcgcggcattggctatatgattcgcgctcccaagaactagattcagccatgagcaagaatcccaattcgccgtccacgggccacgcctccaatccttcggccattccggcccccatgcagcctccccggtcgctgccgaagcagaacaaggtatggagccgtttcacccgcaggattcaagcgattccgctgagcacgaaactggtcacctgcatcatcgtgctgttgaccatcggcaccatcggcatctccttttccatccgtacgttggtgggcaattatctgctgcagaagaccgatacgcagctgatcaaccaagcccagctgattttcaacagcatggactcgctcagcagcgacaccggcgatgacgggcgcagcctcatgaacacgtattacgtggaggtgcgcgacagcgaatacaaaagcacgggtgccggatcggtgcccatgctccgtgacggagtggtttcggaaccaagtctgccggccgacggcagcatcgacggcgtcactcttggacagccattcacgacacgtgcggtggtgcacatcaccacaagccgcaccccggatcattccatcatgcaggccgcgcagtcgccatggcgtgttgtcgcgttgccttggaacgagaagacacggaccgggcaagtcaaggacagtggcgtcgtgttcatcggcctgtcgttgagcgatcagatcgacacggccaacacattgacgcgattctgcgcgatggtgggcatcgcggtggtgctgatcggcgcgatactcggcaccattctggtgcaaagcacgctcgcgcccttgaagcggattgaaaagaccgccgcgaaaatcgccgcgggagatctcagccaacgtgtgccagacctgccggaaagcacggaggtcggctctctgtccatgtcgctgaacaccatgctgacacgcatcgaggagagcttccacgcgcaggaagagaccaccgaaaaaatgaagcggttcgtctcggacgccagtcacgaattgcgtacgccgctcgccgccattcacgggtacgccgagctgtacaaaatgcagcgcgacatgcctggggctttggagagggctgacgaatccatcgaacatatcgaggcgtccagcgcgcgtatgacggttctggtggaggacctgctgtctttggctcgtttggacgaaggacgtggcatcgacatcacgcagcaggtgaaactgaccttcgtggtgcgcgacgcagccgatgacctgcatgcgctcgaccccgaccgcggcatttcctgcggacaggtcgtgctccaaccaagtaccgatatggatcatcccgcccaattcgccttccaaaatggccagatgccccagattgagttgaagggtgatgcttcgagactgcgtcaagtggtcaccaacatcgtgggcaatatccaccggtatacgccggcggactcgcctgtggagatctccatgggtgtgctccccgcgtcgatcagtcccgaatccctatcccgtatgccgtccaacgagcagtcgctgcgccatctggtcgaagccatcgaagtggggcagtccatgcaagtgggtatgaactacgcgattgtgcgattcagcgaccacggtcccggcgtgccgccggaggcacggtcgaagatcttcgaacgtttctacaccgccgacccgtcgcgtgcgcgtcagaagggcggtacgggactcggcatggcaatcgcgcaatccgtggtcaaggcgcatcatggattcatctgcgcatccggcagcgaaggaacgggactgaccctgacggtggtgctgccgatcgccccggtcgaacccaagccgcagccgattacggcgagcgagaatcgaaaaaacgaaaaaaagaatcgcaaatcaaagaaataacgctcttttccgtcgggaaagcagacgctatcggcgcggaaggatgggtgcggcccacctcttgcgctaaactgtatctttggtttgaaaatgggcgaatggttttacctattcgcgtgaaggtatctgatcagcaaaatgtgaggtgacaatgccgagcggacgtgttcgttggtttgatgcgaacaaaggctatggtttcattcagacgggtgagagcacggatgatgtgttcctgcccgctgccgcccttcccgagggcgtgaagacgctgcgtaagggcgccaaggtcgagtattccgtcattgatggtcgtcgtgggccgcaggcgatgggagtgacgctggttgcctcggccccgtcgctggttaaagccacccgtccgaagccggacgatatggccgccatcgtggaggatctgatcaagctgcttgactccgcgggcaatcagcttcgtcgacatcgctatccttcaccggctgaaagcaagaagctcgccacgcttctgcgcgcggtcgccgacaatttcgacgtacaggaatagagtttcatgtccgataccacaatggatcccaaggcaatcgcccaagcggtcgctgtcacagtgtccgacgaggacggtcaggtcggcgacttcgtggaagccatcgacctgggagacaacgtcaccgatttccgcttcgaatcccgagtacgcggctacgaaggctggcaatggtcggtcacgttataccatgatgtcgaactggaccattggacggtcaacgaatcatccctggtcccgaccgacaaggccctgcgtccgccaaaatggattccttggaaggaccgtctcgagccgggcgatttggcggtgaccgattcaatcggcaccgatcccgatgacccccgcatggaagagggcttccgcaagacgcaggatgccgaaacatcggacgatacggaagacaaaccgtcagtcgcggatgaaaccgtacaggaaccggcgatggatggaaacgcttcggatgagtctgagaagacggacgtttcggaggattccgaacatcctgtgacgtccgaagaggatgtcgaagaggcggtcgaggaattcgacctgtcccgcaggcacgtgttgactccgcttggccggtcgcagaccgcaaaacgttggtacgaaggcccacatgggccaaaatcgctatccaccaagacggccgacggcaatccttgctccacatgcggattcttcattccgctgaagggtgagttgaacctgctgttcggcgtgtgcgccaacaggtggagcccggatgacggcagggtcgtgtccatcgatcatggctgcggagagcattccgaaatcgatccaccggagccgtcgcatctgtgggtgcagtcgaagccggcgttcgacgacatgcatatcgatatcatcgcccaggcgccgcgtgacgagcggggctccgtggagctgatcgaacagctttcgtccgatgacgaccataatccgaatgaggatgaggaaggttcggacgcggacatcgaagccaacaccatcgacgacgacgccagccaagaggatgtgcttgagcatgtggcctccgacgatgcgcctgaagtagagaccaccgtcaccgtggtcgacgagaataagccggaaacgtcggacgataccgaatcggctgatacggctgagccgactgaatcggacgagccagtcgaacagactgaacaggttgattccgccgattccgtcaattccgccgggtcggttgagccggttgaacaaatggatgagacggtagttgagccgactgctgaaaccaccgggcaaacggaaaacaaatcgatggaagacgaatcggcggaagctgagtcaacagaagccgaatcggcggcggctgaaacaacggaaagcgaaatgacggaagctgattcgtcggcccaagccgaatccgacgaataatcgtcatcgtatatgagagggccacgtacctgaatgtgtacgtggccctctcatatcttgttttcttttttatgcggtcagtgcacgacggtgacggtgcagtctgcgaagttgatgatttgcttggaaaccgatccaaggaaatgcgcgtccagaccggacaagccgcgcgaaccgaccactagatgacgtgcgtagcgggaagccgcgataagccccttcgaggcgggaatatggaaagcgtgcgattcgatttggaaatcgtcgggaatgttcgctgatgaaacctgaaccgaatcgagcaattcatcaagcatgcgttccgcctgcgcctggccgacggagatgggggcgacggcgttctcataccctttgaccacgcccaaatctttcagctgccagcagaacatgacctgcaggggagcgtgatgcagggccgcgaaatcgatggcgaaacgcaaagcgtgtttggaggtctccgaaccatcaacgcctacaaccaccggacgctggttccgaggcaggggagaacccggcatcgtgtaggagaccgtttcctcggtcggcgtaagcgcattggcgatggcgtcctgcacggatgcctcttcatcatcgaggatacgcaccacggtgacgggcaccttcgcctcctctgcaagagaagcggaaagcgatcccagaaaccatcgtgccacgcgtccaagcgaacgacgtccgacgacgatctgttgggcgtccttgccgatttccagaagcgctgccgttccggtggctttgacggaggtgagtttgacgcggttctcgtcaatcgtcatgccttgcgaggcctgggccacccattcgcgcagccgacgggcgatatcatgacgcatctgcgcccattgctcctcatcttctggctgggatcccatatcccatgaatgggtccatgcgtagaccgcattcacctgctgtccggtcagcgatgcttcgccaagagcccaacgcagggctgcgaaggattcatcggacccgtcgacgccgacgacgatgtcgcctcggcgggaatccatcacatcattcgattgcaggatggtgtcgctcatttggtgacctccttggtcgttgccataagtcaagcatatccgtttctttgcgtccatagcgcaatttacgcgccggcggaataaacgtcaccgcgaatcggtagagtgttgaaggactaacaagagtggaaggacaagcatgttcgaacggtttaccgaccgtgcgcgacgcgtgattgtgttggcgcaggaagaagctcggaccctccagcacaactacatcggcaccgagcatctgctgctgggcctgattcgtgagggtgaaggcgttgccgccaaggcattggcctcgaagggcgtgaccttggacgacacccgcaagcaggtcgaagagatgatcggcaagggaaatgcgtcgccgaacggccacattcccttcaccccgcatgccaggcaggtgttggagctgtcgctacgtgaggcgttgcagctggggcacagctatatcggcaccgagcatatcctgctcggtctgattcatgagggcgaaggcgtcggcacacaggtgctgatcaagatggatgtcaaccttggcgaactgcgtagcgccaccatcgatctgatccgaggcaattccagcgacggcaagaacgatagcaagggcgaactcgccaatgccggtggcgtgcaggaccgtcgcaatcagaccggttccgcgattctcgaccagttcggccgcaaccttacggctgaggctgccgctgggaagctcgatccggtaatcggacgatccaacgagatcgagcgtgtgatggtggtgttgagccgccgcaccaagaacaacccggtgctgatcggcgagcctggcgtaggcaagaccgcggtggtcgaaggactcgcgcagaagatcaacgccggtgatgtgccggaaacgctgaaaggcaagcaggtctactccttggacctcggttccatggttgctggttcccgctaccgtggcgatttcgaggaacgcctgaagaaggttttgaaggagatcaagacccgcggcgacatcgtgctgttcatcgatgagattcacaccatcgtgggcgcaggctccgcggatggcgccttgggcgcttccgatatgttgaagccgatgctggcccgtggcgaactgcagaccatcggcgcgaccaccaccgacgagtaccgcaagtacatcgagaaggatgccgcgctggaacgtcgtttccagccgatccaggtgcacgagccgaccatcgccgagaccattgagattctgaagggcttgcgtgagcgttacgagaaccaccatcatgtgacgatcaccgatggcgcgctgcaggccgcggcggaactttccagccgctacattcaggaccgccacctgcccgacaaggccatcgatctgatcgatgaggccggcgcccgactgcgtatccgcaggctcaccgctccgccggagctcaaggaattggacgccaaggctgccaagctggccgaggagaaggaccaggccatcaaggaccaggactttgagaaggccgccgagctgcgtgacaagcaggagaagatcgagtccgagcgcaaggagaaggaatccgcttggcgtgagggcgagtccgatgtgaagatggtggtggatgaggacgtcatcgctgaggtgatttcccagaccaccggcattccggtgttcaagctcacccaggccgagtccaagaagctcatgggcatggagagcgaactgcacaagcgcatcatcggtcaggatgaggctgtgtccgcattgagccgttccatccgtcgcgcacgcgtcggattgaaggatccgaagcgtccggctggttcgttcatcttcgctggcccgaccggcgttggtaagaccgagctggccaaggccctcgccgaattcctgttcgacgatgaggatgcgctgatccgcgtggacatgtcggaattctccgaaaagtacgccgcgtcgcgcctgttcggtgcgcctccgggatacgtcggctacgaagaaggcggcgaacttaccgaaaaggtgcgtcgcaagccgttctccgtggtgttgttcgacgaaatcgaaaaagcccatccggacatcttcaacacgctgttgcaggtgctggacgatggccatctgaccgacggccagggacgcaaggtggacttcaagaacaccatcatcatcctgaccaccaacctcggcactcgtgacatcgccaaggccgccaacaccggtttcaacctgggcacgaacaccgaatcgagctaccagcgcatgaaggaacaggtctccgccgaactcaagcagcagttccgtccggagttcctgaaccgtctggatgacatcatcgtgttcaagcagctcaccgaaccgcaggtgcgccagatcgtcgacttggatgtcaagcagctcaacgaccgtctgttcgaccgtcacatgtcgctcgaactgaccgacgcggccaaggatctgctcgcacagaagggcttcgacccgctgctgggcgcccgtccgctgcgtcgcgtgatccagcgcgacatcgaggacgccatttcggagaagatcctgatgggcgacctcgaagatggccagcgcgtgaaggtggacgccgaaggcgaaggcattctgggtgagttcacgttcaccggcgaggccttcgaagagccgagccagacggataatccggtgaaagcgaccgaaacggccgctgaaaccgatgccgccactgaaccgacggcatcgacggaaccggctgattccgcgcagtcgcagaactgatttccaacgttgccggggtaagaaccccggcaacgcgtatgcaaaaagaccggtgggtttcatgatggaatgtcatgaaacccaccggtcttttttacatatgcctattcgtccagctatccgttcagctggacggttgtggttccgccacttccaagcggaaccacaaccgtatcgctctatgggagcgtcattacttgatggcgttcagccactgctccttggtggccttctccgcctcaagcttggccttcttcttcggatcggactcagcggcgatctgggcgtcaagttcggcgagctgggcgttgagctgctcctcgaaggaggacttacgggcgtcggcttccggatcggactgcttccaggcggcatcctcaacagccttgatctgcttgtcgacagcatcaagacggctttcgatgcggtgcatgtcatcgcgcggaacgtagccgatctggtcccattcctcctgaatggcggccaatgcctggcgagcctgcttggcggccttctcatccttgaccggcaccaaagcctcagccttggtcagcagttcttccttcttggcgagattttccttttcggacgagctaatctgctcgcgatcggcctgacgggcgttgaagaacgtgtccgccgcagcacggaaacgtgcccacagcgcgtcatcatcacgacggcccgcacgaccggccttcttccaacgatccatcagctcgttgaacttgcgggaggtttccatccaagcggtggaatccttgatctcctcggcttcggcgatgatggcctccttcgcggccttggcgttgctgcgctcctcatcgcggccctgggcccacttgcggcgggcgctgttgaacgtagtgcgggcggaggagaaacgcgaccacagggcgtcggcgtcggccttgtcgagacggacgctattgtgctggtgatcctgccactgctggaacagcgaacggaacttgtccgcggtggaacgccagttggtgttgtcgcccagggaattggccagagcctcggccttctccacaatcgcggtacgttcggccagcgccttggcgacggcggccttgtgggcctcgctcagctcggccttcttggccgctccggcctccttcagtgcttcgaactgggacttgagcgcctcaatatctccgacgacggccggctgctcgatttcggcggaaagcgtcttgatggactcgtcgatctcacggttcttcacattgctggacttgagcctgttggcgaacaggtcgagctttgccttcagatcgagatagcgacgggcatacagtgccagggcctcttccttggaagcgtccggaaactgtccgacctcgcgttctccctcgccttccttcacgaacacggtgccgtcatcggcgacacggccgaacgcttcggtggccttgatatcggcttcggagaatccggtggaggttgcaggacgctgcggagccttcttggcgaaggccgcggggctcggcgcatgcggcttcatggccgctgggctcgggacggccggtttgctggcctgggttgcgggcgtcgctgcctgctcgttggtttcagtggtgttctcggacgcggtgacattctcgtcggccatggccagctccttacgtaagcttcatgtagtgcagaggtgacggtccgtgacgtgcgcttccacaccttgaaaaacgcgcggcattttccgtaacctcatttattatagagaaccgtggctaaaggtgcatctatttcaggatttccagagtggctcccctctgaacgtgttgtggagcagcgtgtcatcgacacgctccgtaatgtattcgagctcaatggcttcataggcattgaaacccgtgctgttgagcagggttccagcctgctcaagaaaggcgagaccagcaaggagatttacctgctgagccgtcttcaggaagtcggacacgagtccgacactccgattgaggatcgtcttggtctgcacttcgatctgaccgttccgctgagccgttatgtcgtcgaacattccggcgatctggcgttcccgttcaaacgttggcagattcagaaggtctggcgtggcgaacgcccgcaggaaggacgtttccgcgagttcgtgcaggccgacatcgacgtgatcggcaatggcgatctgcccgaccattacgaggtcgaattgccgttggtcatggtgtccgcattggaacgtctgcgcgagttcggtctgccgaaggccaccgtgcatgcgaacaaccgcaaactctccgaaggcttctaccgtggtttgggccttacggatatcgaaggcgtgctgcgtgagatcgacaagctcgacaagatcggcgccgatgaggtggccaagctgctcgtcgaaggctgcggcgccgacgaagcccaggcccgtgcctgcctcgaactggccgagctgaccgccgccgacggcaaggaactgtccgacaagttcgacgcattgtgcgccaagcatgacatcgcgtctgattccgacgcctacgtgttggcacgccagggactcgacacgctggcgatgatcgtcgacgaggccgcgcgcatccgtccgggctccgtgatcgccgatctgaaaatcgcccgtggtcttgattactacaccggttccgtgtatgagacgttcctcgacggcgccgccgctttgggctccatctgctccggcggccggtacgacaacctcgcatcgcagggcaacaagaagtacccgggcgtgggcctgtccatcggcctgtcccgcctggtctcctacatgctgcacaccgcgggcgcgcacgccaaccgtgtgtctccggcatccgtgctcgtggcggtatggaatgaagccgaccgctccgcgtccaacctgatcgccaaccagctgcgctcccgtggcatcgcggcggacgtggcgccgaccgcggccaagctcggcaagcagatcaaatatgcagacaagctcggcatcccgtacgtctggttcccggccgacgcttccgaagagggcgcccaggacgaagtcaagaacatcatcacaggagaccagcggccggctgacgcacagtcgtgggagccggatactgtgtatgcccagcaaaccgttaccgttgaagcctgaaatcgcaagacttcgcaacatacaagaggataaggaataggggaagcatgagccagacggcttacagaacacatcatgcaaccgaagtgaccgaacagctcgtcggtcagaaggtgacgctcgccggttgggtcgatcgtcgccgcgaccacggtggcgtggccttcatcgatcttcgtgacaacaccggtctggtgcaggtcgtcatctatgacgaggagatggcccgtccgctgcgctccgaattcgtgatccaggtcgtcggcgaggttcgtctgcgtccggacggcaacgagaacgagcatctggccaccggcaagatcgaagtcgtggccgaaagcatcgaagtgctggccaagtccgatgctctgccgttccaggtctccaccgctcttgagaacgagtccgagaacaagctgccgggcgaggacgtgcgtttgaagtaccgttacctcgacctgcgtcgtccgtccatgcagcgcaatctgaagctgcgagcccagatgtcgaaggccgcccgccatgcgctggaggaaatgggcttcgaggagatcgaaaccccgaccatgatcaagtccacgccggaaggcgcccgtgacttcgtcgtgccggcccgtctggtgccgggttcctggtacgctctgccgcagtccccgcagctgctcaagcagctgctcatggtctccggcgtcgagcgttactaccagctggcccgctgctatcgtgacgaggacttccgcgccgaccgccagccggaattcacccagctcgacatggagatggccttcgtggaccaggaggacgtgatggccatggccgaaaaggtcatcgccgccatctggaagtccgccggctacgacatcaagctgccgatccagcgcatcacctggcaggacgccatggacaagtacggttccgacaagccggatctgcgtttcggcaatccgctgatcgaactgaccgattacttcaagaacacgccgttccgcgtgttccaggccccatacgtcggcgcggtgctcttcaagggtggcgcggccacgcctcgccgtcagttcgacgcatggcaggattgggccaagcagcgtggcgccaagggcctcgcctatgtggtgttcgccgagaacggcgaactcaagggccccgtcgccaagaacctgtccgaagaggaacgtaacggtctgaaggaagccgtcggcgccgaagacggcgacgccgtgttcttcgcagccggtcgccgcacctcctcccaggaactgctgggcgccgtgcgtgtcgagcttgcccgccgcgcgggcctgctcaagcccgacgatttcgccttcacttgggttgtggacttcccgctgttcaagccgaccgatgacccggacgacgacgatgtggcagtcggccactccaagtggacctccatgcatcacccgttcaccatgccgtccaaggattggatcgacaagttcgacaaggatccggaacacgccatgtccgattcctacgacatcgtgtgcaacggcaacgaaatgggcggcggctccgtgcgtatccaccgcgacgacattcaggaccgtgtgcttgacgtgcttggcatcacgccggaagaggccgcagacaagttcggcttcctgcttgaggcattcaagtacggcgctccgcctcacgccggcatcgctctcggctgggatcgtaccgccgcaattctggctggcgccgactccatccgcgacgtcatcgccttcccgaaggctggcggcggccgcgatccgctgaccggcgctccggctccgatctccgctgagcagcgcgccgagaccggtgtcgattacgatccggatgaggacgaggactgatacggtttcgcccatagatgaatgaaaaatgtccgaacatcaatgatgctcggacattttttattattcgcgttgtctattttccgtcgctgtcattatagtggagcgtgtttgattatccggcaaccagaaagggttgaagcgcggtatgaaatcgaaaacacaggacaagaagcgactgaacgcggtcggcatgcgcatatgcgcgctgttcgccgtgctcgccgtggtctttgcggcattcatgacgaccgttccgcatgcgctcgcctccgaaactggcaatccggcctcggtcaagggcaagacatataaaatcggcaccgacaccacgttcgcaccgttcgaataccgtgagaacggcaagatgaccggcatcgacatggagctaatccgaggcatcgccaaggaagagggctttaaggtcgagatacagtcgctgggattcaacgccgcgttgcaggccctaagctccaaccaggtggacgtcgtcatagccggcatgtccatcactgacgagcgtaaagcctcctatgatttctcgaatccgtatttccaatccggcatccagatggccgtcgcggccaacaacgacgacgtcaccggctataaggacctcaaaggccggacggttgtggcgaaaaccggctcggagggcgaatcgtacgccaaacagcatgccgacaagtacggttacaaggtgacttccgtcgaccaatcctcaaccatgtacgagatggtcaaatccggcaatgccgtcgcggtgttcgacgattatccggtactggcatatggcgtatcgcagaacaacggtctgaaaatcgtgactccgaaggtgccgcacggcgaatacggcatggccgtgaacaaaggcatgaacgcagatttgctggccgccatcaacgatggattgaacaagatgatcgcttcgggagaatacgagcgaatcgtcgcacaatatcttggcaagcaaggcgcgaaagagcaggccaaatcgatttccggcatgatcaccgacaatggcgacgacagcgccgaacaacagaaggtcggtttcctcggactggtcaaacagtcgatgccggcattgctgacgggcttgaggaacacgctgctgatcacgctgctttccttcgcgatcgcattggtgctcggcgtcgcgttcggcctgatgaaggtttcggaaagcaaaatcgccgcaggattggccaatgtgtacatcgcggtgttccgcggcaccccgatcctggtgtgggcgttcttcttctacttcggcgtgccccagctcatcggacatagcgtgaacatctgggtcgccggcgcattgaccttgtcgctcaactccggcgcgtacctggcggaaatcgtgcgtggcgcagtccaatcggtcgattccggacagatggagggcgcacgttcgctgggactcaaccacaggcaggccatgcgccgagtgattctgccgcaggccagcaaaatcgccatgccttcgatcatcaaccagctggtcatcatgatcaaggactcctcgctactgctcgccatcggcttcggtgagctgctgtaccaggcgcagcagctgtacgcggcgaacttccgcgtaaccgaaacgctgctgatcgtcggcgtcatgtacttcgtggccatcaccatcctgacgtggctggccaacatcgtggacaggaaggtgaaccgatgaacgagaacgacgtgatcatcgacgtcaaggatctgcacaaaagctacgggcagaccgaggtcatcaaaggcgtcgacatgaccgtgcgcaaaggcgaggtgatctgcatcatcggaccgtccggcgccggcaaatccaccatattgcgttgcctgaacggactcgaacaggccaccggcggcaagatcgtggtcaacggacacgatttgacggacagccatgtgaacatcgaccaggtgcgcgagcaggtgggcatggtgttccagcatttcaacctgttcaacaacatgagcgtgatcgacaacatcaccctcgcaccgaaactggtgcattatgaaacggatgagcaggcccgcgcgcacgccatggaactgctgaaaaccgtaggattggccgaaaaagccgacgccatgccgaaatcgctgtccggcgggcagaagcagcgtgtggcgatcgcgcgctcgctggcgatgaatccgaaggtgatgctgttcgacgaggcgacatccgcgctcgacccggaaatggtgggcgatgtgctcgaagtgattcgcgaccttgccgccaaaggcatgaccatggtgctggtgacccatgagatgggcttcgcacgcgaagtggccacgagggtcatcttcaccgatgccggcgtgatcgaggaagagggaacccctgacgagatcttcaaccatccgaagagcgaacgattgaagaccttcctctccaaggtgctgtgacattgctccggcggcgatccgtttgatgaatatgttcgtcaaacggtatgaaatgtctcatattccggacgaaatgatgtgaacgggcagtataggaaacatgaatttcgcattgctttcttatactgccctttatgtctgaaatgaaagaaaccgaagcgaagcgtcccatcatgccggacgcgggagcggataacaggccgctcgtcgaactgacccatgtcgagaagcattatggcgatctgcatgtgctcaaggacatcaacctcaccgtacgcaaaggcgaggtgctcgtcatcgtcggaccgtccggatccggcaaatccacgatgtgccgcaccatcaatcgattggagaccatcgattccggggatatccgcatcgacggcaagccgttgccgcaggaaggcaaggaactcgccagtctgcgcgcggaagtgggcatggtgttccaatcgttcaacctgttcgccaacaaaaccattttggaaaacgtgacattggcaccgatcaaggtgcgccacatggacaagaaggaagccgaggacctggccatggatctgctgggccgcgtcggcgtggcctcgcaggcctccaaaatgccgtcgcagctgtccggcggccagcagcagcgtgtcgccatcgcccgcgccctcgccatgcagccgaaggtcatgctgttcgacgagccgacgtccgctctcgacccggaaatggtcaacgaagtgcttgacgtcatggtcgaactcgcccacgaaggcatgaccatgctgtgcgtgacccacgagatgggtttcgcgcgcaaggtggccgacaaggtcgtgttcatggccgacggacagattctcgaacagagcacgccggacgacttcttcgaacatccgaagaccgatcgcgccaaggacttcctgtcgaagatcctcacccactgaagtgacggaacataacgacagaagaaggaacctgatatgaaatcactttcgatcacgacgaaacgcatgttgcgcagagccgtcgcggcattctgcgcgtgcgcgtgcgtgttcgcggtatccgcatgcggcgcggacgaaaccggcaagatccgcatcggcatcaaattcgaccagcctggcctgggcttcaagaagaacggcacctacgtcggcttcgacgtggacgtggccaagtacgtggccaagaaactcggctattccgaagacgagatcgtatggaaggaatcgccgtccaagcagcgtgaggctatgctgcagaacggcgatgtcgactacatcgtcgcatcctattccatcaccgacgaacgcaagaaggtcgtcgatttcgccggcccgtatttcgtggccggacaggatctgctggtacgcaaggacgaaaccggcattgacggacctaaggatctgaacggcaagcggctgtgctccatgaccggcaccacatccgccgtcaacgtcaaggagaagttcgccaagcagacccagttgatggaacagcccggcatggcggaatgcgccaccgcgttgctttccggcattgtggacgccgccaccaccgacgacatcattctcgctggcctcgcatccgcctcacgtggacgcctgcgcgtggtgggcaagccgttcacccaggaatattatggcatcggtgtcaagaagggcaacaccgagctgaagaacaaaatcaacaacgccatcaccgatatgattcaggacggttcttggcaaagggctatttccgacaacaccaggggagtggcctacacgccgaacgccaagtacaatccgccggtgccgaatggaaaggggaataagtgatggacggattcctcgcgttgttcagccaatacaacattcccggcgcgtttctggtgaacatcgagctgaccctgtggtcggcgttgttctccacgattctgggcgtcgtcctcgtgatgatgcgcatttctccgatcgcctcgctccgtaccgtttccggtgcctacgtcgaactgttcaagaacctgccactgaccatcatcatggtgttcatggtgctgggtgcgtacgcgcagctgaagttcagcttctccgacacgttcgccaccaacttcttctggctggccgtgacgggcctgagcctgtacaccgcggctttcgtatgtgaatcgctgcgctccggcatcaacaccgtgccgcttggtcaagccgaggccgcccgcgcgttgggcctgaacttcatgcaggccgccactcagatcatcctgccgcaggcgttccgcggttccgtggcgccgttgggcaacacgctgatcgcgttgctgaagaactccaccgtcgcggcggcggcatccgtggccaccgaaacctcgacgatgatgagcgaaatgatcgaataccacgccgaccaaatcgtaccgatcttcctgatcttcgccttcggctatgtggttctgatcattccaatcggcatgctgaccacgtatctatccaacaagctcgcggtgaggaggtgacgcgacatggcaagcaatgaaagcgcggtgctgttcgaccagcctggtccgaagggccgcaaaaccatccgtatcgtcaattggatcgcaggcatcatcttcgcggtggtggtcgtgctgatcctcatgcgtctgcacaatccgccggacggcgagaaccagctgagctgggaactgtggaagccggcgcttgacgccgaagcatggaccgacttctatctgccgggactgtgggccacgatccgcgcgtccgtactggccgtggtcggagccgtggtgttcggcctggtctttggtgtgggccgactgctgccgagcctgctgatccgtaccatttccggcgcgatcgtggaattcgcacgagccgtccccgttctgctgctcatgatcttcttctggcgctggttcgccttcgcaggtctgcccagccccgcgtattgggcggtggtgctcgcgctcgtgatctacaacggatccgtggtggccgagctggtgcgttccggcgtgggcaacctgccgaacggccagcgtgaggcctcgctcgccttgggattgacccgtacgcagtctctgttgcagatcgaagtgccgcaggccatctacgccatgctgccggcggccgtgacccagctggtcgtcgtgttgaaggacaccgcgctcggctcgatcatcatgtacactgacctgctgcaggaatcacgtcgactcggctccatgtatttcaacatcctacagacgctggtggtggccgcggtcgtctatttcatcgtctgctggctgctaagcaggctggccgaatggctgccgtcgcgcatgcagcagcatacggctgcaccggccgaaccggaaccggtcgcgccgatcgccatcatggatccgtcgaacgtgaaccagatcgccgtggccaaggaaggcgtgccgctgggtggcgcgcagcgtgtctaccatgtgcaccatcgcggcaccaacgcgtccatccaccagtggcgtcagaccaggtacgcccaaggcttcgatgagacgcatccggaaagccaggtcaaattcgacaagaatggacatccgatcaaggacaatccgttcaagacgaagggcgatggcaaggacaagaacaagtccgaagccgacgaatagcaccggtatcgcataacacgcgtagggggtcgtttttccgcgaaatacggggaagcggcccctttcgtgtctacgatggactgcacgcatgtggtccgtaccaagcagggaggcttgacatggcggataaaaccaaggatgcgaaaaaagacgacgccagaatgtcgtcgatcgcgaaaacgctgaacaaagtggaagatcggctggaaaaaagcgagaattgcgattccgtcgccgaaggattggcgaacgccgccaaagcgagcgaactactgagctcggtatggacgttgccgccgacccagctattgcgattccatcacgacacgaaggtatcggacatagatggcgattccactcctggttttgacggcaacaaggatgatgccgaacgattcatatccatcagctcgtcggagatcgcccgttaccagcggcttatgtacgccaatggcgtgaaaggctcgcatcggcgactgctgatcgtactgcaaggcatggacgcgtcaggcaaaggcggcatcgtacgacatgtgttcagccaaggcgacccgatgggcatgcactatcacgggttcggcgcgccgaaaggcgaagaactggaccatgactatctgtggcgcatcaaacgcgagctgccgaacaacggatggatctccatcttcgaccggtcccattacgaggacatcgtcatgccgcgcatctacaaaacgcagccggaagaagtgtggcaggcacggtacgacgaaatcaaccgattcgaatcgcaattgacggccgacgggtgcgccatcatcaaaatcttccttgtggtcagcaaagacgagcagaaacgccacttcctgagccgtctcgatgatccgaccaaatactggaagttcgatccgagcgaccttgaggcgcgcgcccgctgggacgactacatggccgcatggcaagatgtgttcctgcgcaccagcaccgagcaggcgccgtggtatctggtgcctgccgacaaccgctggtattcgagggccgtcgtctccgagctgctgcgcaacacgctcaagaacatgaacatgatctggccgccgctcgaagtcgacgccgacgaaatgcgccgtcagttggacacgctgtagtcgaagaagacaacctcgccgctggattgcgtggcgtccaggtcgacggttccggtgatggcccaatcgtggtcgccatcggaatcgtcgatgatctgccgcaccttccaggcgtgctcgctgttctccttgctttcgtcgaggatgaacagttcgccgctgcgtgccttcgcgtcgatgttgacgtattcgtgctcgtcgtagtaatcgtcgagcgtgtcctcccactcgtgcacgccgtagccccagtccttatcgagcgcgccgagctcgtccggcttgtcgaggtccatgagctgcacacggcggaacatggcattgcgcaccaatacggtgagtccacggcgatcctccaccacggcctgttttgcgccgggcgcggcaagattggcggccgcttcggacgcgtcggtatcggttccggcatgctcccattcgtccaccagcgaggagtcgatggaacggaccaccacgcgcagccaggagatgatgtcgtcaagctgctcgtcgcgcttttcctgcggaacggtacgcgccaacgcacggtaggcgtcggacaggtaccgcagcagcgtgccttcggaacgggcgatgttgtagcgggcgatgtagccggtgaaatcggaagcggtctccaccatgtcgcgcaccacggatttcgggctcagccaatagtcgttcgcccacggaacatcatggcggtattcatcgaacgcggcctgcagcatatcctccaacggcttcggataggtgatctcctgaagcctgtccatacgctcgtcatagtcgaggccatcctctttcatgcggatcatcgcctcgtcgcgcgcctgacgttcctgcgcgcgcagcacctgcttcgggtcctccaacgtggcctcaaccatggatatcacatccaacgcatacgtgtccgactccgggtcgagcagttccaacgcggccagcaggaacgggcttagcggctggtcgagggcgaaatcgtccggcatgtccacggtcatgaaataatccttgccgccatcgtcacggtcttcggtctcgatgacgttcgtgtcgaacaaggtctggaagatctcgtccgcgcgggcgtgcaggcgctccttctgctccggagtctgcgccgaatcgtcgataagccggtcgatgcggtagcgggcgtcgccgccctgctccacctcgttcaacaccatggaatgggtgatcttcatatgcggcaccagtgtttccggagccgcgtcgataagcttgtcgaacgtgttctcgttccacgttacgaaaccttcaggagccttcttgcgcttgatcttcttcagtttcttcggatcgttgcctgccttggccagagccttggcgttctcgatttcgaattcgggggcttcggctatgaccagaccctccgtgtcgaagcccatgcgtccggcgcgtcctgcgatctgatggaactcgcgggcgcgcagcttgcgcatcttcgtgccgtcgaacttggtcaacgcggtcaataccacggaatgaatcggcacattgataccgacaccaagcgtgtcggtgccgcagatcactggcagcagtccctgctgggcgagctgctccaccagacgacgatagcgggggagcatgccggcatggtggatgccgatgccggtacgcaacagacgctgcaggatcttgccgaacgcggtggtgaacttcgtgcccttgatggcttccgcgatcgcggcgcgctgctccttgctggacacgcccgtgctggccagcgcgttggcggtctccaacgcggcatcctgagagaaatgcaccacgtaaatcggcgtctcgcccttgccgaacgccaattccaccgtcttctccaacgggtcgagtgtgtattcgtacgtcaacggcacgggacgtggcgcgtcggcgatgatatccacgtcggtgtccgtcatgtcctcaagcttgtcggcgattgcgtcgacattgcccagcgtcgcgctcatcaacaggaactgcgtatccggcagcgtaagcagcggcacctgccaagcccagccgcgctcgggatcgccgtaatagtggaactcgtccatcgccacgcagccgacatcggcgtggcggccctcgcgcaacgcctgattggcgaggatctccgcggtgcagcagatgatcggcgcatccgcgttgatatgcgtgtcgccggtgatcatgccgacgttctcgcggccgaaaacttcaaccaagtcgaagaacttctcagacaccagagccttgatcggagccgtgtaataggaacggcggcccgtgcacaacgcggcgaaatgcatgccgagcgccaccagcgacttgcccgaaccggtcggagtgttcaaaatgacatggtcgccggccagcagatccatgatggcctcctcctgatgtggccacggttccacgcctttgacgtcctccacccaggtgaagaaacgctcatagatctcatccgtgtcgatgttgcgctcgccctcgtcccaattcggcgccaacgcgcccagcgagccataattcgtatcgtctgccatgcttgccagtctaccggttggggcgaacgcatgcatcgaacgtgtgttcgaattgttgggtgtgttgcggtacagtggaaagcatgactgacgatttgtttgccgcgatggacgcgccggatgatgtgacgcgcccgcttgccgtacgcatgcgcccagcgagcatcgacgatgtggtggggcaatcacgggtattgggggaggggtcgccattgcgcagactcgccaaccccgcttcgaaaggctcgctcaccgcaccgagctccatcatcctgttcggacctcccggagtcggcaaaaccaccctcgcctatatcgtcgccaaacagtccggccgtgtgttcgaggaattgtccgcggtcacttccggtgtcaaggacgtgcgcgatgtgctcaaacgcgcacatgacagactcgtatccgaaggccaggagacggtgctgttcattgacgaggtgcaccgattctccaaatcccaacaggacgcattgctgcccagcgtggagaacagagacgtcacgttcatcgcggccaccactgaaaatccgagtttctccatcatcaagccattactcagccgttccgtggtcgtcaaactcgaatcgttggagccatcggacctcgagacgctcatcagacgcgccatcgccagcgagcatgggctgaagaacgaggtacgcatagacgatgaagccgtcgacgagatcatccggctcgcaggaggagacgcgcgcaaaacgctgacgattcttgaagcggcggccggtgcgctcacgggtgaccaagaacgcaagaaaggcgcgaaacgcccggtggtcacaccggacgtggtgtcgaaagtgatggatgtggccaccgtacgctacgacaaagacggtgacgaccactatgacgtcatctccgccttcatcaagtctatgcgcggttccgatccggatgccaccatgcactacctggcacgcatgctacgcgcgggagaggatccgcggttcatcgcccgacgcatcatgattgcggcaagcgaggaggtcggcatggcggcgccgcagattctgcaggtcaccgtcgccgccgcacaggccgtagccttggtcggtatgccggaagcacgcatcatccttgccgaagcggcgctcgccgtggccaccgcgcccaaatcaaacgccagttataatgccatcaacgcggcgctcgccgatgtggatgccggacttatcggtcaagtgccgttgcatctacgcaatgcgccaaccaagcttatgaaggaatggggcaatcacgaggggtaccgttacgcgcacgactggcctggcgcggtggccccccagcagtacatgcccgacgaactggtgggacgcgaatactaccatcccaacgatcgtggctatgagcatgaggtgagcgcgcgcctcgccaagatccggccgattctgcacggcgaggacgataagggcggacgctgattccgccgtcttggattcagccgtgctcttttgcttatgtgtataatacggatgcggtaaacaacatgccttgcgtccaatgtgggaatgcgtacgtgacggagcatgtcggaaggaggacggcgatgatgcaagacgagcatggcaagtccaagcagacgctgatcatgattgtcgatgacgatgcggccttgggggaaatgctgtccatcgttctgaatggcagcggttttgaaacggtgacatgccaggacggattgcgtgcagtggagatgttcccgacccttcatccggatcttgtactgctggatatcatgcttccgggattggacggggtgcaggtggcacaacgcatacggcagaccgccaatacgccgattatcatgcttaccgccaaatccgataccactgacgtggtgaagggtctggaagcaggagccgatgattatgtggtcaagccgtttgaagtggtggagctgatggcccgtatcaaagcgcgactgcgcacactggggatgggcgcttcatcggatggagcggcagccgaactgccggaattcctgcattgtgggatactcgagatgaaccgtgtgcggcatactgccaagaaaaacggtatcgacttgcacttgactccgatggaattcgaattgctctacgtattggccgtgcatgaggatgagcccctgagtcgtacaagcctgctcaagcaggtatggggttatgacgacggcggagacgccaagttggtcaatgtgcacgtgcaacggcttcgcatgaaagtggaatcgaacccggagaagccgcagatcgtacaaactgtgcgcggcatcggctataagttcgttgcgcctaccgaataagcggccatgatgacactacggcgggtaaggaaggcatggcgccgcggaaggcaacgcgctcacaagtcattgcagaccaggatggtcgtattgtcaatgctggtgttttctctgacggcggctttgttgtgccttttctccatgggcaccatcaaaggaacgatacaggcgcaggttatggatgagtcccgtagggatttctcctcgcagatcagtctggcccaaaaacagctgagttccgcgaaccttgccgattccagccaatatcagcagttgatcggcaatctggcatccgaactgcaaaacaatggatccggcaatatgattggcgtgtatctgatgagcggtgatgactcgaacattgatgagaagaccttcgtgccagtatccaccgagccggaatacacgaacctgatatccacggagatgcagcatgatctgcaatcggattccgacgattcgatttattaccaggccgtgaatatagcgaaatcggagaagggcacacctggggccattcttggttcgacgatttcatcaaatggcattggcacggtgaagatattcgcgctgtactcctatcaaacgcagcagcaagctctattgcagattcagttcaacatgctggtctcagacgtattgttgagcatcgcaatcgtcgtcatcatattttcagtcatgcgttccgtggtcaaaccggtacaggatgtcgcggcttcagccgaaaccatggcatcggggaatttggatatccgtgtacaggtgaacagacaggatgagatcggtgtgctgcagcgttccttcaatgagatggcggactcgttggtgcagaaaatcgatgaacttgaaaaagccggcgatatgcaacgtgaattcgtctctgacgtcagccatgagctgcgtacgccggtgacgaccatgcgcatggcggcggacatgttgtcgatgcataaggacgggtatgatgccacgaccaggcgcacggtggaattgctggacgggcagattcgcagatttcaggagatgctcgctgatttgttggagatttcgcggttcgatgccggatacgcggcattggatctgactgaaggcgatgttcgtgaaccaatcagccaagcggttgaacaaattgcgagcatcgcggaaaccaaacaagtgccgctgaatgtccaccttcccaatatggaagtattggcctgcgtcgatgcaagacgcatctgccgtattgtacgtaatctgcttgccaatgcgatcgatttcgcagaagggcgacctgtggaggtgcgtcttgcggtcaatcgcgccatggtcgtcatcagtgtgcgagattatggcgtgggcatgaccgcgagccagtgcgaaagaatattcgaccgattctggagaggcgatccgtctcgtgcccgtactacgggcggcacgggcttgggcatggccattgtgctcgccgatgtgagactccatggtggtgatatttcggttcgttcccagatgggcaagggcacttggtttctggtgacattgccgcgcaatcctgaaaacggcccggtgaatgtagcccaagctccgatccgcttcagtgccgagaataacggattctgtactgtcggaggattcggtatcgccgacaatggattttccgactatctgaccggtgagcccaatgtcgggaaggggcggaagcagtgaggacgtatcgtgtggcacgagcgctggtaacgatgctggtggcgctgctgttcggctgtctgttgccggtattgagcggatgctcgaatgtattgggactgccgaaaagcggggcagtgcaggtcgtgaaacctaccgaacaggatacgcggagaatattcacgaatccgtcgggacctgtgaagggcgcgcagccggaagccattgtcaaggggttcttcgaggccctgccggccggcgtgcaaagcgacggttttaaaacagctcgtcggttccttaccagtgcggcttcgaattggtggaattccgatgcgaaaacgatggtgtactcaggtgctccgcagattgcccgtaaagccagttttgccgattcttcggcagtgaatgatgagattacggtgtcggtgcgtctgcaagtccaaggcatgctggattcccacggcgtgtacctagcggttcccgaagagacggaaactttcgatttcaccctttccaaggtacaggggcagtggcgtatcggaaagctgccgtcaggtgttatggtcggtgccgacgatttcaaacaggcgtatcggcaggtttcgctgtaccagctggggacatcgcgtaaggaattgatccccgatgtgcgttggctatgctggcgtgattggcgtgctcgtgccgtggaggaattgcttaatggaagtgcggcgtggctgcgggatgcggtggtcgacaccaatacggagcaggtgaccttgcggtcgaatggcgtgaccgtccatgattcgacgattcggatatggctttcatccgtgatgaatcgaatgaccgatgcggagcgctcggtattggtccggcaactgcggctgtcattgggggacggcagcaaggaaacaagcatcgatgtagtggccggcgggcgaaattactcgcatgccgatgacggttcatcgctggatacgcgatcgacagtggacccaatatacacattgagcgcgggcaacatcgtttcgctgaaatcgtccaatgcggtacgtgtagcgcaggccggcatcgatgacgcagacggattcatcttttcatctgaaggtggtgccgtgcttgaccacagcgggcgtgtgaaacgtctcggagcggatggcgccttgcgggataccatgttctccggtcataagatacggaccatatgcaaaggcagagggaaagagatttgggccgttgacgaatcgacggaggagattgccgtcgacgccgacggcaggacgcgcgcgttgacgattcccggacttgacgatacacaacatgtccgtgcgataagcgtttcgccggaaggcgatcgtctggctttctctctggaatccagcaaacgtgcgaaatccggaataggcatcatcggaatccggcgtggttcggatggagaggtggagtcgttggcaaggtcgttcctgcggatctccgatcaatccggagtgtccatgatgaccttctacaacgacatcacttttatctatgccgcgcaatatgagcagaacgaccatacacagatcgcacgacgtcagcttgtgccgggtcctgaaaacaatcagtctcttcccgatgccggagccatcgccatggctaccggtgaggtcaatatgtatcggcgcttcgccgtacttgaccgtttgggtatagtcagaaccgtcgatggctcgttggggggcacatggtccagtacggattcgcaggttatggctctgtccgcacagtgacgaatgcatatgcgataaacaccttcggtacacatgaatctggttatggctccatgagggatattggattgtcgcggtgagaactctgacggcgcgatgccaagttgttaccgaaaagttatcgtatgaggttgagcgttgaggctttcgacacgatactggaatcaccgatggcaaggaaggccatcacaaccagtaacagctcgaggaggagttcatgaagaattggaagaaagccattgcagtctgcgcttcggccgcagctctggtcagcatggcggcatgcggcagctcaaatgccggatcgaaatccgatgacggcggcaagaagacgattggcttcgtggccgtcggcccggaaggcgggttccgtaccgctaacgagaacgatttgaagaaggcgttcaaggatgcgggcttcaacttggtgtattctccgacgcagaacaatgatcagcagaagcagattcaggcattcaacaagttcgtcaacgatgaagtcgatgccatcgtgctgtccgccaccaacgattccggttgggatgactgcctggagaatgcggcagaggccgaaatcccagttttcaccgtcgatcgtaatatcaatatcaagagcgcggaagccaagaaggcagttgtgtcccatatcggcccgtccaatgtgtgggcaggtgagcaggctgcggaattcgtcaataagagcttctcgactggagccaacggcttcattctggaaggcccggcaggcctgtccgttgtgactgatcgtggccagggctggaagaacaaggccgcggacaacatcaaggttctcgaatcccagtccgcgaactggtccactgatgaagccaagaccgtgaccgccggcttgcttgacaagtacaagtccgacaatccgcagttcatcttcgccgaaaacgatgagatgggcctcggagcggcacaggctgttgacgcggccggtctcaagggcaaggtcaagatcatcaccatcgatggcaccaaggcggctttgcagtctcttgttgacggtgacctctcctacgttatcgaatacaacccgatcttcggcaaggaaaccgccaacgcagtcaaggactatctgggcggcaagtccgtcgagaaagacatcgagatcgaatccaagactttcgacgcagccagcgccaaggaagctctggatgccggaacccgtgcatactgattgtgatgggcgacggttctgatacggaacgtcttttcttctcataacccacgaacggtgcgtcgcgatgatggcgcaccgttcactacatcttgggcaaatatcacagaacgataacaattttcgtaaggcgaagacatggcagacaaaaaaccaatcgtcgtgatgaagggcatcacgatcgaattcccgggcgtcaaagccttggacggcgtcaatctacgtctattccccggtgaggttcacgctcttatgggagagaacggcgccggcaaatcgacgatgatcaaggcgctcaccggcgtgtacaagatcaatgccggatccattgaagtggacggcaagccgcagaccttcaccggcactggcgatgcgcagaacgcgggcatcgccacggtgtaccaggaagtcaacttgtgcaccaatctgaccatcggcgaaaacgtcatgctcggtcatgaagtgcgggggccgctgggcatcaattggaagaagacctatgagaagtctaagaagttccttgcccagatgggattagaacatctcgacccgaaggccccattgagttccatctccatcgcgatgcagcagctggtcgccatagcccgtgccatggtgattgatgccaaggtactgattcttgatgagccgacctcttcattggatgccaacgaagtgcaggatttgttcaagattatgcgcaagatccgcgactcgggcgtcgccatcctcttcgtctcccacttccttgatcagatctatgagattaccgaccgattgacgattctgcgtaacggcaagttcatcaaggaagtcatgaccaaggacactccgcgtgatgagctcatcggcatgatgatcggcaagagcgcggctgagctgagccagattggagccaagaaggcgcataaggatatttccggagagaggcccatcgtctccgtcaagcagcttggtcttaagggcactatcaatccgaccgatttggatgtgtatccgggacaggtcgttggcttcgccggtctgcttggatctggacgaacggagcttggtcgtctgctttacggcgcggacaagccggattccggcacctatgagctcaagggcaagaaggtcagcatctccgatccatacacggcattgtgcaacaagatcgcgtactccaccgagaaccgtcgagacgaaggcatcataggcgatctgacagtacgtgagaacatgctgatcgccctgcaggcgacgcgaggcatgttcaagccgattccgaagaaggaagccgacgagatcgtcgacaagtacatgaaggaactcaacgttcgtccgaacgatccgaacaagctcatcaagaacctgtccggtggaaaccagcagaaggtgcttatcgcccgctggctggcaacgcatccggatctgctcatcctggacgaaccgacgagaggcatcgatatcggtgccaaggccgaaattcagcaggtagtgctcgatttggccgagcagggcatgggcgttgtcttcatctcgtccgaaatggaagaggtggtcaggctttccgacgacatcgaagtgctgaaggatcgccacaagattgccgaactcgtcaatgacgacaccgtttctcaggaaaccatcgttcaaaccatcgcaaacacgaacgtcaatacaggaaaggaggcatgatgaccgacaagaaagcagagcaggaaaaggactccgtcgtcaagaagctcctgtcttcgaacctcacatggtctgtggtcgcgctgattgtgctcatcatcatctgcaccatctccgaccaccagttcctttctctgagctggaacaagaacaccggaggcctatcgggcccgctgatcaccatgttgcaggaatcggcgcgttatctcatgatcgcaaccggcatgacgctggtgatctccaccgcaggtattgatctgtccgtcggctccgtcatggctgtcgcaggcgcagccgctatgcagctgctgtccgcgggcgtcaacgtctggatggtcattctcctttcgctgctcatcggccttgccatcggctgcatcaacggtgcactggtctctatcctgggactccagccgttcatcacgacattgattatgatgctcgccgggcgcggcctcgccaaggtgatcacctccggccagaacaccgacgccagctccgttgcaggcggcgcgccgcttaagtggatggcgaacggcttcatccttggtattcccgccaacttcgtcattgcattggtcatcgtggcgctcgtcggcctgctgtgccgcaagaccgccatgggcatgatgatcgaatccgtgggcatcaatccggaagcctcccgcatgaccggcatcaagccgaagaagatcctcttcctcgtgtacgcggtctccggcgtgctggcagctgttgcaggtctgttcgccactgcgtccgtgatgcgaatcgacgtggtcaagaccggccaggatctcgaaatgtacgccatcctcgcagtcgtgatcggtggaacctcgctgctcggtggcaagttctccctggcaggcagcgccctgggcgctgtgatcatcgccatgatccgcaagaccatcatcaccctcggcatcgattccgccgcaaccccggccttcttcgcggcagtggtgatcgtgatctgcgtgatgcaggctccgaagattcacaatctcagtgcggaaatgaaacgcaaacgcacacttaaggcacagactaaggtggtggcagcatgacttctgcaacagctactcaggtcaagaagaagacccagaaaatcggtgggcgtcgcattaatgcccagatgattcctaccattgccgcggtggtgatcttcattctgatgatcatcatgggccaggcgctattcggtacctatctgcgacttggtttcgtctcctcgctgttcattgatcacgcgtatctgatcattctggcagttgctatgacattgccggtgttgacaggtggcatcgatttgtctgtcggcgccattgtggccattactgcagtggttggcgtcaagatgacgaatgccggcatctccgctccaatcgcgatggtcgtcatgattcttataggcgtcgcattcggtttgctgaccggcacgctgatcgaggaattcaacatgcagccgttcatcgcctctctggcatcgatgttcctggcgcgtggcatcgcatccatcatctccaccaaggcgcagaccttccccgagaacaacaacttcgatttcatagcgcagaagatcaccatcatcgacaatccgaagatctcccatgatctctacatcaatgtgggcgtgatcatcgcggttcttgtggttatcttcggctatatcctgctgcaccacacccgtacaggacgcactatctacgcgatcggcggttcccgttcctctgccgagctgatgggtcttccggtcaagcgcacgcagtacatcatctatctgacctccgccacgctggccgccctcgcttccatcgtgtacacggccaacatccgctcggccatcaacaccgtgggcgtcggctgggaacttgatgcagtcgcatccgtggtcatcggcggtaccatcgtcaccggcggcttcggctatgtgctcggctccgtcgtcggcgcactggttcgctccaccatcgatccgctgacttccgacttcggtgtgccggcggaatggaccaccatcgtggttggcctgatgattctcatcttcgtcgtgctgcagcgtgcagtgaccgcggtcaacagaaaagaataggaggtgtggtccgaataaaatcatcctgattccttttatcttccttccctgattggaggcggacgagctttctggctcgtccgtctctttttctgtgccacaaaacgtgggggctgatttggacgttgggccaaacgccccatcggttgcacgaggcgcgcgttcgtttcgacggaatcgcatccgttcttcaagacgcgtcggcacctccgtctgattggtcgagcctatgcctacttccatgggcacgcttgacaagcgcggtttgtccggttgaatcggctacactgtgcatttggctattcgatactgatacggcacgtccgccttatgggcggcgttcgagtgcgcgtatgtgtatgccggttggcaaaccttatattccaagcgcatagaaaaacaacgaatcataatggggttgagtccacgatggaacgcaacattggtcggaacatgcaggcaagcgggacaacggatccggtgaatgaggacaatgcggagaatgcgacgcagggcaggagagcgccgcattcggcgccgaactctgatgatgagaggatcagcggtaaactcatcggcgccatcgtggcggtcggctcgctcgccttcatcggtattcttaccgaaaccgtgatgacggtgctgttcccacagttgatgagtgagttcggcgtcgacaccgccacggtgcaatggatcaccaccatctatctgttggtggtggcggccaccatgccgctatcctcgtatctcaatcgcaaggtcgagcatcgcacgctcttcctcgccgcggtgctattcgccgtgcttggctcgctcatcatgatcgtcgggcatgcatttccggtgattctggtggctcgtgtgattcaaggcatcggttcgggcatcgccaccccattgatgaacaacatcatccttgaacagtcgccgcgcacgaaggtcgggcgattgatgggcgtcggatcgcttgtcatcactgtggctccggcgatcggtccgaccgtgggtggcgcggtgtcgagtattctgccgtggcgtgcgattttcgtcatcgtcattccggtggttctgctgatttcgctgcctgtcggtctcaaatgcgtcgagcagcatcgtccgacggaggacgtgcatctgaatccgctgcagttcgtgtcgattgtgctggcattgtgcggtctggtgatgttcctcaaccaggccggtgtggccatttccgccgcggtgtccggcggttccgccatggtgccgggtgttttcgccgtcgcgagtctcgtgatcggtctgggatcgctgctgttcttcggatggtcatcgcgtcgttcgttctcgccgctgatccgtttgggatggttgcgcgaccctatggtgttgctgcatctgatcgcttatatgttgctgccgatcgtcggcattggtttcggctatgtgatcaccaatctcgctcagctgtccttgggcacgaatgcgttcttggctggagcgttggtcctgccgggcgctctgatcggtgcgttctttgctccgatcggcggcaccttgtacgaccgtttcggaccggttcgtccgattctcggagcattcagcctggcgatttgcgggccgatcctgctgctggtcttctccatgcggctcactgcgggcagtcttgccggattctatttcattttcggtctgggatattcattgggctgttccaacatcatgaccaacgcgctgcataatatcgcgccgcagttcacgccggacggcaacgcggtgttcaatacctgcctgcagttcggcggcgccgccggaaccgcattgttctccacagtgctgtccgtggcccaggctggggccggcagggaggggagcgcgtcgttccgacatgccactgcagtcggcggaagctggacgttcgccatcatgatcatgattgtggccgtggcgatttgctgcttggcctcggccttccgtatcgcggcgaagcgtgagtgagttttctccactgtgggcgcaattttgttccccgtcgcttcgaagcggtaggctgtgaaactatagagaacactggaaaaggagacaaggtgagcaaccttagtgcacccctgcccgtcatggctggcgaagacatgccggcaggacccaccgatccgattttcaaccgcctgctcaaggaccgcatcatctggatgggtgaggaagtcaaggacgagatggccaaccgcatttgcgcgcagatgctgatgctggccgccgaggatccgaaaaaggatatctggctgtacatcaattccccgggcggctccatcaccgcgggcatggccatttacgataccatgcagctcatcgagccggacgtggccaccgtgggcttgggcatgtgcgcatccatgggccagttcctgctgagctccggtaccaagggcaagcgtttcctgacctcgcatgcgcgtgtgctgatgcatcagccgtccggcggcatcggcggcaccgccaccgatgttcgcatcaacgccgaactgatcatggacatgaagaagaccatgagcgagttgaccgccgagcagactgggcacaccgtcgaggaaatctaccgcgacaacgagtatgaccactggttcaccgcccaggaggcgttggagtacggctttgtggacaagctcgtttccacccatgacacgatgagcgccaccaagggagagtgaccatggcaagcgaagaagcacagtttgtagcccgcgccgaacgtctggccggaccgaccggtgtggtcggcttccagagggctgcggcgcgtgaggccgcgttcgcaccgcagaaccgttacgttctgccgcagttcgaggaaaagaccccgtacggatacaagaggcaggatccgtacacccgcctgttcgaggatcgcatcatcttcatgggcgtgcaggtggacgacacctccgccgatgacatcatggcccagctgctggttttggaaagtcaggatccgaaccgtgacgtgatgatgtacatcaattcgccgggcggttccatgacggccatgaccgccatctacgacaccatgcagtacatcaagccggacgtgcagaccgtatgcctcggccaggccgcctcggccgcggccatcctgctggccgccggcgccaaaggcaaacgtctgatgctgccgaacgcccgcgtgctcatccaccagccggccatcgaccagggcttcggcaaggccacggagattgaaatccaggccaaggagatgctgcgtatgcgtgaatggctggagaacacgctggccaagcataccggtcgtgacatcgagaagatccgcaaggacatcgaagtggacacgttcctgacggcccaggaggccaaggaatacggtatcgttgacgaggtgctggaacatcgcagctgagcctgcggtggaatgatatcttcacaaatgcaatacccctgccgggtcgcggcaggggtattgtgttttctaaacggcagatatgtgaaacgaagaggttgcgaatgggacgcgtggtcagctacaacgatgcggtgccgagatgcacgttctgcggcaagtccgagagccaggtgcgtaaactggtcaccggttcgggcgcggccatctgcgatgaatgcatcgaattgtgcgtggacatcatttccgaggaacgggacaaggacgcccagctcaatatcctgcaactgcccaagccggcacagatcagcgcctacctcgacaatcacgtcataggccaggagtccgccaaaaagacactttcagtggcggtgtacaaccattacaagcgcgtcaacatggaaatgcgcgagtcgtcgcgaatcggcaaggaacggatgcatggacatgacgattcgttcgagggtgtgcaagtggcgaaatcgaacatcctgctactcgggccgaccggcgtgggcaaaacatatcttgcgcagacgctggcccatgtgatgaacgtgccgttcgtcatagcggacgccaccacgctcaccgaggcaggatatgtgggcgatgacgtcgaaaccgtgctgcagcgcctcatccaggctgctgacggggatgtggcgcgtgcgcagcagggcatcgtatatatcgacgaaatcgacaagatcgcccgtaaaagcggcgaaaacacctccatcacgcgtgacgtgtccggcgagggcgtgcagcaggcgctgctcaagatccttgaaggcaccgtcgcctccgtgccggtggaagggacccgcaagcatcgtgaaatggaaaccgtgcagatcgacacccgcgacatactgttcatctgcggtggcgcgttcgtgggactcgccgacatcgtggcgcaacggttgggcgccagggaaagcggtttcggtgcggcctggcatgaccatgaggttcccaagcgtgagctgcttgcgcaggtctccgccgatgatctggctgatttcggattattgccggagttcatcggacgtctgccggtagtcagcgtgcttgaggaacttaccgaagacgatttggcccgaatcctcgtcgaaccggaaaacgcgctggtcaagcagtaccagaagctattcgccgtcgatggggtgacgttgacctttaccgaaggggcgatacggcagattgcggcgacgtcgattcggcggggtacgggcgcacgtggattgcgttcgattattgagaagacgctggaggacaccatgttccgtcttcccagcatggaaggcgtcgaagaggtggtcgtcgacgaagccgcagtcaccggatcgggcactccgaaactattcaaggtgtcgacgcagaaaattcctcgtctacgtgaggcgtaaggccgaaaactcctgcgacacgccgagattttgcctggagttcatttgggtgtatcttattcgagttgccgaaaacaagacaacgttgcgcgagtagcccagcggattagagcagctgactacggatcagcaggtcgcggccgcggtcgccggcgggcaggtcatagctgacgtgacgcccaactgcgtggcaacaaccaaacaataacccaatccacacaaagtagagcacagtctcaagggtggttctggttacaagccagaaccaccctttttcaaatatttgatattccgataaagtaaattgaggtacaaaaaagagacgatgacgtcgacaccctaacgaaagagaacacgatgaagaagattcccgtcctcgcctgctcgtctgtagctattcttgcgcttggactcagcatcgctttaccatcaggttttgctcaaaacgtcgaaaatacaacaaatcaatctgttcaaacaatctcagagaatactatccactccgaaactgcttcaagtggtcctgtcaccctcaaagcttcatgggatgagacaaaactcggcagtccaactactttccatgtggaggcgacaggcggctctgataagtacatgttccgcatggatgcaccttcgtatagtagtccagatgaatacgctttcgaaagcgtcgccgatccaagccgcagcgactggacgaaatacacctccgaaaccaccagccatgactatgaattcacaatgatggcttccggaacatacaacttccacttctacgtcatggataaaactgcaggagtttattatcttcgcgtcaactttaacatccaggtttcagacccaaattatccatcaatcaatgagatagtttccgaagcggtggctcaaagcgaaaaggaaactgacggaacggaatatgctaaagccgtctggttgcatgattggcttattagccggatggaatatgactccacgttgaagtggagcagcgcggaaagcgcactttcccgaggtcttggcacatgccagtcctatgaatccgcatatagcaagctgcttaccaaggcaggcattgaaaacgtcgaaaccagagacaccaaggatgcgcatacttggaacgcggtaaagattgatggagactggtatcaaatcgatgccacttgggatgacagcaatgacaactggtacggctttgatcagcgccatctttatttcgggctcactgatgagcttatgacgattgcgcatccgggacatgagtcgatgtatcagacagaaggctatgcacaacgttccacttctctgaaagataattactacgttcgttccggagaggccgatcaatgggcagataaatatgcggaacgcattcagaaacatcttgatgcattggacaaaacattcactgttgatgtcgacaatgctaacgatcccccaagcattagaaacatcgtcaacggaatcattacctatgcaatcggccaaaagaattggaatgctgatggcagagatgtagcgctcactgtgaaggtaaatgataaagtttttgaattcacggctcaatatgctgatattccggtcgagtcggtctcgatttcgggtgacggcgtgagcaacgggaagctgagcctgaagtccggtgcgagcgtgcagctgacggcgacggtcaggcccgacaacgcgacggaccggaaggacgcatcgtttactacggttcctcaatcaccattatcgcccagggggagcggttcgccgggtatcgccgagcgctcgcggacgcgggcatccccttcgacgagcagttggtcgtcaacgtggaagaggccacaaacgccgcttcggaagccggtcgcgtgttcgacgagatcaagccggacggcatcttctgcttcaacgatgtgcgcgcgaccttcatctacgaggcggccagagagcggtcggtcggcatcggcacagacgtttccgtgatcagcatcgacaaccagccgctcattacggacgtgctcaaacccgcgttgaccaccttggagcttcctcactacgaaatgggcttcgaagcggtgcatcagctggtcgccatgatcgacgatgaagccgccacggaaagccttgcacgcagtgaggattcgatcaggcgttcggagaacggcccgatgacaccgttgcgttgccgcatcatcgaacgcgattcgatcgtttcctgacggcactgcgtctttgagtatttccatccattttccatattcatttcacacgtgtagaggggtctactatgtcgaatacctattccatctccatcgaaaccggcggctaccggcagctcgatctgttcgccgaacgctgtggcgaggggaacgccgtcgtcaccgttgcggacggcaacggcgtcgcaatcgcggcgcacaccatgcccatcgccgaacgcaggcatcatttctccattgcggtgccgcagaaatccaccgtcaccgtggcggcaagcggcctggttgtacgcttcggctacctttccgaatgcgatgacctgcttgacaacggcgttcgctacgtgaacatgaatccaagcgacaccgattggcctgcacagcccacgctggaacagatctacaaccgtttcgggcgttcgggcgcgcatttcgaaccgttcgcacgttggatgaacgatccgaacggcctgtgccagttccaagggcgctaccacctgttcttccagctcaacccgtatggtttcggctgggacaatatgcattgggggcacgcggtaagccgtgatctggtgcattggactcatctgccagtcttcctggaaccgcagcccgaactgcacaccgacgagcgtatcgtcggcggcgcgttctccggttcggccgtgaccgtggacgagcatgacaatccggtcgccggcaacgaggcaaacgccatccgcctgtacctgacccgtcatctggaaacccgcggcgacgaatcctccgtcaccgaataccagaccacctgcctgtgcgaggacggcgtgcatgttcgcgtggaatcgccggtggcgctgcgtgcgaatgacgattttggctatgacttccgtgatccgaaggttgaatgcggcatgggcggcgaggcgctcgacccggatcgtgcctatatggtaaccgccaccaatctgccggtatcggaatttggcgcagacgccgccgatagtgcggttcccggcatcagcacccagaacaccggcggctggttcacttattctcctcagggcaagccgggggtcgaccagccgaacaacgccaccgttcccgccatgacattgttctccgcgaagaaaccgctcaagcgcaatgtgacatggcgctacgaagggccggtgctcgccgatttcggtcatcagatcgcacgcacctacgaatgccctgacctgttccaggtcgacggcgtgaccgttgccgtgggcgcgctgatgcattaccgcgacaagcagggacgtttccagcaggtgcgctggtatgccggcgacttggtgaataccgataatggtccgaaactggatgtcaaggccagcgactggtgcgatttcggcaccggatattacgccacgcaaagcttcgccgacgataacggccgtcgcatcgtattcggctggttcaccgattttccggagatgcgtgtcgaacagccgtgcctggccaacggcatgatgtcgctgccgcgcgaattgcatgtgcgtgacggcaggctgtacagcaagccggtgagcgaagtgtaccgcgagctgctcggcgagcgtcttgccgtgcacggcgatggcggggatatggtcgttacggctcccggcaacgcatactatgcgaacgtgcatctggcggatgatgccgatgccatcatggtgctggcgaagggcgtcaacccgcaggacggaaggccgaccgaactgctgctgcagcgcactgatggcgtgacccgcctggtggccaagggcactgcggtggaggatgtcgacttcgacagcggcatcaccgatgttcgccaggtggaggtgttcttcgaccgcaatgttgtcgaagtgttcctcaatggcggtcagacggcaggaagcatgctgttccaaggcgctgatggcgacggtgagcttcgcatcgcgtcgtccggcaagatcgatgcggttgatgcgcgtgcattgaacggtatttggcgctaagacgtagagccgtatccggcggccccgttcctgcgtgttccttgtgacacggcgggtgcggggccgctgccgtatgtgcaggggtatgtacgcgatatgtgcgagatatgggcacgatatgtgcgctgcgttgtaatttgccggcggatgttgcatgtcatgctgtgttgcgacacggcgcgggtgaatccgtgggcggtgacgacctaggtaaacgtttgactactgacatgcgcgtgtggcgtctcaccatgtaatgcgaaaagcgggagagaggggtgttttggcacgtgcctttcctatactggagggcacgtccggcaatttgccgagacggtaactggatattcacacctcacgtttagggagttccatgaacaaggcaatcatcaccgtcgtcggtcaggatactgtcggcatcatcgcccgcgtctgcacctatctttccgcgcaccaggtcaacgtgctcgacatctcccagaccatcatcgacggtttcttcaacatgatgatgattgtggattattccaacgcggacgaggaattcggcacagtcgtcgacgacctcgacaagctcggcgaggagatcggcgtgcgcatccgctgccagcgcgaggagatcttcaccaagatgcaccgcgtctgatccgcggcacacgtaagccatgcaagcaaccgaagccacgaatcgtaccaatcgtaaggaaaaaccatgctgaatatcatggaggtccacgagaccaacaagatgatcgagcaggagaagctcgacgtgcgcaccatcaccatgggcatcagcctgctggattgcgccgccgacagcgtcgacgaggtctgcgagaacatctacaacaagatcaccacgtacgccaaggacctcgtgtccaccggccaggccatcgaacgcgatttcggcatcccgatcgtcaacaagcgcatcactgtcaccccgatttccctggtcggcgcaagctcctgcaagagctccgaggattttgtcaagatcgcgcacgcgctcgaccgcgcggccaagaaggtcgtcgtcgacctgatcggcggctactccgcactcgtatccaagtccatgaccccggccgaggagatgcttatccggtccctgccgcaggcgctttccgaaacggacatcgtgtgctcctccgtgaacgtgggctccaccaaaaccggcatcgacatgaactccgtcgaactgctcggccacatcatcaaggacattgcgcacgccaccgcagacaacgactcctacggttgcgtgaagttcgtggcattctgcaacgccccggacgacaacccgttcatggccggcggtttccatggcgtgaccgaaggcgatgcggtcatcaacgtcggcgtttccggcccgggtgtggtctcccgtgcattggacgaggccaagggcaaggatttcgagttcttgtgcgaaaccatcaagcgcaccgcgttcaagatcacgcgcgtcggccagctggtggcccaggaggcctcccgccgactcggagtgccattcggcatcatcgacctctcgctcgccccgacccccgccatgggcgactccgtcggcgaagtgctggagaagatcggcctcgaacaggtgggcgccccaggcaccaccgccgcgctcgccatgctcaacgaccaggtgaagaagggcggcatcatggcgtcctcctatgtgggcggcctgtccggcgcgttcattccggtctccgaagacaagaacatgatcgacgcggccaacaacggctgcctgaagatcgaaaagcttgaggccatgacctgcgtatgctccgtcggccttgacatgatcgccatccccggcgacaccaccgcggccaccatttccggcatcatcgccgacgaggcggccatcggcatggtcaaccagaagaccaccgccgtgcgtgtaatcccggtggaaggcaagggcgtgggcgagatggccaacttcggcggcctcatgggctacgcgccgatcattccggtgaaccagaccagctgcgaggctttcgtgacccgtggcggccgcattccggcgccgatccactccttcaagaactgacgttcttacgaaggagcccgaccttcctgcacggagggccgggctcttttgcgtttgtaaaactgtttttacttaccgccggcaaagttcaactgtcgccaggcttcgtagatggcgatggaggcgcagttggtgagattcaggctacgcagcgaaggacgcatcggcagacgcacctgctcggccacatgcgggccggccatgatgtccatcggatcggggatattgccaggttccggaccgaacagcaggatgtcggtcggcttgtattcgatgtcggtgtacagcttggtggcgtgcgcggtgaaggcgatgatgcgcgaatccggcatcgattccaccagatcctcgaaattcgggtgcagcaccacatgcgccatgtcatggtagtcgagccccgcacggcgcagcttggtatcccgcagattgaaacccaaaggttccaccaggtgcagaatcgttcccgtcacggcgcacaggcggatcgcggaacccgtgttgcccggaatacgcggggagtagtagcacaggtgcggggtggaggtctccgccttcgccgcgtccttcgcgctcagcatcgcgtccaccacggaaatcggattgccgtgcgcgtcggtcaccagttcgtccgggccgtaattggacttgcggtacccgtattcgaacatcttctcgaccttggcttcggccgcctgcgtctcggcgtcgcgcgttgcgccctgcgcgttatcggtatgttcttcgttcgtcataaatgctaagaataggaacgatgaacgacacgaacaccacatacgacaccgccgtacgtgacgccgactttgacgactttgccgattccgccaccgccgtcacctccgatgcttccgatgctgacgaaatcgcaacgacgctcgcgcaatggtggcagaccaacgcgcgcgacctgccatggcgattcggccgcaccacaccgtggggcgtgctcgtttccgaagtgatgagccagcagacgcagatggtccgcgtcgtgccgtattggaccgcatggatggaccgcatggatggaccgatggccggacgcagccgcgctcgccgacgccccgaaatccgacgtgatcaccgcatgggggcggcttggctatccgcggcgcgccctgcgattgcaggaatgcgcgcacgtcatcgcatacgattacgccgacgagctgccgcatacgtacgacgaattgcttgctctgcccggcatcggtgattacacggcaagcgcggtgctgtcgttcgctttcggcgaacgtatcgcggtggtcgacacgaacatccgccgtgtgctgtcacgtgcgttcgtcggcgtcgaatcgctcggcggcagcgcaagtcccgcggaacgcgcgctggcgaaacggctgctgccggacgatgattccgcgaaatgccgtcgtttcgatcgcccgtccgtcgtgtggaaccaggccgtcatggaactcggcgcgacggtgtgcactgcgaaatcgccattatgcgaagcctgtccgatcgccggaaaatgcgcgttcctacgcaacggaagaccgggattggggcagcggcgtacgcgaccacgccaacgattccaaggtacggaccggcaggtgcgcgggctggtgctgaacgcgctgcgcggcctgccggatggcgagacggtgcttgatcgcaagagcgtcgaacggctgtggaaagaccacgtgcagctggacaaatgcatcgcgtcgcttgacgaggacggtctgatcgaaatcctgcccgggggaggggtgcggctgccggtgtaacgtacacggcatgcgtggtgcgtgcggccgcggtgccgcacggaggatgacacgctagactgggagccatggcttacaagacctccccgcggaccggtaagaaacgtacgaaacaacagcaggcgatgtatcgccgccgccgcatcgttttcggtatcgcgacggtgctggtgctgagcttcatcgtattctgcctgtattcgctgacgcagggcgtcgtcgctgtcaaccgcgaaatccaccatgccgatgtttacgcgatctcccgcaaggaggtgccgtcgccgacccaacagcagaaaagcagcgttcccgattgcgacgcatccaacgtcgcgctgtcgcttactccggccgcatcgagcttcggtgtgggcggcacgatggacttcaccgcttccgtgaaatacaacggttccggcaaggctggctgtctgatcgacgtgtcccaggcgggcatggtgctgacgatcaagtcgggcaaggacgtggtctggaaatcgaacgtatgccccgtggacacggattaccggctgatagccaagggcgacgaggtcaagcagacgatcacttggccgggcgtgcgttccggcagcgaatgcgccgacgcggcggacctgccgaacgtggaccgtggcgtgtattcggcccaactgtcggtcgaaggccatgcgaaaaccaagtcggaaccggtcggcatcacagtggaataaaatctacaggttatgttattctaatgactttgcgtagatgcgtgtcatatagcgggcacgctgacaaggaagaggcgcccgcgtattaggcatatggtggccaatgagagcgcttccggggaaacatatcgatacgattagcgagcgataaggaacgtccattggctgaggctacgacgaacaccaccaccatcatcgcacgcgccgaccagcatgatattgatctgcacaaagcgtcggaccgtgtgaacttcggctccatccgcgagcccattgatgtaccctacctgttgggtgtacagactgacagctttgactggctcatcggcaacgagcgctggcagaagcgagtccaggaggatctggagaacggcaccaacaccgtgccgcacacctccggtcttgatgaggtcttccaggagatctccccgatcgagaacttcgctcagaccatgagcctgaccttctccgatccgtacttcgaagagccgcgccacaccgtgcaggagtgcaaggagaaggattacacctactccgcgccgctgtacgtgaacgccgaattcgagaacggcgacaccggcgaaatcaagtcccagaccgtgttcatgggcgatttcccgctgcagaccccgcacggcaccttcatcatcggtggtaccgagcgagtgatcgtgtcccagctcgtgcgttccccgggcgtgtacttcgaccgttcccaggaccgtacctccgataaggaggtcttcggcgcgaagatcatcccgagccgtggcgcatggctcgagttcgagatcgacaagcgcgacgtcctcggcgtgcgcgtggaccgtaagcgcaagcagtccgccatcgtgttcctcatggccatcggcatgaccaaggatgaaattgccgacgccttcaaggactacccgctggtcatggacgctctcgccaaggagaccgtgcagacccaggacgaggccctgaccgacctgtaccgcaagatccgtccggccgacaccccgactccggaagccggcaagaacctgctggactccttctacttcaacaccaagcgttacgatctggcccgcgtcggccgttacaagatcaaccgcaagcttggtctggaaaaggacgtcaacgaccgcagcctgtcccgcgaggacatcatcgccaccatcaagtacttggtcaccctgcatgcgggcgagaccaagttcccgggcaagcgcgacggccaggacgttgacctgcgcgtggacgtcgacgatatcgaccacttcggcaaccgtcgtatccgccaggtcggcgagctgatccagaaccagctgcgcaccggtctgagccgtatggagcgtgtggtccgcgaacgtatgaccacccaggatcccgaggccatcaccccgcagtccctgatcaacatccgtccggtgaacgccaccatcaaggagttcttcggaacctcccagctgtcccagttcatggaccagaacaacccgctggctggcgtgaccaacaagcgtcgtctgtccgctctgggccccggcggcctgtcccgcgaccgcgcctccatggaagtgcgagacgtgcacccgtcccacttcggccgtatgtgcccgatcgagtctcctgaaggcccgaacatcggtctgatcggctccctggcaaccttcggacgcatcaatccgttcggtttcatcgagaccccgtaccgcaaggtcgtcaacggccacgtcaccgacgaagtcgagtacatgaccgctgaccgcgatgccgagcacgtcatcgcccaggccaaccaggagctcgacgagaacggcaacttcgtcaagaagcaggcccttgcccgagtcggcgaagaggaagcggtcgatgtgccggtcagctccgtcgattacatggacgtctccccgcgtcagatggtttccgtcggcgcctccctgattccgttcctggagcacgatgagggacaccgagcgctgatgggcaccaacatgcagcgtcaggccgtgccgctgatcgaatccgagcgtccgctcgtgggcaccggcgccgaatggcgcgccgccgtcgattccggcgacgtcatcctggccgagaagccgggcgtggtgacctacgtgtccgccgacatcatccgtaccatgaacgacgatggcaccaccagctcctacaagctggccaagttccagcgctccaaccagaccacctgctacaaccaggtcccgctcatccacgacggcgaacgcgtggaagccggcaccgtgctggccgatggtccggcaacccagaagggcgagatggcactgggcaagaacctgctcatcgccttcatgccgtggaacggctacaactacgaggatgctgtgatcatctcccagcgcctcgtgcaggacgacaccctgagctccatccacatcgaggagtacgagatcgacgcccgcgaaaccaagctgggtgccgaagagatcacccgcgacctgccgaacgtcggcgaggacgcggtggccaacctcgacgagcgtggcatcatccgcatcggcgccgaagtcgaagccggcgacattctggtcggcaaggtcaccccgaagggcgagaccgagctgactccggaagagcgtctgctgcgcgccatcttcggtgagaagagccgcgaagtgcgtgacacctcgctgcgcgtgcctcacggcgagaccggcaccgtcatcgcggtcaaggaaatcacccgcgaggatgccgaggaagacggcgacgaactgccgaacggcgtgaaccagatgattcgcgtctacatcgcacagcaccgtaagatcacccagggcgacaagctctccggccgtcacggcaacaagggcgtcatctcccgcatcctgccggaagaggacatgccgttcctcgccgacggtactccggtcgacatcatgctgaacccgctgggcgtgccttctcgaatgaaccttggccaggtgctggaattgcacctcggctggatcgcgcacgccggctgggacatctccctcgacccggatgccgaggccgcttggaagaagtacgtgccgcagggcgccgaaaagggcgctccgggcactccggtggccaccccggtgttcgacggcgtccgtccggaaaccatcaagggcctgctcagctgcacccttccggaccgcgacggcaacaagctcgtcggccccgacggcaaggcgaccctgttcgacggccgtaccggcgaaccgttcccgaagccgatctccgtgggctacatgtacatgctgaagctgcaccacctggtcgacgacaagatccacgcccgctccaccggcccgtactccatgatcacccagcagccgctgggcggcaaggctcagttcggtggccagcgcttcggcgagatggaagtgtgggccctcgaggcctacggtgccgcctacacgctgcacgaaatgatgaccaccaagtccgatgacgtcgacggccgcgtgcgcgtctacggcgccatcgtgaagggcgagaacctgccgccggcaggcatcccggagtccttcaaggtgctgcttaaggaaatgcagtccctgtccctgaatgtcgaagtgctcaacgccgaaggcgtggccatcgacatgaaggacgaggatgacgatccgtccacttcctccgatgacctcggcttcaacatcggcgcgcgtcctgacgccgccgccaaggaagaccaggttgccgaggagcccgaattccagtgattgaaaggattggccgcgctgcagcacagcgtgcagcgcggccaatccccgaacaacgtgataagcattaagaatcgatagacaggacaatagagtgctggacgtcaacgaatttgacaaactgaggatcggactggccaccgccgacgacatccgtaactggagctacggcgaggtcaagaagccggagaccatcaactaccgtaccctgaagccggagaaagacggcctgttcggcgagcagatcttcggacctacccgcgactgggaatgcgcctgcggcaagtacaagcgcgtgcgcttcaagggcatcgtctgcgaacgctgcggcgtggaagtcaccaagagccgtgtgcgtcgtgagcgcatgggccacatcgagctcgccgctccggtgacccacatctggttcttcaagggtgtgccgtcccgactgggctacctgctggacatcgcgccgaaggacctcgagaaggtcatctacttcgcggcctacatggtcaccaaggtggacgaagagcagcgtcatcaggacctgccggacctgcagcaggagttcgacaacgagatcgccaacctcgagaagcgccgcaacgccgaaatcgaggagcgcgccaagaaggtcgaagccgatttggccgagctcgaagccgaaggcgaagccaagggctccgcacgtgccaagctgcgcaacagcgccgagcgtgaaatggccgccatccgtacccgctacgacgagcagatccagcgtctgagcgccgtgttcgaccgcttcaagaccctgaagccgggagacatggaaggcgacgtcgacctgtggcgtgagatggaagaccgctacggcgattacttcgaaggctgcatgggcgccgaagccatcaagaagcgtctgcaggacttcgacctcgaggcagcctccaagcagctgcgcgaagagatcgacacgggcaccggccagcgcaaggcccgcgccctgaagcgtctgaaggtcgtcaacgcgttcctgaccaccggcaacaagccggaggccatggtgctcgacgtgatcccggtcatcccgccggacctgcgcccgatggtgcagctcgacggtggccgtttcgccacctccgacctcaacgacctctaccgtcgtgtgatcaaccgtaacaaccgtctgaagcgcctcatcgagctcggcgccccggagatcatgctcaacaacgagaagcgcatgctccaggaagccgtcgactccctgttcgacaacggccgtcgtggccgtccggtcaccggcgcttcgaaccgtccgctcaagtccctgagcgacatgctcaagggcaagcagggccgtttccgtcaaaacctgctcggtaagcgtgtggattactctggccgttccgtgatcgtggtcggcccgtccctgcgcatgcaccagtgcggtctgccgaagccgatggccctcgagctgttcaagccgttcgtcatcaagcgcctcgtggaccagggcttcgcgcagaacatgaagagcgccaagcgcctcgtggaccgtgcggactccgaagtgtggggcgtgctcgaagaggtcatctccgagcatccggtgctcctgaaccgtgcacctacgctgcaccgtctgggcatccaggcattcgagccgatcctggtggaaggcaaggccatccacctgccgccgcttgcctgcgccgcattcaacgccgacttcgatggcgatcagatggcagtccacctgccgctgtccgccgaagcccaggctgaggcccgttccctgatgatggcttccgacaacatcctgaagccggcagacggccacaccgtgaccatgccgagccaggacatgatcctcggtctgtactacctgaccaccgtcatcgacggcgccaagggccagggccgcgtgttctcctcgctggaagaggccgaaatggcgctcgacaagcacgagatcgacatgcaggccaaggtgctcatccgccttccgcaggacttcgtgctgccgaaggactgggagccgggcgaggtcaaggtcgtcgatccggaaccgggcagcccggacgtggtcaaggaggagcgtttccatgacggctccgtcctgttcgccacctcctacggccgtatcctgttcaacggcaccttgccggtcgactacccgttcgtcaacgagcaggcgccgaagaagcgtctgagcaagatcgtcgacgacatcgcgacccgttactccaccgctcaggtggccgtgacgctggacgccctgaaggatctgggcttcacccgcgcaccgtggtccggcgtgtccttcgcgttctccgacgttatccagccgccggaactggacgagtacatcgaaaagtacgaaggcgaagccgacaaggttaacgagaactacgaaatcggtatgctcaccgaagaggagcgtcgtcaggaactggtcgacctgtggaccaagtgcaccagcgaggtctccgaggcggttgaggaacacttcgattccaagaacaacctggccatcatcgtacagtccggtgcacgaggaaacatgatgcagatcaaccagatcgcaggtatgcgaggcttggtggcaaacccgaagggcgagatcattcctcgaccggtcaagtccaactaccgtaagggcctgtccgtgctggaatacttcatctcccagcacggcgcgcgtaagggtctggccgataccgcactgcgtaccgcagagtctggctacctgacccgtcgtctggtggacgtctcccaggacgtgatcgtgcgtgaggaggactgcggcaccaagcgcggcctgaccatgaaggtcggcgaacgcgatgccgaaggcaatctgcacctggtcaaggccgccgacggtggcccgtactcccgtctgctcgcggccgacgtcatcgacccggccgacggcgagaccgtgctgtacaaggccggcgacgccctgtccatggacgtgctcaacgatctcgttgcccacggcgtggaagaggtcaaggcccgttccgtgctgacctgcgaatccaagcgtggcgtgtgcgccaagtgctacggctggtccctggccaccaacaagctggtggacgtcggcgaggccgtcggcatcgtggcggcacagtccatcggtgagcctggtacccagctgacgctgcgttccttccactccggcggcgtcgcttccgcttccgatatcacccagggtcttccgcgtgtcaccgagcttttcgaagcccgtaccccgaagggcgaagctccgatcgcggagttcgccggcgtggtcaaggtggaagacaccgagcgcggccgtcaggtcaccctgaagccggacgacgactccgtcgagccgatcgtctacccggtgacccgtcgtgcgccgatgctggtcaaggacggcgaccatgtcgaagccggcacccagctcatcgaaggctccgtcgacccgaagaagatcctgcgcatcctcggcccgcgcgccgcacaggtgaacatcgtggaggaagtgcacactgtgtaccgctcccagggcgtggatatccacgacaagcacatcgaggtcatcgtgcaccagatgctgcgtcgcatcaccgtgatcgactccggcgacaccgacctgctgccgggcgaactcgtggacaaggcacgcttcaaggccgccaacatggaagccgtgaagaacggtggcaagccggccgccggccgtccggagctgatgggcatcaccaaggcttcgctggccaccgattcctggctgtccgcggcctccttccaggagaccacccgcgtgctcaccgaagccgccctgaaccagaaggtcgatgacctgaagggcctcaaggagaacgtcatcatcggtaagctcatcccggcaggtaccggcctcgcccgttaccgcaatgccacggtggagcccgacaaggccatccgcgacaccatctacccgaacttcggtttgggcggcgaaggcaccgacagctccttcggcgacaccgacctgtccgatgtggacttctccaacatcgacttcggcgacctgaagctgggcgatgacttcaacccggatgacttcctggacgacaacggcggccagaccgatctgggcgacaccctgtgagattcccctcacgatagtcgacagacgaatcatctgacatagcgaaaggcggaaccgaccaataccggtcggttccgcctttcgctatatctatatgtcgtggaattgcgaggttgtggattaatcgcgggggagggtttcgcagtcgtcttttgacgttacttgatcttctccgaaagcgtggtttccagatccttcaacgaaccgctgagatcggcctccttcgcggccttttgcaaatcggactgatccagggtcggcgaatcgatgtcggacatcttcgcatgaagatcctgaagcttttcgtaatcggcggacccatactcgatatcgttgagattcagatcggccatctgatccacaatgtccttcttcttgctgacgctttcctgcatatccgcgccatactcggcataggacttgatgggaaccttggccagatcgccggcgtcggcggcacagctttcgagcgccttggaaagatcgcgatagtacgaagacatgtcggcggagtcgaatttcggcagcttcgtgcaggtatgcgtcatcttcatgagcgcgggcatggtctgggccagatcgttcatgtacctctcgtatttcgcacggtcccactcgaacgtctcgtacttctccttgacgtccttgtctttttttcacggccttcatggcagccagcttgtcgctgtcctgcttgaaggtcttcaacttcttcttgccctcgtcataagcggaggatgaatcgttgtccgttgcgctcgccgccgagctgaattcctcattgatggctgtatagctgctttccaacgcctgcgtttggaccagcgcttcctcgtaatcggaacggctgacgcgattcgtaaggaagaacaccgctgccagcgcgatgacgacgactgcggccaccgcgccgatgataatggcgaccggcggcttatttttggccgcggcgccggcttgctgggaaggaaagttgccgggcattggcggttgcggctgaccgtattgttgcgattgggcatattgtggcatcgcaggctgtggaaccgccggttgagacgcggtgggctggggcatggcgggctgaccgtacggcatcggccgcggctgaccatactgcggcatcggcggctgaggctgtccataaggttgcggttgtccgtattgctgcggctggccgtacggcatgggttgcggctgtccgtattgaggcccgcccggctgtggctgactgtagtttggcgcctgcggctgcggaggctggttatactgcggttgcccattctgcggttgaccatacggaggagtgttcgccatgtgaaaagtccttcttatcctttttccttttttttgaatgtcgaatccgtgaacacggagggaaacatcgacgtgtccgtctcttttgacgagttacagcataatattttgagacggaatatgcgagcatcgtattgcagaatgagtatcgtcagacggcatggacgtcaccttcctacaatgggaatatgagttttctaccttacccgccgccgcccgaaccagggtggtatgacgatgacgtcacggtgatggcgcaacccacagccgaacccgtcgacaatgccgccgattccttggaaacacgcgaacggctcgccgcacagaacgagtcgggcgaccacgatatgcaggatgtttccgttgcgaagggcgacgctgccgtttcggacgaggacgatatcgactgggacggcaccgtgctttccgaagccttcaccatgaagcagccgaagcacacgtacgtgctggacaacgagcagaccggacagcaggtgatcgtggatatgggcgtgctccttggccgcaagccttcggccgaagtgcccgccggcgccaaatcggtcaagctggaggatccgacgcgcacaatctcacgcaaccatgcggcgatcagcttcgaccaggatggcacgctgtggatagaggattacggttcgctcaacggcacgtacatcatccaagacgatgtcgaaaccaaagtggaacacaagccgatgcagctggaggcgccatgcacggtgcgtatcggcgaccagttcttccaattccgcaaacagtgagggcgtttgtcagtgaagacacgattacgctgacggactgcgttgacgatttgtgttgacagcgtcggcgcggacggttagcggtaagacgataaggggttgtcacggagattcccgcgacaaccccttatgtttcaaatggtctgataatcggcgttagctcactgctggcgcagacgaatggccgcgttgatggccgaatcgttcaactggccaagccaggcaagcaattccggatagatgtacggattgcgcgcaagacacggacgaagctccggcgcttcgctggcgatacgggccatcagcatctgatcggtggtggtcatggccagttccgcggtgaaccccgcgtctgccggcgattcctgggccgcggcatactgctgttcggcatactgctgttccggttcgttctgcggctggctcgatgaataatcggccacttcggacaaatcggcgggattcatgtatgggtcgacatactcggtcgaagcctcgttagacgccgcataggcagcgtcctgaccgtattgctggttcaccggctgttccggctgatactgctgcttctgctggaactgttccgccactgccggctgatactgctgttccggctggacctgttcggcaatcggttcggccattggctgggccgtcggttcggcaatcggctgcggctgcacgccattttgcggaaccggccagcccatcgccaccagctgctggcgggcgcgctcatcgccgaattcggcgacccaacgcttcagacccgggtacgctcgcggattggcaacgacattcgcaccgaattccggattctcgtacgcgattttcgccaggaacacgggatcggcgttcggatcctgcacggccgccaccgcggcatcgaaatcgaccatcatgatctccttgtctcgtggtctgtaaccatcttattgaatgactcgtaacgtttgcaacgtaccgtccagcgcatcgtcgatatcctcgtcatcgccgatcttgctgacgttccaatcctcgtcgcacggcatatcggaacgcatatccaccacgatgacggtgatgttgtcgcggccgccggcgttcagcgcggcgcgtaccagcatgtccgcggccatctgcgggtcggcgtacgccgccgcgatctcggcaagctgctcacggccgatctgtgcatgcagcccatcggaacagatgatgaaccgtccgtccgcacgcgcggcgtaccagtcaggctggatgccggcaggcgcgccgacacattgcgtgatgatgttgcgcggaatgcaacggctcgcctcatcgggcagcatctgccccgaatcgatggcgttctgccgttccgaatggtcgcgggtgatgcacgtcagcgaatccgccagccacgcgccattgccgtcggcgcgcatatggtacgtgcgggaatcgcccacattgacgatgtaacaccgttcgtcggaacatatcgcgtcatcgccgacacgcgtcggcagcagcacgccgctgatggtagtgcccgcaacgccgccgagctgctcacccagacggagcacctcctgctgggcaaggatcagcgtttcgtcaatcgcgtcaagatcgcgcgtcggcagttcggccaaacgcgcgaaccgttccgcaacatcggaactggcctgcttgccgcccttgccgccacccatgccgtcgcacaccacatacacgccgtggcttgcgcaggcgctgtcctggttgtctttcctacgcaagccgatattgctgttcagaccgacctcaatatgtttgacgttcatgagtcccgccctttcacaccgattttccgcaagcggattttccggaagtggaacacgtccgcaagcgatagtttcgcccgccacctgcggaacgtcggcagcgagccgagcatgaactttcgttcttcggcgatgtcatgccagtagcgttccgcatgctcctgcgtgatatcgcctccggagaaggccgcgtaatcagcctccctgcccagctcgagcagtgtatcggcttcgaagcccatctgttcggcgatggcctgcgcctgctcgtttctggtgccttggacgtcaaggccgctttgccgggcaagcgccgcgaccgcctgccatccggcagcgacgcgttgcgatgcgctgccatgcctgcgcgcccgagccagggcgatcgccttgatggcgagcagcaggccgcagacgatgagcaccgtccacagagggctgccgtagatggcgacttttctgacgattctgccgaaacgctgccagaacaggctcgtcggcgtctcgtcggccatgctgccgccaagcgacgttttgcccttggcttggttgtcgtcacgcagcggatcggtaagcggcaccggaggctgacgcaccaaggtctgcggattgggcggagtgagattctggttctcgtcgggaaccttcgtttccttcggtgtcgggtagaacgccacccatccgtaaccgtccagcttgatctccacccaagcggtcacatcgttgccggtgaatttcgtggtggtggttttgccatgcttctcggtgcggctgtcactgatctcgccctcgtcgttcttcggcaggaagcccagcactacgcggctcggcaagccgagactgcgggccataagcgccatcgcggaagcgtattgctcgctgtctccaaccatcgcactgccggcgagcagctggtcgatgcgatagttgccgtgaccggccctggacgggtaatcgccattcaaaccatgggagaaccagccggattccctgagcttgtcggcaagagcctgcgcggcctcgccgcccttggactggccgcccgcaatcgcggtggccagcttatccacgcaatcgggcacatcttccgccttgggctggctgatggaggaagcattcgccttggcgatctccttatccgtcggcgtccgcggaatgacgccggtttccgtataggacaatcccggagaggtgcgcgaagggtagatcgccgacatggtgtcggtgttgtagtagaacgaatcggcgtccgacgatgtggcgaacttcacgctggaagccgcgccggccatcggcagccaatagtcgctcaaaccgtcatcgaccgtgaatttcgcggtgaaccgcttgccggcggcgttgtttgcgatggaatcgcccacacgatggtagttggaggaatccgaagccatggtggaatcggacaggttccacacattgccgtcgaaacggtccataaccgccaaacgcaccgtggaaccggccggcagatcgtcgacggtcagcagcacatcgtccttatggttcttgatatacgaacgcatgccgctcaacgggctggtgtaatcgtacgggctcagcggcggatcataatggtcgcgcagaatggtgcggttttgcccgaccaccaagcatccgccgatcgccacagccgaagccagcagcacgatgactacggaactgagccaacggcccaattccaacagtttccaacgcgcgctgacccaaaccaccagcacgaccgccataatcgtgccgatcgccatacggtagaagccgctcgacgtgccaagcagcgcgcagatcgcgagattcgccacgacgggaacgaccgcgaccatcgtaagccggccatcctccgcaaccgcgaagataccggccagcagcgcggtccacaggcagatcgtccacacggcgagcagcgagccgtcgccggtgccggtcggcgggtcgatggccagcaggtatttgaacgagccgagcatccgcatccacccctgcgtcaacgtgcgcaatgtgggaatgacatgggcgatggtggtgccattcaggaagatgaccgggccgaccaccagctgcgcacacgccatgaacagcatctgccaccacaggcgcaacgcgggaacgagaccggcaagcgccacgagcgagccgatgatggtggcggggattgcggcgctcgtccaagacagggcggagccgtatacgtcgatgaggttgctggctgcggcgatggtcagcagggcggcgaccgtgaggcttgcgtattgcgcggcgtgtggctggttggtgttgggcatggctggggacttgccgctgcgggacatccagatgacggagtgggtggagtccgcccatgagccggtgcctgtgccggtcgccatgccagtgttggtgttggcggagttggtgcctgtgccggtgaggttgccggtgaaattgccggtgttggtgaatgtggtgctcatgccagcacccccatgatcatggggaggtcgttgaggtctcccacggttgccaaggtgaagtcggagtagcgtttgatggcgcgcggttggccggttgcggcttgaagcaccacgcaggttgcggagcgggggagtgcgaggaccatgtgtttgatgtcgtcgatggttttgagcctgccgacggtgaagaagtagaaggatgcgtcgggggcatgttcgagagtggtttgcgcgaggttgggattgtcgtcgatgtcagggtcgatgccgctgcagccatcgagaaattccgtggcgttgcgcggaatggcgtgcgtggaaccggcatgcgcggtgactggccggttctgctgcaggcattgcacgccgatggaggcgtggacggatacggccagttcgaattcctgggaatcgatgtaatcatccgggttcacgctgatggtcagagcggtgtcggtacggcgggtggcttcgtattggcggatcataagcgatccggttttcgcggagctgagccaatgcacgttgcgcacgtcatcgccgggctcgtattcgcgcaggccgtagaagtcgaggtcgtcgtcgacgatttcgccgcttggctgaccttccaaatcgcgtggaatgccggcgttcagggtgctgagcagcacggtctgcggatgaatgaacacgttgatctggtccacgagtttcttttcgtggcggatcagaccgaacgggtcgcctttgcggatggatagcgggccgatgggcagcaccgcgcggctgacggcggtgaattccacggtcgtcagccgtgactggcctgcggcgagcatgggaatggcgaaccgttcgtggttgtctccgatgggcaggtcgccgcgcgccgacgtggtgggggtgcggcccggattgtccacgcagacgtcgactttcaccgtgtctgacaccgtgacgcgtctgctggacacgtcgatggtggcttggaacgaggtgttgccaagggaaagcatgaccgccgcggccagcatgaccgcgaacaccaccgccatggccagcagctcatgccaccccagcaggacgaacgccaccagcgaggcgacggcgagcgccgccaccgcccagccaagcggcgacacgtatgaggtggccagtcgcttgatgcgatgtttgaggcggcgtagggatcgttggatggtccgtctgcgctgcactgtgtgcgaatgccgcattccttgacctttcggattgtgtggtgcgtatgccggggtggattgtgtttcaggcgttggcgcccagggttggggccggcacgtcttcgaggatctggccgatcatctgttcgggggtgtttccggcgaaggtggcttcggcggtgagggtgatgcggtgcgcgagcacgggtacggcgaggtttttgacgtcgtcgggcactacgtagccgcggttgtcggaggcggcccatacgcgcgcgcagcgggtcaaggcgagcgcgcctcgcattgatgagccgacttggatgcgttcgttgtggcgggtggcttccaccagtcgcacgatgtattcgaggatcgcgtcgtcgagatgcacggtttcgctgatgttgcgcatgcgcagcacgtcttcgccggtgagcaccggatgcacggtggcggcgcggtcggtgacgttgacctgcttcaggatgttgacgctcacgtcgtggcttggatagccgatggtggttttgatgaggaaacggtccatctgcgcttccggcagcttgtaggtgccgagctgttcgatcgggttctgggtggcgatgaccatgaacggctgcggcaccgggtgggtgacgccgtcgacggtgaccttctgctcttccatgacttcgagtagtgcggactgtgttttcggtgaggcgcggttgatttcgtcggcgagcacgatggacgcgaagatcgggccttcgcggtattcgaattcgccgcgcttctggtcgtagtaggtgacgccgaccacgtcggacggcagcaggtccggggtgaactggatacgtttgaacgacatgtcgatggagttggcaaggcctcgcgccagctgggttttgccggtgcccgggttgtcttcgagcaggatgtgcccgccgaccaccatggctgtggcgcattggcggatgggtgcttccttgccgaccacgacctgggagacgttgtctacgagcttggcgaacttctcatggaattcggtgatgtctttgctgggtgcggtcatcatggacgtgtcgacgaccggctgggattgtttgacgggctgtacaggctggctgggctgtacaggctggctgggctggacgggttgggttggctggacgggctgctgcgcgggcattgcgactgccggattggcggccggttggcgaaggttctgcggcatcggctgacggaaccgcggctggttcggcgttgccggggcggactgttgcggcaacgccggttgggcggtgccgtgcgcgctcagcagcgtgccctccggatcctcatcggcttgcggctgctccggcagattcggcgtgtggaacgccggctgctgctggccgggttggctgggaacgcttggattatggccgatggaacccagctgggtggcatcatcgaaatcgttgctcatgggttgctccttgcttgttgtgttgctcgtgtggatggttcgttgtgtttgcgattgctgtgatcgtccgtttcaccatctggcgtagtaggccaggccgcggatccaaggcttggatccgccgtcgacggtggacagggcgacggaggatgccacaggccggtcattccgcgtggccgcttcgccttccgtggacgcgtcagaatccgatggttccgacggttttgatggttctgaaggttccgacggttcgggtttcggcgtgggagccttgtacctgtcatggtccagcagtgtgccgccattgtcctcgttgttgagcgcggtgtcggtgcccaccaccttcgccttccacgcgtaatcgactccggtcggcagcacatccttgacgttcagtttgtcggcgcccaatacccaggcgacgtcataggatttgccgtccgcggtgaaggtgatcacggttttgccgggctggccgtacatgttcaccgatccgccgctgaccttgatgatgttcggatcattggcgtcccacgtcagcatcggcgcgttgacggcggccttcaccttgcggacgtatgccggatcggccctgccggacttggaggtgcttaccgcgccattgaaatgctgcgtgacggaacccgaggaacaggactgccattccttgagcgggaaatcgtgcgatcgttcggaagcgccggcatggtaggagccgagtccgtccgcgctcaccgtgaacccgtcggcgtggccgttctccttccaactgactacgcacacgtcgtcatgccccttgacgctgaccgattcgggcgccttcaccgcgtatttcggtgtgaaacgtacggtcgaatcgtcgctggtcgttttctccttgccgaccaccgccgccttgatggtgtattccctggtgttgagatcatgatccggaatcttgaaatcgtaggatccggaacatccgtcgatgcttgcgctgacatctccggaaatctcgacggccttgcatcccgcgttgcgggtgttgcccacggattcgacggtgacggttcccgtggtgtcgtcgttcgtcacggagatcttcggcgcatcgggcttgccccacggcttgaccgcgtcggacgccttggacggttggctccaattcaccttgttgtgggcgcgtaccgtagccgtgtacgagtcgccgtcggaaatcgcgttgttatcgaaaacaaaatcgattccggtggaatttgtcgtctgcttggacggtgcgttcctgccggacaaagtcacctcgtaattgttcaccgacgagaaattgccgtccggagccttccacgtgacgctcaccgtgttgcccttcacactggccgtcacatccgtcggcgcatcaggcagcttgtccggcgtgccctcgacggcgttggaatccttggaccagccgacctcgttcctggcctgcaccttgaacgagtaggtcttgccgttcttcaacccgtcgatgagacaggaggttttctgcccgcacgagcgctcgccggacgcgtctccgccccacatcaccttgtattcggtgatcgggctgccgttggccgaaccggccgtccagctcagattcacggcgccatcctgcgggtcgccggacaccgcggaaagcagcggcgcatcaggcttgtccatcaccgaaacgctgatggtgccggtcacctcacgttcctttgttttggtggcgtcgcgcacggtgacgaccaccttgttggtgttcgcgccgatgtcggaagccgccctgatggacaccacgccgttggacgggcaatccaccgtcagcttcgacgcgccatcggacgtgcatccggtcaccgtcagcggagtgtcggggaacggattgtacgcgtcggacagcagattcacctgctcgctggaaccggccttgattttcacggtcttctcggtgacacgggcgagcggcctgttggacgcggtgacgcgcacggtcataccggcgctcaccgtacccttcgcatatttgatcgagacgggcacgctcactgtggtgtccggcgtggccgtcttgtccgcggacacggtcaacgtgccggagggagacactctggcatccacactgccggaattcacgccgccggaatacgagtactgcttctcatcctcgtacaggcccgacgccgaatgggtcagcgccgtcagatcgatggtagtggccttctcgccggccaccacatcgacggtggaggatgagaacgtcggcggcggaacctcacgtccgatcaccgtgatcggaagcgtgagcaccgccgaattgacgatcttcaccttgtcgttcttgtctcgcttgccgtccaccgcggtgaaggtgatggacgcgggacccgcgtaatccttcggcgcggtgaacctcaacgtctggtcgttgacgtacaggtcgccgtccgcggccttcgtggcgctcaccgaatcggcgccgtccacatacgcggtcttgcccgcgcccacacgcacgtagtcggcgatgttgatggtgatggtctcacgcgcattgaccttcaacgccggcgccttcggacgtagaaccggcggaaacacgccatatgcgggcacttggatgaacgcggtggacgtgatgccgtacgtcgtgttcgtgacggtgtacggcaccgcgcgcgcctcgtcggtcagatcaacggtgatgatggtggaatccttgccgcccttgacatgcgcatggtcggtcgcggaaggatccacgcccacctgaagctcgtcggcggtgccggacggattggcgatccactgcgaaacgtccacgtccacggatttcttgtcgatcgtggcggcggccggaacacggtaatcgtacgcggtcggcgggtcgatggcggcgttctcgtcgacattcaccgtcaacgtcgccgaatcggacaggccggccttgtccttgacggtgtagaccacgtaatacgtgcccgcctgcttcggcgtggtgaacgacagcatgttgtcaacgacctgaatgccgtcgatgccttgcgattccacgtccttggccacggtcagatcagtattgtccccggaaatgtcgttctgcgccaccggcacggtggccgcggtgttcggacgcagcgtgatctcgtcgtcgcgcgcgtacacacccgaatcggctccggatttgaacacgcccacacgcacctgcgcggtggccctctgaccggtccaatcctccacggcgtaggagaacgtgtccgttccggacgaatcggcatacgcctcatacaccagatacgtggcgcccacctcgctgatacggcccagtttcggcgctttgttgcccaagccgagcagctgcacgtcatcgccgtcagcgtcgatgccggtgagcgtgatcggaatctgcaccttctgaccggccgccacctgcgcctcgacgtcggacggtgtcggagccgccttgttggacgcgtccttctgatgcacgttgatggtgatggtggccgaggccgcgttgccgagattgtccttcaccgtgtaggtgacggggaaggagccggtttgtctggtggcctgatagcgcacggtgtcgccggacacgaacaccagacccttgaacgtgttcttgtcatactgcaaatcgttctgcaggctcaccgtggtgccgtcggaatacgtgacatggtcgagcacgtccacggacacgatgccttcggtgcgcacctgtgtggtgatgttctcggccttcggcacggaattcgacgtggtcagcgccggcggctgcaggacgatgacgccggtcgacgatccggccgcgttggccacggtgtaggagatccgcaccggctcggtaggcacctgacgcgcggtgatatagacgcgcttgttgctcaccacaccggttttgatgccgctttgcgcgtccgcggtgacgctggtcaccgacagcacgccgcccatcgggtcgacgtcgttggcaagcggctccacgatcgcggtattgtccgcgccgagcagcgccacatcgttcgccgcgatcggcttggcggcgtctccggccaccgcctgcacctccacacgagccagaccggtcgacggaatggaaccctgcgtgatggtgtacggcacatagtaggtgccgggattggaggcggtgaacgtgatcgacatgtcggtggcgttcatggtggtggccgcgccggacggcgtctccaccgcggtcaattcggccggttcgacggacgtgccgtgcacgtacggcttgagcgcgatggtggtgcgggtgtcgggcgtggtctgtttgaccacggggtcgatgaccgcgcccagcgtgttcgccggcttcacggagaagtagatcatgccggtgccggtctgctggccgtcggacaccgtgacctcgatgcccgccctgccggacgacatcgaaccggcgttgaagaccaattgtccgtcggctcgcgtggacaccgtcacctgatcggtgttctgcggcgatgccgacaccaaggtcagcggatcgccgtcggggtcggagaagctgcccaacgcgttcgcggtgtacgaagcaccctgctccacgtcgatttccggcggagtgtcgctctgcagcggcgcatggtcgtcgccgccggccagcgtgagcgacacggtggcgctggacgtctgcccgcgcccgtcggaaatctcatagctgaaggacacgttgcccgcggcggcaccggaggcgtcgagctgcagataccggccgtcatagacgggggagacggtgatgttcgcgccatccggagcgctcaccgacgtgatgcgcagcacggaacagtcggtctgctcgtcgttgcgcaacacgtcgagaatctgctgcgatcccacgcgcgcgccgaacgaatcgtccacggccttgatctgccccgactgcgccgaacagttcttgctgaaattgtgctggttgttggcgctgtcgttgttctgctgctgttgcttcgactgcttggtctccaccttgttccactggattttgatgaccttggtggactcctgcggattccacacattgccgttgaccacgtcgttgagcaccaccagacgatggttggtgcggaacacgagctgcgaggtgggattgacatcttccaacgaggaaaactgtgcgtccttgtcgttcgccgcgcacaccctgatgtaattgttggccttctgcgcccacgcggcgaacacgcagccattggtggacaccggctgcgcggcatcgcccttgccggtattcggcagctgcgtgacctttttactacccaaatcgaccatggcgatgccccgcggcgtggaaaccgccacccagccagtctgcctgccatccgtggacggcgcctgcaacgtcgcctgaccctgcaggccgatatccgcgctgcccttcggccagaacaccttgccggcaccggctacgaccggcgtcttgccgaccacggtgaacgattcgacattcgtggcgcccttgatcgtcgcatccttgccgggcgttccctgaggtccgtcgacactgagcaccgcgccgtcggacgcgcgatagccgtagacgacaccgtcatgcgtcaccgcgatacggccacccgaccccagcttcatcttcggcgaatcggtggtcggattcatggatttcacatcatcggcggacccgacccacacattgcccgtcttgacgttgatgaacgccgcggtgttgcctccgacgacggtccgcatatccgatttgatggtggtgttgccgctttcgctgacggtggaggcctcgatgttgctggccttcgtaccttcggagatcacggtggagccatcatgctgggccacgtcgaaccgggccgcagtggaggcgacgcccgcatcggcgtcccggttgcgcacgttgaaacgggcggccttgcggtccttgagcgaagtgacccacacggtgccatcgtcgagctgcacgtgacgttgcgtcaccgaactgacgatgacggccccggcgacgatgcccagcaacagcagcagcatgacgatcggcgtgatccaccggcgactgccggaaggcagcagcttgcgcagcatcgacccgaatcgcaactgccgttcgtacgattgcgccgactggttctcggcgttcctatgcttgctcatcgactggctcttccctgattgtgcccaaactttgcttgaccgcgcatccaaccgcatgcgcctacctgtttgcccgcatgcatgccgggctgtattggttcgtatcggttcatgtcacccgcatccggccgcaaactcacggcttggccgcgcacgcgatcatgggattctcggacatctgccggtccgcgcgaaccagactcacctgcacgcacgtctgcgcgccgtcggccggatcgatttcgatactcgtcgactccgtggtggtgccctgcgcgttcgggtcggttcccgaatcgccgaccagcgaccacgcgtacgaatcgccatccttcggcgaaggattgacccatgtgaaccgcactttgccgtcggcggtgtattcgcccgtaagatcctgcacgctcggcacactgcccgacgtgatcgccgaatcgggatcgtcctcggcatggttctgggcgccatggttctgcacctgcaccttgctgttgtcggaggacgcatccatattcggcatgacgacggtgacgaacgccaacgccatcacgaccacggcggccgccgcagcaaccgtgacggccaacggcttcgcccaccgggcatgctgtttcgcaaccggggcggactggtcgaatgcggaagtctgcgcgtacatgttctgcggataatccggcacaccctcgacggtggtctgcacggcacggccatacaaggcctgttgcacgcgctgcatgtcgcgcgcgaactccaacgcggaatagtaacgatcctcgggcgtacggctcaaggccttacgcaacacccgttccacttcggccggcacgtcgggacggttgagcttgggcagcggattgttgagaatgacggacttgagccgttcggcccgcacctgccgttgggaatcgcccagcacatcggcgtagaaatactcgtacggcgattggccgatcagcatggcgaacagcgtggcgccaagcgaatagatatcggacgattcattaccgccaccgccttgggcaagcacctccggcgcggcccacgcgatggtgaagccgacacccggacgcccatagacggtcccggcgatgccgaaatcggcgagcatgggcatattgtgcgcgttgatgagaatattgctgggcttgatgtctcgatggatgatgcctttgcgatgcgcggtgaacagcgcgctcgccagatcgatgccgacggtgagcatctggtcggcggtgagacggccatgctcgaggaacgtcttgtaattgccgcccggagcgtattcgaacacggtgtagccgcgcccgttgacggtcacgccgttttcatagacggaaagaatgtaggggtgtgtggagatctgccccatgaaattcgcttcggaacggaagcggaccgcggcacgtgggtcgagcgtgttcttgctgattttgatggccacctgacgggccggggaaagctgctggtacaggtacacgtcggcttcggaaccggagcccagccgtttgatcagtgtgtagccgggaatctgagggggaatgctccttgaggcttccatgcttcctctttcttgtagttcctgcccggttccgtgcgttgcgtctatgcttcgaccgtactcgtcgtcatgggcaggccgtctgttcgctgttgaaccttcccgggctgcgccgctagtcaatcttattggtggcggtgtccgaaaaactttgtagagggtatcgatgtccatatgtaaagatggcggtgtccacgatgacgttttcaggacggcttcggacgatgatatgcgattcgtggccggaccgttcggctaagctggggagacatgatggatgtggacgatctcgatgacgtgacattggttgcgggggcaccccgcagcggcaagacccggttcgcgctggacatgctggtcgccgcgatgaagcggcatggcgacgcgtacgccgtgatgacggtctccggcagacaggtggccgaccggctcggcgacaccgtgatccgcgaactgtccgcgatctcgcaggcacgccccgtcaccaccctgccagccgtcgcgttccgcatcatgaccgccgtgcgatcgcatgccggacaacccctgccgaaactgctcaacggggccgaacaggacgtggtcatccgccgcgtgctcgacagacatgccgaacatgccgagcacggcgacgaatgctccacctgcgcactattgcgcacctacttcgtggtcgccgactggtcgggcatggtggtggacgacgccaccgacgccttcgccaaccagctgcgcgacatgcttgcccgcatgaacgagatcggcgcgaaaccggaactcgaagacgcgctgatttcccgcgctgccgacgaacacggcacgcttgacgaacgacgcgaacgactgcgcgtgcaatggcggctcgccttcgcgctgcgtgccgaatacaaccaggccatcaacgaggcatatccggaccaataccgtctcgacgcctcgcagctcatgatcgacgccgcggccgccgtgaacgaagccaaaacgtccgacctgccgaaactcgtcatcgtcgacgatttccaggacgccacactcgccggcttcgactttctcaccgcattgcgcaaccgtggcgtgcgtctgctgctcgtcggcaaccccgacgaggcggtgcagacgttccgcggatcgtaccctgaatatctgttcaacatggcgcaatcgcgattgggcgcgcgactggtacggctggaaccgtcccatatggccgaaggcacggacctggccgcggtggcgagccgcgtgagcctgaccatcgccagcacggaatcgaccgacgacgcgctggcgaaccgccccggcaaaatgccggccatcgccatgccggagacgcacgacggcagtcttgaagccgcgatgtaccgttccgccgtcgaagaactcgacgacgtggtgtggaaaatcaaaaccgaacatctcgaacacggccgcgactggaacgacatggccgtgatcgcccacgacaacgccaccgtgcgcacgttcggcgaacggctacgcgccgacggcgtgcccgtacgctattcgagcgtgacccgccccctcaaggacgaaccgttcgtgcagggcctgttctccatgatcgaactggccgaactgaaacggcaaggcatcgccacctcgtccatgaacctcgacacggccggcgcatacgtgcgctcacgcgtcgcatcgattatgaactcgccgctgatcaccacccccggcgaacgtccggctcggctgtgcgtggtcgaatcggcgatgaacgcgctcggctcgctggccacggttttgcatgacgatacagccgatccgaccacgtccgacacgtccggacgcgcgctgctgccacagctgatcgacgattggaacgattacgtcgaaaccttccacaccgcacgcgtggcggcatcggcgtcggacacggaaaacgctgccgacatgggcctgccggcaatcgacaccgacgaccggctgatgacgggagagcgtgccgctgaggacgcggacgaaccatccttcggcatgaacgcgctgtacatcctgctattggaaggcgacaccgaccgcgtgctcgacgcgatcgcctccgtactgggccgcaaagacccccaagcgcaagccttcgcacgcctgtggaaaacgcttgacgataccctgcggtcggaggcacgcctgacatcccacgaaccgcaatacatgctcgactgtgcatggcaggcgttcggcaaagccgaaatctggcagaaaacggcgttgcgcaacaacgccgaaggccgcgcggccaacgaccggctcgacaccgcgatgcgcctgttcagctacgcgtccggcggcgaatcgaacggcgtgacggcagcgcacaccatcgacgcgttcatcgaacaggtccgcgcgctcgccatcgaagccgactccctggcgcacaccgcgccgatcgatcaggccgtgacgctcaccacgcccgccggagctgccggaaaacattggaaactcgtgttcatgcctgcgttccaacaaggccaatggccgaacctcgcgccgcgcaacaccctgttcggcggggaggaactcgccgacatcatgctgcatggacgactgtccgacgacatcgtcacttccgcaggccgcgaaaacgcgcagctcgccgcggtgctcgcctccgaacagaaaagcctccttgtggcgctcacccgcgccgatgagcgcgtgacggtaagcgcggtcctcaacgaagaccatgtgccgtccgacttcctctacggctacctgccggaatggttcgaccgcgaccgggatgccgatgcggaaacacgcgtgtacacggcggtcggcgaggccggcgaatacgcgggactggaggccgacccacgtggcctggtcgccgcctcgcgaagcgtgctggcccatgcgccgaccgattccccccaagcgcgcgatgccgcgcaagccttggcgttgttggcatcgcatggcatcgccgccgcgaatcccgacaattgggcgttccttacggaacatgcgggagccgacgatatgacggaaatcgacggcaagatggaatctgacgggaaaacggagcatgccgacaaggcgaagcttatcgaacaaccggaatccatcgaaaaaacagacggccaatccgacgtggtcaccctttctccatccgccgtggacagtttgtgggcgtgcccggtgtgctggatgctggagaaccgtttcgccggcccacgcatgggcagcgcggccaccagcttcggctcgctcatccacgccgtcgcgcaacaggccaccgaagccggcctcgacctgccccaaaaccacaccgcggtaagcgacgaggacaacatcgacgaaatcacccaatggatgatcagccgatacaagaccctacgtggcgacctcaacgccatcgacgaccccgaggaacggtacaaggcgctcggcaaggacgcgaaagcatcggtcgcattgcgcaacatcgccacatatttcgtcaagtcgaaccgtacgggatacccgtcgaacaacaccgaaaccatcaccgtgggaacattggaccatgccgaagcggaacggcagttcgccgcgcaattcgacttcgacgacatcctcgacgcctacaacgccatcgacggcaacgctccgatctcccgcgacgaactcatcgccatcatgggcgcgctcgtcggcggctggccggaaaccggcatgagcgaccggctcaccgtacgcctgtcgggcagaatcgaccgtcttgaacaccgccgtaccgcagacggccgcgaacaggtacggctgattgactacaaaaccggcaaagtgccgaatggacgctccctgttcagcgacctgcagctcgtctgctaccagctgggcctcgcattcccggaacacgacggaaaacgcggcgcgcaggcgatcgcaaccatgccggacatcacccaaagcgccctgttccacgtcatggaatacgcggcacccgcgccacgcaaagggcaaggcgacgaagcgtaccaccagcaggcgctgttcgccggcggaagcatcaacgcgggcgatttcataccccgcaaatacgtgcccaaaatggccagcgtcttcaccagcggcctcgacgacgtcgaacggccggcgcaggtcagcgaagaacattggaagcaacttctggaatcgcggtcgaagatgacggtatggtcgctgaccatgatctcccgcgtcttctatgcggccgcggcgagccgggccacccgcatcaccgcgcgtccgaccgtggaacacgtcggatactgcagaacgtacggcagtggggtctgcccggcctgccaaggcgagcagaacaccgtattcgaaaggaccgtggcatgaacgggagcaacggtatgaacggaagcatgtcaacgaacggggccacagcaaagggcgatgcgatgggcactgcgccggccgccacgccgaaattcaccgacagtccggaacaggccgccgtcatccaagccccctcatacgaggacgtggtcgtggtggcgggcgccggctccggcaaaacctacaccatgacccgccgcatcatcaccctcatcgaccagggcatcagtcccgagaagattctgggcctgaccttcacacgcaaagccgcctccgaactgctttcgcgcgtctccgctgccgtgacacgcaaccaagccggacgcggtacacgcgtcgccttcctcaaaccggaagtctccacctatgacgcgttcttccaaaccatcgtgcgccaatacggcctgctcgtcggcttcgaccaaaacacgcagccattgagcgaagccggagcgctgcagctcatccacaccgtgctcgacaagcacatggaccagctcatggccttcgaccaaggcggcgacgaactcggcaaattctccaccatcgccggcaacgtgttcaccctatccaacgccatcgcaggagccatgatcggcagcgactgcaccagcttcgacgaagccgtggaacgcgtgcgcgcatgggataaggcgttcgtggcgcaagtggccaaagcgcttgaagacgaggacgttcccgatgacgagccgaaagtgggcaaggctccgaaacagaagaaaaaggaatccgacaccgccttcgaaacccgcatgcgcgaataccgcgcccaatgccaccaactctgcgtctacaagaccgcgcaattggccggcacggcccgcaaacgcgacctgctactcgacctcgtggccgactaccacgccgaaaaacgcgccctcaacatggccgaattcagcgacttcaccatcgccgcattccaactcgtcacccgattcccctccatcggagccacctaccgcaaacgctacacgcacgtgctgctcgacgaataccaagacacctccaccacgcaggcggccctcctgaccgcactgttccacgccgattccacccatcgcagcgcggtgaacgccgtcggcgaccccttccaatcgatctacgcatggcgaggagccagcccaggcgcattccgcatgctgcaacacgacttcggccacgacgccaccgacaagccctacacgctgaccgtcacccgacgtaactcgcgcatggtgctcgaagcggccaacaatctgacgaaaccattgcgcctgcccgccagacgtcgcggcagctcgcttatgcgcgaagtggacgtgtccccgctcgccaacatcgacaatgcccccgaaggtacgctcggcgtgctcggctacgccacattcggccaggaaatcgacgccatcgtacgcttcgccaaacaagcgatcgcactgcacacgccaaccgaaaacgagctcgccgacggagccaaagacaaccgtccgcacgtggcgctcctgttccgctccaaaacgcagatgccagcctacgaggacgcactggaacaagccggcctcaccacactcgtcgtcggccaggccgcactcctggaacgtcccgaaatcaaagacatcctcgccctgctgcacgtcgtatgcgaccacaccgacagcgccgcgctcatgcggctgctcgccacaccacgattcggcctgtccgccgacgatctgcaggcgctcgccggcatcgccgaacggctcaacaccgcgcaacgctaccgcgcgctcgtgtcggccggcatcgtggaggcggatgcgaatccgtccgacgccgacatccgcgccaccgtgcgcgcctaccgcgaccaagtgcccaacgccgtcttcctgatcgacgtgctgctgcgcggcgatctgcggcacctcgtcgacggcgtattgagccgtgcgggagccgcgagcgtcatccacgccggtcgcgtcatccaacaggtgcagcgcacggccggccatccgttgccggaagtggtacgcacggccatcaccgcgctcggactggacatcgacctgctgctcgccgaacggatgcggcatccggatgccggcaatcgtgccacatcgcatgccgcttcgtcactcgacgcgatgctgtctctggtggacacctacttgcaggaaatcgccgcgcagggcacgccaagcctgcgcgcgttcatctcgtgggtggattcgctgcgtgacgcgtccgacgacaacgccaccgcaccagatacccccgtcgatgtggtgctcatgaccgtgcaccagtcgaaaggcctggaatgggacgccgtggccgtggtcggcatgcgcgacggcaccttcccgtccagtcaaggcgaccacctgagcgtcaaaacggacgaagaccatccgggcggtcggcgcgacggcgtatgggagccgccggaatacttcgaaaaagcccacacttggctggaagacccgtccgcggtgccggttccggtgcgcgccgacgcggatatcctgccacgattcccacacgacgcgcccatcgggggcaatcccgtggaatcgctcgacggattggacgatgcggaagtgatcgacgacgaggtgttcggcaccttgcgaaccatggccgtcgacgatatggaaggaatggatccggcaagcctgtacctgacgcaacaggaggaatacggccgccgactgcacgccgacgaacgccgtctcgcctacgtggcgttgacgcgcgcccgctacgaggcgctgctcgtatacagcggatgcaacgagacgagccgcgactcccgcctggcggagggaaagaaaagcgccgcgccgtcgaatttctggctggagacgcgcgattcgatgaacggaatcgtcaccgcggtacgcgaaccggacaacctgtccgacgatgtggacggctccccgcacacgctgggacttgacctgcccgacggctatttcgtaggcgaacacgcccgcgatttcgagaatgccgtggtgggcgatgcgtggaacacgccgctcgaaccggtctcggacgaccatactttgccttggccgtgcgatctgagcgccgatgtcgccgacaggctgcgtgccgcggccgaacaggtacgtgccgtcgaatccgacgaaccgaatatcgctgaatccacgggaacgcagggcgacgttgccgatgaatccgccacgccatcgccggaaaccggaaactcactgctgcgtctcgccaaactgctcgtcgccgacgaacatctcatgccggaaccggacgtggctgacgcaggcgaatcgcaggacgccttcgacgaggccgtgcgtgccaaaggcgaacgtatccttgctgccggccgccaaaacgtcacctcgctgcaagcgcgcgccggctccatgggcgagcgtgactcccgcgcctactggcgtggtctggtccgtccgattccgcacgtcgcctcgccggcggcacagctcggcacgcggttccacgcatgggctgagcgtttcatcatggcggatgcggacgtcgacggcatcggcggtacggaaggtgctgccggtatggccgcgcagtcgcgtgcggaactgatcacattgataggtgatacgcaagtcgacgcggacaacggcggcgtgcaatcgcaggacgcaccatcgcaggacgcccaattgcgagacgaacggaaactggccgcttggcagcgtcgtctcgtcgcttcgccgtgggcaaaacgacgtccagcatgggcggaacgccagctcgtcgtcgacatgccccagctcggcaccatcgtcaacggcaaactcgacgcggtgttcttcggcggtctcgacgaaacggacgagacgaaacgctacaccgtggtcgattggaaaaccggcgtaaaaccacgcaaaccggacgaaatcaaagagaaactcgcacagctcgacctgtaccgcctgctgctcgcggcgatggaaggggtgccgttggatgcaatcgacgcctgtctatactatgtgagtgagcctcacgaggccgatcgggagcttgacgccctcgacaaaacagaagaagagatccttgccgagttgagctacggaattccgcagcaatccgacaacgactagtgccggtgcgcaatggctccttgaccgaagaaagcgggggagcggcgctttccggcctgcctgcgggagaaaccgctatgcaggcagcgttgtggaggaacgccgctaccctcgtgcagcatgtgtgggcgggcgcacatgccggacgcaacaacagttaaggagtgtttgatatggctgcgaacagcgcaaccgcaatcccgaacgccggcatgggtgccggaacaaacaacgcatcggcaatcgtcttccgtcccatcggctggggcgatctggacgcggtggtcgacctgttcgaccgtacctggccgcaggatgtggacaaggtcggcgcggacatgtcgcggctgatctcccgatatttcgtgctgcactacctgctgccgaccacgttcgccaacggcgcgttcgccgccgacggcacactcgcgggcgtcacgttcatccgcgtcgccggcgaggcgccgcagctcgacgaaatcgaagtcggcgaggaaatgaaggccttggaacgccgcatcgacgccgatccggaggccgccaagcatatggcggcgctgaaatccggcttctcggtggaactcgatctggaacgcgaagggcgcgccaacgaaaccaccatgggcgagctggaactgttcatcgtcaaccccgacgtgcgcggccacggtgtgggcgggcggctttggagacgcatgcaggagcatttcgccgcatgggacgtgcccgcgttctacctgcacaccgattccgactgcgacgtgagcttctacgaccacaaggggttggactgcatcgcgcaccgcacggcaagcgagacggtcgcccggctcggcggcagtgccgacggcgaagtgccgccactgttcgacgacatgttcatctaccggggaaaggtgacggcgtgacgggcgcgaaaccgcaatcgcaatcgcacgaaccgcacgaatcgcagaaaacgcaatcgccatacgcgcagcttttccgcattcccggcacgaaggcgttctgcgtgtccggagccatcgcgcgactgccgatgtccatgatgggcctcggtatcgtgctcgcgctcaaccacatgtacgacaattggacgatcgccggcgtgatgagcgccgcgtacgtgctcgccaccgccgcggtcacgccgctgtacgcgcgcctgttcgaccggttcggccagcgcaaggtcggtccggtgatcctgacggtgcagatcatcgtcatgctgggcttcgcgttcgccgcgctgatgcgcgtgccgattccgctgctgttcgtgcttgccgtggtcatgggcatgacgcagttctcgttcggcgcgcttgtgcgcacccgttgggcgtacgtgctcgaccgcgccgacaaggaggacctgctcaacaccgcgtatgcgctcgaatccgccatcgacgagatcgtgttcatcttcgggccgattctggcggctttcctggccgcgtccgtgcatcccgtatcacagctgttcgtgccgaccctcgcctgcgcgttcggcggtgccgtgttcttcgcattgcgtgacactcaaccgccggtattgcgcgaaatcacggtcgtcgcggccgatacggacgatgctgacgtgcgattggcggccggcggtgccgctggtgccgcggtttccgcggaccgtttcgatttggatcggctcaagacgggcgatcgcgaccgcaacaagcgcaatgtgctcacctatgcgggtgtgctgccgcttctcgccgtgttcatcgtgttcaacatggcgttcaccgcgtttgacacgtccatgaccgccgtcatgaaatcgctgcacctcgactccgtgctgggcgtgcagctggccatgctggccgtcggctcctgcatgggcgcgctggtcttcggctcgcgcgagctcaaaggctcccgttggcgtcacatgatcatgttcctcgcgttgatgaccgtcggctttgtggtgatccacctgtgccagggcaacctgatcgtgatgggactggtggagatcctcaccggtctgaccatttcgccggtgttcgcctccggcaacctcgtcgtcaaggagaccgtgcccgaggaatcgctcaccgaaggcctgtcctgggtgagcaccgccggcacgatgggcgcgtcgttcggctccatgatcaccggcatcgtgctcgaccatttcaatccaagcgcgggattgagcctgcccgccgtgttcgtgggctgttcgattccgttcgcgctgatcggctggctgctggtgcgccgccgcggctgaccgacgttcgatcgtcaagcgtcatagccgcctgcctccgcgtcgaagcgtctctttagattcataagtggaacacgttatggacgcggacacgcgatttcgaacacatgcgcacggcaaacgtacgacatgcgcaacatgcgcgtccgcgaaaacatcaaggagctgcaatgatcaaggtttccgtagtcggtgccaaaggccgcatgggttcgcacgtggtcgacgccgtcaatgccgccgccgacaccgaactcgcgctcgcgctcgacgcaggtgacgacctgaccgccatcacccccgaaaacaccgacgtcgtggtggagttcaccgtgccgagcgtgtcgctgggcaatgtgctcgcgctcgtcaagcagggcgtcgacgtggtggtgggcaccaccggctggaccgaagagaagctcgaccaggtgcgcgccgcgctcgccgcggccctgcgtgagggccagagcgtgttcatcgcgccgaacttcgccatttccgcggtgctcgccgaccatttcgcaaaggtcgcggcgccgtatttcgaatccgcggaagtcatcgaactgcaccacccgaccaaggtggacgctccgtccggcaccgctttccacactgcgcagggcatcgccgaagcgcgcaaggcggccggcttgggtccggttccggacgccaccgaaaccgatggcggctcccgcggccaggtggtggacggcatccacgtgcacgccgtgcgtctgcgtggcctcaacgcccatgaggaggtgctgtttggcaactccggcgaacagctgaccatccgcgccgacagcttcgaccgcatctccttcatgccgggcgtgctgctggccgtgcgcaaggtctccaccggaacctacccgggtctgaccgtcggcctcgaccacttcctcgacctgtaatcgtaattcttttttcaaactgccgacgggtgcatgtgtctcccgtcggcagtttttttatggcggatctgttccgattatttggcaaggcgtgcgatggcggcgctgacttccgccagcttttcgtcggcgacggtaccgccctccgccgcggctttggcgacgcaatggtgcagatggtcgtcaagtaacagtagcgccaccgacttcagcgcgctgtccgctgcggaaatctgtgtcagaatgtcgatgcagtattcgccgttttccgtcatctgccgaatgccgcgcacctgcccttcgatgcgattcaatcgtgcgatgatcctcttctggtcgcttgcgtacccatgttgtgtggcgttcatatcgtcctcctcgctgcgctgaaaattttatctacggctgaagtttgctcgtccctcttgccaatataccctataggggtatattgtgatggtgtttgccgaaatcgaaagccaattacggacggaaggcggctggaatatgcacatcgcaatcgcgcttattatggcgctgctcgtcacggcgggcgtgctgtggttcttcttcgcaccgcgcaaagcatatcgtgcgccgttgcgcgacggcgtgcaggaagcggtcgtcgaagtcaaaggcgggtataacccagccgtcatcgaagccgaagcgggcatgccgttgcggctgatcttcgatcgcaaggaagacggcgaatgctcgtcgcatgtcgtgttctccgatttcggggtcgatcttgcgttgcccgccttccgcacgaccacgctgacgcttcatcccgaccagccgggcgagtatcccttcgcatgcggtatgaacatgctgcacggcacgttgcgcatactgccgggaaagcatgcaagtgtcggtgccgccgccggttccgcggaaacaggcgtgcaatgcgcgcaaaaaggcgccgtccaaacgtccggttcgggtgattcgggcaaatcgcgcggatcggaatcggaaattcgcgccctcatcacccgtcttatcgtggcggccatctgcacgattccggtattcggctccaccatgctcatgctgtatccgatgccgaactggctgcagttcctgctgatgctgccaatcgtcggctatgcggcattgccgattttccgcagcggtttcgccgcgatcgcccaccgttcgccggagatgaacgcgctcgtcagcctcggcgcgctggccgcattcgcctactcctgcgtggtcaccttcgcaccgaacgtcctgcccgagaacgcgcgcgaaccgtatttcgaagcggtcggtgtggtcgtcacgcttatgcttgtcggccagctgctcgaagcgcgcgcccgcaaaggcaccggtgaagccatgcgcgcattggcgggtctgcaaccgaaaaccgcccgcgtggtgcgagacggcaaggaaaccagcatcgccatcgatgacgtgcgcgtcggcgacatcatcgccatccgtcccggcgagcagctgccggtcgacggcatcgtcatatccggcagctccaccgtggatgagtcgatgattaccggcgaagccatgccggtcgccaaaaccgagggcagcgaagtgacgggcgccaccatcaacggcggtggctcgctgcggtaccgcgccacgaaagtcggcaaggacaccgtgctcgcgcagatcatcggcatggtggccgccgcacaaagctcgaaagcccccgtgcaacgattggcggaccgtatctccggcatattcgtgccggccgtggtactcatcgccgtatggtcgtgcgcgctgtggttcgcgttcggccccgaaccgcgtgtcacgcacgcgctggtcgccgcggtatcggtgctgctgatcgcctgcccgtgcgcgctcggactggcgactccgttgtcggtgacggtctcgactggccgcgcggctcgcatgggggtgctggtccgttccgccgaagcgttggaaacatgcggcaaagtcaatgccgtcgtattggataagaccggcacgatcaccgccggcaaacccacccttaccgatgtgctgccgttgggcgtgtggcatcggcgtcccgatgatttgctgacgatcgtcgccgccgccgaacgcgattccgaacacccgctcgctgctgcgatcgttgccgcagctgcggaaaaagccgacgtcgcggacgttgcggaactcgcgcaaaccaccgattttcaggcgattgccggccgtggcgtcaccgcgcgcgtcaccttccgcggtctgccgcacaccgtcgccgtcggcaacaccgacctgatcgacgaccttgacgtcgacatgcccgacgttacgtccgatacctccgaaattgcctccgagaccatccacgatacgaacctcgacgccatcatcgccgacatggaacgcctgtcgcagcaaggcaaaacgccgatcctagcggccatcgacggccatctcgccggcatcgtcgccgtcgccgacgtgccgaaagccgactcgcgccaagccatcgaactgctccgcaaacgtggcgtcgaagccgtcatgctcacgggagacaatccgaccaccgcacgcgccatcgcaagccaggtcggtatcgacgaacgtcatgtgatcgccggcgtgcggccggaacgcaaggccgacgaaatcgcaaaactccaatcgcaaggctatacggtggcgatggtcggcgacggcatcaacgacgcgcccgccctcgcccgagccgacgtcggattcgccatcggcaccggcaccgacgtggccatccaatccgccgacgtgacactgatgggcggatcgctgatgggactcgtgcacgcgctcgacctgacgcatgccgccatgcgcaacatcgcgcaaaacctcggcttcgcactcggctacaacagcatcggcatcgtgatcgcggccggcgtgctgtatccgttcaccggaacgctgctgaatccgatgatcgccggcgccgcgatggcgttctcgtcgttgtgcgtggtgacgaacgcaagccggctgcgcctgttcgatccggacgcggaggcggcgaaaaacaagacgtatcgggtacgcaagcccgatccgagcaaaaataatggcaaccagcacagtcggaaaggaacgatcatgggactgttcagcgatcacaaggccaagaaggaagccgagaacatgggcgcgatgggcgccggacactgctgcggcggtcatgacggccacggcatggcttcgaatatgggcgattccgcggcgaacgttgcgaaggacccggtttgcggcatgagcgtcgatccggccaccgcggccgcgacccgcgaatacggcggcgtcacctactacttctgcaaccccggttgcgccgacaagttcgcccagaacccggccgcctacctgggctgagacctgattctcgtccgtccccaatctgccgacatcgaatgacatccggccgtcggcgggttggggatttttgttgaatggttgatttacggattccgattcacggacgaacgataagattcccctcccgcactccggagagcgcgtcccgccccgctacaagcgtgcgcgtgacgacgccgttaagcgtcatgccatcgcaggcgcagatcggattgcggctttccaaagcggtagcatccacaacaaaccgttcgtacgggcgaataatcgccaaatcggcccgcaataccggcgttatatcgccacgatcgtcaagtcccacaagccgtgcggtgttgcacgacatccaccgcacgacgtcggccaaactcaagccgcgccgcatcgcacccgtcaacaccgcgcggaatccgacctgcagactggaaacgccaccccacgcggtggcgagcgtgccggctttcatatccgcgctggccggggaatgatcggtgacgacaccatccaacgtgccgtcggcaagccccgcccatagcgcgtcctgctcatgcagatcacgaatcggcggacagcatttgaccgcggtggcgttgtcgggaatatggtcgcaatccaacgtgaggtaatgcggacaggtctccgcgctgaccggcagtccttcggccttcgtccgccgcagcacgtccacgctcagaccgctggacacgtgcagaatatgcgtgcggcagccggtgcgtgccaccagccgtacgatcttgcgcaccgcgttcgcctcgcattcggccgggcgcgatgccgcgttcaacagtgttcgcaacagtcggggattttgttgccgcgttagtcgcccatttcgctggtttggcaccgtttcttctatgccgaatccgcccgatatgcgatgttgattgtgtggggtaagctgtttttgccatggtcggtcatctcctgatggtgggtcgcgttgccaagaggcgccgccactgcctgtgatggatgcatttcagtgcttacggcatctgaaattcttcattcgtcgtgacagttgtcggcggccaaacctggtgaaacccggaaagcaaggggtagcatcgtcaggagagcggatgcgccgcgtgagaatgtactgcagggaagggcgatgagcgtgacttctggaattatgctttcagacaatatgggggcttcgaaggacgccatggacgaggaaggcaatgctgccgcggacctcggcttggtggcgcgcatccgggaatccttcgattcgctgactgcgacggaacgtgaggccgcgcagttcattctgggtcatctaaccgacgtgctggtctgcaattccgtggaattgtcgcagttgagcggcatctcgcagccgacgctcagccgcctgtaccgcaagctcggctatgcgaacgcgggcgaattcagacgtgacgtgcgtcgcgtccatcgtcctggctctccggagctttcacggcacacccagtgcgacgatttggttgccgaccatctgcgccgtgacgaggaaagcctgaaacgcacgtttgaaggcatcgaccgcgcgcaactgtcatccgcatgccaagccatggccacggccccgcatgtggcggtggtcgggtaccgcagcagctatcccgtggcgctgcacatgcgcgaacagctgatgcggctacgcggaaacgttgatattctgccgaatccaggccagtccatagccgaagatctggttgattatgcggcaggcgacgtaatcgtcatcatcggcgtgggccggcgtcttcccttcttctcgcggctcatcgacgtgatgcttgagcgcggcctgaccgtggtggtgattggcgacatttcggcgcgcaacgccgtcatcggccgtaacgtcgccttcttcaaagtggtgctgaactcccacgtgctgacgagcttcaccgcggcgttcgccctgatcgccctgatggtggacgaagtcggaaaatgcctcgtcgataccgaagacgaggtgcacgcgcgtatcgaaggcatcaacgattgcttcgatgcgctcgatgagcttgaagattgatagggaaaatctaggcgcggcacgtcccgttggaacggcggtaaacggaagtggaagcgggaatgggaacggaatgaattcaaaacgaaacatgctggcgtacgaccggtcctccaccggattgtgggtggctttgatcttcctcgtatcgctgaatctgcggcccgccatcgccgccgtcgggccggtcctcgcccaaatgggaaccgaccttgcgtggggtgagggcgtgcagggcgtattgacggcgattccgctgatcgccttcgccgcggtcagcccgctggtcacgttccttgcacgccgcatcggcatcgacatgtcgattctgctggccctgctgtgcatcgcggcgggcgacgccatccgctcgttcggcggtggcgtcggcatctggctgggcacggtggtgttcgcctccgccatcgccgtcggcaacgttcttgtgccggtgatcgcaaaacgtgactacgccggccatgtcgcgatggcgaccggcgtctattccggctgcatcaccgccggcagcgccaccgcaggtttgctgtccgcgccgcttgcgcagatgtggggcggttggcgtgcgtcactcgccttctggagtgtgcctccgctggttgtcgccgcgctgtgggcgttgcgtatcctgcacaatcgcaaagtcgttatcgcttccgccggcggcaccatcgaaatcagcgatactggcgatatcgatgatattggcgattgcagcacgacggccaacgtacaaaacccgcattctgcacagcgaccggcatgttccacgcaatcgtcgcatggcgtgttcacccgcgtgctgcgccgtacgatgacgtggtacgtgacggccttcatggggctgcaatcatccgctttctacaccatgtccaattggatgccgtccatctcggcgtccatcggctacgatgcctccaccgccggcgtgcatctgttcatcttccaaggcatcggcatcctttccggcttggtcattcctaagctcatgaacgtgcgcggcaaccaggtctgcgcggcgcttaccgccagcgctcccatgctgatcgctggccttggcatgctgctgctgccgcatctcatgccggtatgggcgttcgtcggcggctgcgcgcaaggcgcgtccctggtggtggcgctcgcattgatcgcgttgcgcggccgtgacagcgccgaaaccgtggtgctgtcgggcgtcgcgcagtcgttcggctatctgatcgcctcgctcggcccgcttatgttcggcgtgctggtccaggccaccggcggccatcatgtgccgctgatggtgttcacgttcgtcgctttcctgcaatgcgtcgtcgcggtcgtcgtcggcaggccttccaaaatatgatttttcgcatctcgcgaaatcgtaagcgtccgcagagggaagtaccgttagccgtatgacaagccctaagactgacgacggtacaatgcatctgctcgatcctgctccattcggacgtatccttccggccatggtcacccccatgaaggccgacggagccgttgatttcgaggccgcgcagcgtctggccaagcagctcgtggcggacggtgccgacggtcttgtggtcaacggcaccaccggcgaatcgccgaccacccatatggaggagaaggtcgagctggttcaggccgtcaaggaggtcgtggacgtgccggtcatctccggcgcaggctccaacgacaccgcgcacaccgtgcgcatggtggagcagacccaggaggcgggcgccgacgcggtgctcgtggtcgccccgtactattcccgtccgtcgcaggagggcgtgttccgccactacaaggcggtcaacgactccgcggacaagccgatcatcgtctacgatgtgcctggccgtaccggactgcacatccagctggagacctaccgccgtctggccgagctcgaccacgtccaggccgtcaaggacgccaccggagacatcgccggcgcggtacgcaagcgtatggaaaccggcctgacctggtattcgggcgatgacggcctgttcctgccattcctgtccgtcggcgcagtcggcatcatctccgtgatcgcgcacgccgccgccggcccgatgcgcgacctcgccaacgcgttcgaccgtggcgacatccacgaggcgcagcgcatctccgtgcagctggcaccgctcgtcgaagcgatgaacggcaacggcttccaggccgtgatggccaaggccgcgctcaaggtgcgcggagtcctcgactccacggaaatgcgcctgccgaacgtcggcccgggcgaagcggagcttgtgcgcgcggaaaagggcatgcgcgccgcagggctgctgtaaaatcgcattacataacgtgcggttggccgccgcgcatgtacggcggcggcctgctttaattcctcgtcttcgcagaggcggagacaatgagtaacagaaatccaactaggaaatggcaacagaagaaaccaagaacaccacaacgcacaagcgcggcagcaaagctgccaagcgcaccgaatccgcagccaaggcaaccaagtccgacaaggctgtgaagtccgagaagaccgccaccaagaaggcgaagtcctccacccgcggccgcggtggctcgtcgcgcaacggcggctcccgtggctcccgcggcaacggctcgaaccgtcgcccgtcacattccgctccgcaatccaccgcgccccagcaggacgaggtgctgatcgccccgccgaagtaccgcaagggctccatgcgcatcgtgccgctcggcggtctgggcgagatcggccgcaacatgaacgtggtcgaatacaacggacatatcctgctcatcgactgcggcgtgctcttcccggaagaggagcagccgggcgtggacctcatcctgcctgacttccactacatcaaggaccgtctcgacaaggtcgaggcgctcgtgctcacccacggccacgaagaccacatcggtggcgtgccgtacctgctcaagctccgcccggacattccgctgatcggttccaagctcaccctcgccttcgttgaggccaagtgcaaggaacaccgcatcaacccgacgctcgtcgaggtcaagggacgcgacaagctcaaggtcggcccgttcaacctggaattcgtgaacgtcacgcactccattccggacgcgctcgccgtgttcgtgcagacccccgccggctcgcttatcgacaccggcgacatcaagctcgaccagctgccgctcgaccaccgcatcaccgatctggtggaattcggcaagctcggcgaaaagggcgtggacctcctgatgatggactccaccaacgccgaggtcccgggcttcgtcaagccggaaacctccatcggtccggcactcgaccaggcgttcgcacaggccacgcgcaaaatcatcgtggccagcttctccagccacgtgcaccgcgtgcagcaggtcgtcgacgcggcccacaagtacggccgcaaggtcgtgttcgtcggacgttccatggtccgcaacatgtccatcgcagcagatctgggctacctgcgtctgcccgaggacaccgtcatcgacctgaagcaggcccatgacgtgcaggacgacaagctcgtctacatgtgcaccggctcccagggcgagccgatggccgcgctcggccgcatcgccgacggcaaccatcgtgacatcaccatcaacgagttcgacacggtgatcctcgccagctccctgatcccaggcaacgagcatggcgtctacaaggtcatcaacaagctcgtgcagctcggagcccgcgtggtcaaccgagacaacgccgccgtgcacgtctccggccactgcaacgaaggcgagctgctgtacatgtacaacatcgtcaagccgaagtgcgccatgcctatccacggcgaaaaccgccacttggtggccaacggcatgatcgccgtcaagaccggcgtcgatccgcagaacgtcgtgctggccgaagacggcgacgtcgtcgacctgtaccacggccaggccgcggtcgtcggctccgtgccgtgcggctacgtctacgtcgatggcgattccgtcggcgaactgaccgacgaagaactcgagaagcgccgcatcctcggcaccgaaggcttcgtgtccagcttcgtggtcgtcgacaccgagaccgcggatgtcatcaccggtccgaagatctacctcaacgcggtcgcggaagacgaaagcgagttcgacaaggtccgtcaccagatcgtcgagcagctgcaggacgcgatgatgcagggcacgcgcgacacctacaagctgcagcagatcatgcgacgcacgctcggcggctgggtggcacgacagctgcaccgcaagccgatgatcgtccccgtcgtcgccgacatcgcgcaggacgtggatgacgcgatgggactgaacgccgcgaaataagccgtaaatttaccataaattgaatcaaggcgacgtgatcggcacaactgattgcgccgccttctgttaccagaaagaaggagtgacatgccaggagcaaacctcacccgaatcgaagcggaagaacgcaaaagcatcatcgccgcgccaatccattacacggtcaagcttgacctgacccgcggagccaaggatttcggctccgaaaccaccatcaccttcgacgcgaagccgggggagtcaagcttccttgacctcatcgccaacgaagtcagcgaaatcaccctcaacggtgaaaccctcgacccggctgaagcgtacgtcgacagccgcatcgaactgaagaacctcaaggagcacaacgaggttaccgtcaaggcgatgtgccagtactccaacaccggcgaaggcctgcaccgcagcgtcgacccgtccgacggcaacgtctacctgtacacccagttcgaagtgccggacgcccgccgcgtctacgccgtgttcgaccagcctgatctgaaggccgtgttcgacttctccgtgctcgccgccaaatcctggatcgtcacgtccaacatgcccacctcctccgtgaccgacaacgaaaccgtcaccgaggaaggcacgctcggcgatcacgccgccgaaaccaccaagctgtgggtgttcgaaccgaccccgaccatgagctcctacctcaccgccatctgcgccggaccgtacgccgaatggcacaccgaatacgccaatgaggacggccgcaccgtgccgatggccatgtactgccgccaggcgctcgccaaggccttcagcaaggacgtcgactacctgttcgacatcaccaagaaaggcttcgccttctacgccaagacctggggcgtgccgtacccgtacgccaagttcgaccagatctacgtgccggaatacaacgccggcgccatggagaacatcggcatggtcaccatccgcgaccagtacgtgttcgaatccaaggtcaccgacgcctatgcggaacgacgcgtcgtcaccgtgctgcacgagctcgcccacatgtggttcggcgactacgtgaccatgaagtggtggaacgacctgtggctcaacgaatccttcgccgagttcacgtccaccctcgccaccgccgaagccaccgaatggaaggacgcctgggcaaccttcagctccggcgaaaagagctgggcgttgaatcaggaccagctgagcaccacccacccgatcgtcgccccgatcaacgacctcaacgacacctacgtcaacttcgacggcatcacctacgccaagggcgcctccgtgctgaagcagctcgtgtactacgtgggccgtgagaagttcttcaagggcatcaacaactacctcaacaagcacgcctactccaacgccaccctcgccgacctgctcgccgaactggaactcacttccggccgcgacctgaaggcgtggagcgcccagtggcttgaggaatccggcatcaacaccatcgccaccgaagtcgaagagaacgaggacggcaccatcaagcgtctcgccctgcgccagaccgctccggccgagcatcccgtgctgcgcgcccaccgtctcgccgtcggcttctacaacgaggatccggaaaccggcaagatcgtgcgcaccgaccgtttcgaactggacgtcgacggcgaactgacggtcgtcgacgcggccgccggcaaggcacgtccgtcgctgatcctggtgaatgacgacgacctgacctacacgaagctgcgtttcgacgacaagagcctcgcattcgcgacaagcaacctgtaccgcttcgacgacgcgctcgcccgttccgtgatctggctcgccctgtgggacatgacccgcgacggcgaactgccggcacgccagttcatcgacacctcgctggccgcgctcgccaccgaacacgagtccaccaccttccgttacgcgttggcacaggtcagcaccaccgcatggcattacaccgctccggcagagcgtgccgagatcgtgaagcatgtggccgccgaactgttcaagctggcgggtcaggccaaggccggctccgacgaacagttccagctcgtcaccgcctacctgggctacggcgagccgggcgacgaggcgttcgtcgccaacgcgaagggcctgctcgacggttccgtggcattcgacggtctggaaatcgacaacaacttccgctggaccatcatcaacgcgctgagcaccgtcaacgcgatcgaccaggcgggaatcgacgccgaactggccaagcgcgaaaccaccgagaaccgtgagttcgcctatggcgcacgcgccgtggccggtaccgccgaagcgaaggcatgggcttggaacgaggccctgcacaacgacgagctgaccaacatgcagcttgaggctgtggccggtggcttcgcagccaccccgcgcgccgacttggccgaaccgtacgccgagaagtatttcgaggtcgccgactggatttgggagcacaagaccttccacatggcggaagcgctgctcgaaggcctgtatccgggctatgccgatccggcgaagctcgtggagctgggtgacgcctggctcgcctcccataaggacgcggacaacgccttgcagcgcattgtgcgtggcaacgtcgaggcttctcaccgcacgctgaaagtgcgcgacttcaacgccgcgctctgatagcaggggcgacaggaacgttcccgcttaagagccgtcatgtcgtcgcacgacttttgattttgggtgcgattttcaaagtcgtgcgacaagcgtgctggctttcataccctctaactcttatttttcgctggttttcaacggaaaatgatagttagggggtatttctttatcaagtgttgccgcacgacttgattttccgccttgaaatcaaagtcgtgcgacacgaaaagggcattgcgcgccgtgaaatgctttgaattgtgaagtgttatgcgattgcgtcgtcacctgctggtttcggcggtacggttgagtacgataggtcacggaaatatcgtttgcagatagcgaggatttgagactcatgccacgtatgttcggaaccgacggcgttcgaggattggcgaatagggatttgacggcacagctggcgctcgatttgggtgacgccgcggtgcgcgtgctgggtgatgacgagcggagcgaattcgaaagccgtcgccgtgcgctggtcggtcgtgatacacgagtttccggcgatttcctcgccgccgcactgtccgctggcatgtccgctggcggcttcgacgtgatcgacgccggcatcatcccgacgccgggcgtcgcatacctgacgtccgtgctcaacgtggaaatgggcgcggtgatctccgcatcccacaatccgatgcccgacaacggcatcaagttcttcgcccgcggcggcttcaagctgcccgacaccaaggaagacgagatcgaagcggtgctcggccaggattgggatcgtccgaccggtgcgggcgtgggtcgtgtcagccatgacaccgccaccgcaaccaacctgtacatcgaccatctggtttccgccatcgcgccggtcggtccggacaagtcgcagccgacgccgctgaagggcctgaagatcgtggccgattgcgcgaacggcgccacgtccgtggtcgctccggaagccttgcgccgcgccggcgccgacgtgaccgtcatcaacgcgtcgccggacggctacaacatcaacaagaacgccggctccacccatcctgagcagctgcaggccatggtcaaggcctccggcgccgtcatgggcgttgccttcgatggcgatgccgaccgttgccttgccgtggatgaggacggcaacatggtcaacggcgatcagatcatgggcattctggcgcgcgccaagaagaacgcgggcaagctcaaccatgacaccctcgtcgtgacggtgatgagcaacctcggtctgaagttggccctgcgttccatgggcatcaagaccgtgcagaccaacgtgggcgaccgttacgtgcttgaggagatgctgcgaggcgattattcgctcggcggcgagcagtccggccacgtgatcaaccgtgaattcgccaccaccggcgacggcaccctgaccgcgctcaccctgtgcaacgaggtcgtcaaatccggtaagagcctgaaggaactggccgccgacttcccgcagctgccgcagacgctcatcaacgtgccgaacgtggacaagatggccgccaagaccaacgccaaggtgcaggccgcggtggaacgcgaagagaagctgctgggcgacaccggccgcgtgctgctgcgtccgtccggcaccgagccgctcgtgcgcgtcatggccgaagccgaaacccagcagcaggcagacgaagtgtgcgatcgcctcgccaaggtcgtcgccgacgaactcaccctgtaagagcccgcaaggagatatgccccatgttcggacacaactcgaaagtggacctcgaactcaaccgcgaggtcgaaaagctcatcaaaaccggcggcaaagagaaaatcatgccgatcgtgcaggccggcgaaccggtattacgccagcagaccatcgcctacgacggccagttgagccgcaaaacgcttgacaagctcatcgacaccatgcgcaccaccatgctggaagcgccgggcgtgggcctcgcagccacccagatcggtctcggtctggctttggccgtcgtcgaagaccacgtatgcgaaggcgacgatggcgatccgcgcgaagccgcggaattccccttccacgccatcatcaaccccagctacgagccgatcggcaccgaaacccgcagcttctacgaaggctgcctgagcttcgacggttaccaggccgtacgcaagcgttggcttgacatcaccgcccgttggcaggatgaggacggcaacaagcatgaggaacatctgcacggctggccggcccgcatcttccagcatgaaaccgaccatttgagcggtgaactgtacatcgaccaggccgaaatccgaagcctgaccaccaatgagaaccttgaggatttctggtgcgaggatccggtaccgaccgaagcggcggccgaactcggcttcgaactgtaatcgcgtaaacgaacaagacaagaacgatgaatgcctcccaggcgaacacttgggaggcattcatcatattcgggattattggaatgttcgaaacatgagtattccaaatattccaatatttcagtattccggattcactagcacatcgtacgtatccgtgttccgctcggcatccgaacgcagatcccagccaggcttgcgcattccatacaacaccagcggcggtaaaccgagcacaagcacgactacagccacaagaatcgcatatgaaacgctatccaaaccggtgaaaccagccggtctcacgaaagtcaacacgaatgccgcggcggaagcgacgaaaccgacgcccgcgaccaaccgaatcgcaggaactcgatacgtgcggcggacttctggatgggtgttgcgcagacgaatcgcggcggcaaacatcaacatgtacatcaccagatacagcgcggtcgccatatccaccagcgtcgcgaaagccgtgttgccattggggatcaacacgaacagcaacgccagcacggtcacgataatgccttgcggaatcagaatgccttcctgcacgtcgtgggcattgcgcttctgcagcgcgggaggcatcagtcccgtgcgggcggccgctagcaaaccgcgagaaggaccagctatccaagccaccacggaagcgaacgcgcctagcgcgatgagcagcgaaatcaccggagtgccccaacccatgccaaaatggtcgaagaactccctgaacgccagattgatgccgtcgatgagccccagctcacgatgcggcacagcaaaggcgattgccaaagtcggcagcacaagtaccagcagaatcagcgcggtcgctagtgcaatggcgcgtgggaattgacgtcccggatgctccaagtcgttggcatgcacggcattgacctccatacccgcgtaggcgagcacattggatacgattagcacaatcgacgcgatgcccgtccacggcggaagcagcgcggatgcgtgcagggaggtctgcactggcttaccgatcgccagccagataatgccgaagacgataagcagcaacgcaggaaacagcgtgccgataagtcccgaaatcgacccgaccttggcgaacagattgccgccgcgcaacgccaccatcgtgcttgcccaatacaacacgatgatcaccgcggccacatatacgccattattgcccaagccacccatgccgaacacatacgacaggctgacggcgatgaacgcaatctgtatcggataccacactacattctgaatccactgcagccaaatggcgagaaatccgatgcgattgccgaacgcctcacgcacccacacgtacacgccacctttccagccggtggccagttcggcagccaccagcgcggtcggcaccaggaaaacgaccgccggaatgagatacagcagaatggaagcgagaccataatcggccatggccggcagagagcgtagcgaggccaccgccaccacggtcaacatcgccagttggctgactgtcatcatggttttgccggttttattggcaacggttgccgtgcttgcgattgcgccgtgcccgtcagcgccgttccctctattcgccccggcatgcgcaggtatgcccgtacgattgcggtttcctgcgacggcagacggattgcgtggcgttgttgtcggtgccgtcgcagcgttcgtcgtggaacgtgcggacccgggatgtgcagctgcgcttgcatcgtgcgctaccacagcaagcggctttttcatatgaactgtcattgcagccagctttcgtaaacataatcgttgtgggaatgaacatgaatttccttaatgcgggaaacgatggaattcgtggaatgaccgcgaaatatcagtggtggaatccggatgcacgagcctcgcttggcattggtgagcgcagtccgtccagatacttcacacacgacttcaaatccttgatgaacgcttcggccatatcgtggctgaaaccgttacgcaccacaatgcgctgcacggtcacctgcgtcagatccaccggcatcggataagccggcaccagccatcccttcatgcgcagccgatcctgcagatcgtacagattccacttgcgatccggcttgtcgttgagcatccatgcgaacaccggaatgtcggaaccgtcgttccacagcgtaaaatcatccatctgctcgatctcgcccgacagatatttcgccacatcatgcgaagtctgctgcacccttcgatacccgtcgaatcccaaacgcaggaacatgtagtactgcagcagtacctgtgcgcccggacgggagaagttcagtgcgaaagtcggcatttcgccgccgagataactcaccttgaaaataaggctttccggcaggtcagcggtttcgcgccatacgacccatcccaaaccggggtagaccagaccgtacttgtgaccggaggtgctgatggagtaaacgcgcttgacgcggaagtcccatgcgaggtccggctggatgaatggtgcgatcatacctcccgaagcgccgtccacatggatgcgcacatcaagtccggtgcgctcctcgatgcggtccagtgcttcgctgatctgttcgaccggctcatacatacccgtataggtcacgcccatgatggccaccacgccgatggtgttctcatcgacatacttgtcgagatcatggccgtcgagcactttgtggtcctcggaaatcggcacatagcgtggttccacgtcgaaatagttgcagaacttctcccagcacacctgcacggcgctgctcatcaccagattcggacgatcggtcggcaggtcggccttttcgcgggcttccttccaacggcgcttcaacgcgagtccgcccagcatgcaagcttccgacgagccgatggtggaggttccgatggcattcattggatcgggcgcatgccatagatcggcgagcatgtgccagcagcgcgattcgacttcggcggttttcgggtactcgtctttgtcgatcatgttcttgtcggccgcctccatgtacaggcggttcgcatgatcgtccatccacgtgctcacaaaagttgcaagattgagtcgcgcgttgccatccagcatggcctcgtcatgcaccacttggtaggcggtttccggcagactacccttctgtggaatggtaaatttcgagaacgcctgggcttccttcggacgggcgaacagcggattgatttccacgctgtcaggaacaacgcggtcgtcggcattgccgcaggtgttgtcgcagcaatgcgaattgttgttttcagtggtggaatgtgtttctgacattgcagttcctttcgttgatttggaacgtttgttgcgttccgggattcaaaaatgaaagtcgattctggatttttgctgggaaatggtcacatttgcgctatgtgaaaattcgtatggcaaccgcttcgcacggaggtatccgcgcgcggtttcgtaatgaacaccgtcattcgaactcgcatggttgtgttctcacaaagaggaatgcgcacgttggtttgttgcacattcttacacgctgaaggtgggtatcggctacgatgggcaggtatgaacgaatcgacgatgaatctttcctggctggatgacgcgaagcaggacatcgaacaatggtcggcatcgatgccgaatgacgccgacaaccagccgatcgactggcgatgggtgtcttcccttgacctgcgtaacggcattggtgccgccacaagacagcacgttgatttgttggcaatgctgcggtcctcgtcgccgcaactttccgccccgcagctgcacgccctgttgaaagatgatcttgcgattcgagatcggctcgaaccgaccatcgcgcagtgcaacagcacgttcatgatggattacgaccgacttatcgcttcctatcggctgccgcgcgcgcttgcttacgcgaaccgtcggttgtgcgacgaaatcgctgttctgcgacagattggcgtggcgatgggattgtggacggtcaccgaggaacgacgtgagcgcgtgacggttccggtgctgctgcccggttcggctttggcttccgggggagtggcgttggatgatattcaggatcgaaccgctgacatcgttaacggccgcgccgcccgtcgtgccgcagagaaaagtcagaagcgagccagtgactatgccatgtcgcgtgcgaacctgagtggagtaaccagtccgggcggctccacgttgtttgattacggttcggaaacgaaatccgctgaagcggcgcagttgcgtcggatggctgaataccgcaaatcggattggcgtgacgcttatcttcctggacgcgatgtggacaatgtcatgggaatcgacatcgaaaccaccggtactgacccggcgcgtgtgtacatcatcgacgtcggctttgaatatatgaacatgatttcccctcgccctgctgccgcacctactggataccaatacgagcagagttattacgaaacgggcgatgcgtatggtcagtcgcgtctgtcgttcggcgttcctgccgcgaacgcgacgctcggtaatccgctgattctcgatttgaccggtatcgatgtacgtgatcgtgcgtccggcttccgcctgttcgatgagtggccggaggctcaaatcggtttgctgcagcgattggagcagcaaccgtacgtagcgcacaacgctcgtttcgaacatagcttcttcatgttgaatgtggctggatatgcggaaagctaccgtgcgggcaagattacgattatcgacacgttgccgatgagccgccgttgggatgaagggtcaattccggacgacgagcatccgtacggcaataacacgttggacgcgtacgccaaacgccagggtgcgctcgatgaaagcaagtcggaacgtcacctcggtttggaagatacgcatatcatgctggttgccatgaaacatcacttgggtgtattgcatggcgaaggccgcggtccgtggggtgcgaatggcaagtctggcatcggtggcaagcattgcgggcgccgctggtagcatttgcgattcgtgtcgcagtttcctggttcttcttcccgtgaccgtcccgttttggctttcccttccggcttttgttacccgtaacgccgttttgcggttacaaaatgcggatgcgattgcggatttgcggggatggaatgggcgattgcggggatggtttcggtggttgcggggttggtcgggcctggtttgtcaagtttcgacacgccgatggaacgttggatttccaacggttcgcgcgttttaggggggatggattcacctctgcgattgtggagggggtccgggaaatcctcgcattttaggggggggatgagaggggtgggactctttgggatggggcggaatgggaatcgttgggctctttgagttgggtttttggatgaaaggattttgggatgctgctgcagtttgtgacggtgttgcagggggtgttggcgccggcgctgctcgtcatggcgttgagcgtcatgctcaccgtcggtgaggggcgtgacaagcctctgagcgcgtactggcggctggccggtttcgttgttggattcgccggcgcagtcgtattcgccgcgctgcgcgccaccgccgtcatcacgcaacgcacgttcgtcaactatccgaccctgtggtgctgcgtgatcctcgacgtggccgtgttcgtcatcgtcctgttcgcccgccgcatcaccgccgactggcacaaccaccgcgcgctactcgacatcgcgaatctcgttgcggcgcttgcgatcgcggccaccacctttcgtgcgctgcccgacgtgattctgcgactgacgatcttcgtcgagccgggcgatcccatcttcacttccgacatgctgttgcgcgcgctcggcttcgctttgggcgcggccgtcgcaatcatcgccgcgcttatcttccgcacgatgcgttccaccgccatccgctggtcgttcacgacggcggtgctgctgttggtcgtgctgttgttcgcacagcatttcaccgaccttgcgcagatcctccaatccaaacgcatcgtcagcttcccgaccgccgccttcctcgcgctcgtgtggggcatcaaccatcagcgcagcctgaccatcgcaatggcgctcgtcttcgccattccggcaatcgccagcatcgtcatgggcttcaaagtcaagccgaccggcgccaacgaggcgatcgcacgcacgcatatcgcgttccgccgccgcgcgaaagcggccggcgcgttcagcctggtcgccatgatctgcgtcaccgtggccctgacgtacggcgtcgcgcaaacgcagaaagtcgtcacgctgtcgccgccggaagactactcgctcgccgacggcgtggccaccatcaaattcagccagatttccgacggccacctgcaccgcttcgaataccgcgcgaaggacggcacctccatgcgattcatcatcatcaagaagaacggcggcgcgtacggcgtcggcctcgacgcgtgcgacaactgcggcgacgccggctactacgagaaggacggcaaaatcatctgcaagaagtgcgatgtggccatcaacctcgccaccatcggcttcaaaggcggctgcaacccgataccgttcgactaccaggtcaagccgggcaaaatcgtcatccaaacgtccacgctcgacgcgctgtcgagccatttccagtgagcgccgagaaaggtaagggggtgccatgttcttcctgaaaatgatctctcgctcgttcagccggcagttcaaacgccgtctgctcatcgccgtcaccgtgtgcctgtccgccaccgtcagcgtggccatgctcggcgtggtgttcgacgtgggcgacaagctcaacgcggagctgagcacgtatggttcgaatatcgtcgtgcagccgaagtccgacgctgtggtgagcgatttgtacaataccggcgattctgccggctcggcttcgggtagttcgtccggttcggacgggggttccacttccgacggctcggctgcggcggacagcgccgacccgaccgcgtttctgaaggagtcggacgcgcagaagatcaagaccatcttctgggcgttcaacatcaccaatttcgcgccggaattgaacatccacgcggatgcggggtgtgtcggttcgggggctggttcggctggctctgctggaacggctggtgcgtcaggtgcggctgcttccgcggcgaaatgcaaggcgaccaacgtgccgatcgtgggcacgtggttcgccaaaaccctgcacatggactccggcgaatccactgtggccggcatgaacggaatgcgctcatggtggaaaatcaacggaacctggccgaaagacgacagcgagcaggcgatggtcggcagcgagctcgccgcgaaactgggtgtgaacgtcggtgacagcgttacgctcgacaagacgatcgccgtcggtgcggacgacaatacgaacggaggtaccgggaaaaccggcaaatcctccaccgaacgcaatcgcgtgaaagtgaaaatcgtcggcatcttcgattcgggcgattccgacaacagcgccatttatatgccgtccatcgccgcgcaaacgcttgcgaatctgccgaattccatcgacaagattgaagtcaaggcgctcaccacgcccgacaacgacctcgcgcgcaaggcgtcgaagaatccgaacgcgctcacgcaggacgagtgggagacgtggtattgcaccgcgtatccgtcgtcgatcgcgtaccagatcgaagaggtgctgccgggcgcggtggccaagcaggtgcgccaggtggccgcgctgcagggcgatgtgctgaacaagacgcaggcggtgatggtgctgatgaccgtgctgtcgctggttgccgccgcgatcgccgtagcaaacctgatggccgcgtcgattggcgaacgcggttcggaattggcgctgttgaaggcgatcggcgccacggacggtgcggtttcgcgccttatgctcgccgaaacggcggtgatttcgctggttggtgcgattgccggtgcgctgcttggctcgggcgttgcacagatcgtggggcacgtggtgttcggctcgggcatcaccatgcgtccgatggtgttcgtgttggttttcgtgttgctggcggtcactgtgctcgtggcctcgctttcgtcgattcgggcgattctgggcttgcgtccggcggaggtgctgcatggtaggtgagttgtgcttggctttcgtagggggtgtgcgatgacgaatcgcaagatgttcttcactatgctgtggggcgcggtgttccgccgtcgctcccgtgcgatgatggccgtgatcgcgtcgctcgtcggcgcggccacgctgttctgccttgcatccgtgtgcgtcgcggtgccgcagcagatgaacgaggaaatgcgcgcgtacggcgcgaacctgattgtcacgcccgcgtccgcaacgggcaaatcgcaaggcatcggtactgcaaccgtacgcaacgtgacggcgctcgtcggcgccggacacagcgtgaaatcagccgcataccggtatgagagcgtgcgcatcaattccgcgccgtacaccatcgccggcgtggacgtgaaagccgtccgcgcgctcaatcgccattggaacgtgacgggcgattggcccggctcggacaacgtgatggtcggccgcgacgtcgccgacgcgctcggcgtgaaagtcggcagccgcgtcaccatcggctaccgcgccgccgacgcgtctgcttcagcgtcttcttccgcgtccgcaaaatccgattcggacgaatcaactgaaacggcagaatcgtccgcgcagggcacgcagagtacacaaactacgcaaggcgaacagaccacgcaagccacggaaaacggccgcgtctcgtccgacatcatggataacaacggcaccgaattccgtatcgctggcatcgtcgacaccggcggcaacgaggattccatcatctacgccactaccgcggacgtgtccaaacttgcgggccacgagcgcggcgccgacgtggtcgaatactcggtgaacgccatgggggatgagttgaacgccatcgtcaacagaatcaacaaaaatacaaacactgccgtcaaagcgcagaccgtcaccagaatcacctcgtccgacacccgcatcatcgccatgctgcagaccctgttctggattgtgtcgctcgtcgtgctcgtgctgacgctcgtcggagtgggcaccaccatcagctccatcgtgagccagcgtcgcaacgaaatcggcctgcgcaaagcccttggcgccgactcacgcgccatcggtgttgaattctacgtggaatccggcatctacggcttgatcggcggtctgctcggcactgctatcggctatgtgctggcgcgtgtgctgtgcgccaccgtcttcggtcgcgcgatcggcttcgactggctgctcggcgccggctcgctgctgctgagcgtggcgatcgccgtcatcgcctccattccaccggtccgccgcgctacccgtatcgaccccgccatcgttttgagggaggaataatcatggaaaacgaccacatgttgcttgaacttgaccatatttccaagatttatggtgatttgcacgctgtagacgacctgagtctgaccgttccgcaagggcaatggttggcgattgtcggctcgtccggttccggcaaaaccacgctgatgaacatgatcggctgcatggatacgccgtcgaagggttccgtcatgcttgaaggccggcgattggaggatctgaacgcccgccagctcgccgacgtgcgcaagaacatgataggactagtgttccaaaagttttacctcgtgcctcatctgacggcggtggagaacgtgatggtggcgcaatactaccattccgtggtcgacgagaagcaggcgatggaagcgctggaacgagtgggattgaaggagcgtgcgcatcacctgcccggccagctgtccggcggtgagcagcagcgcgtgtgcatcgcccgcgcgctcatcaactgcccgaagctcatcctcgctgacgagccgaccggcaacctggacgaaaagaacgagaagatcgtgctcgacctgttccgccagctgcacgagcagggcaccacgatcatcgtcgtgacgcatgacgcgctcgtcgcctcctgcgcacaacgcgagatcatgctcaaccatggtgtgctcgtcggcgaacagtggaacgacgaggatgcgaaacgcgcgtacgaagcggccggcggcaagcccgcattcaccggttccgccgcggaaggcgcgcagaacgggggtattgcgatttcgttcgccgaccccacgaaggccgcaaaaaccggcgatacggacgcggccaacgttgccgttgcggctggcgttgccgacgatacggacgtagagcccgacgtcacgaaaggggagcaggcatgagcaccgcacaatcgaacgcagtcaaagtcatcgcgctatccgcggcgagcatcgcgctgctatcggcatgcggcgagccgaaagccacgccgatggacgacgaatacgccggcaattccggcgaaagcgtgcaatcgcaggaagagaagtcgaaaactgacggcaaggcgtccggcgacacggcagacgacggcgacgccaccaaaaaccgtgccgacgcgaattccgcaacatccgacaagcaggacaccggcaactacgcggatggcgactattcgatcaacggccagtacgggccggtcggcgaggacaccatcgacgtgcatctgaccgttaaggaccagaacgtgacggccgtgaagatcgtcggccatccgttcacgtccatctccaaaaagcatcagaacgactttgccaaagccgtgccggacgcggtggtcggcaagccgttgaaggaccttaaagtcgacaagctcgccggtgccagctggacctccgaagccttcaacaaggcgttggaagtggcgcgtcaggaagcgtcaatccaatagcccattccttctgaaaccgacacggcatgcccgtcttgcgtcggtgcggacggttttcctgtggttaccgtgcggattcggcgcatatgttcggccagagcaacgtggccatgttctcggcccaggaatcagacttgcgttccttgccggattgccgttcccctccggcttcctgccccgccaacgctttgcaagccagcatggaacccagcaccgtgctgaacaggaacgtgtagtccaaacggttttgaaacactccgtcggcgatgccacgttccatgaaccccacgaaccgttcttcggccggcgctagaacttgtgctgcgatcgccttcagcgtggcgttgtcggaagacagcaccacgcccacggctttcaatccgagttcgctgtcgaagcagtcctggatgcgtcgcagcatggtggccagtccgctccgcgacggcttcaaatcgttgaaattcggtagtccggcaacttccggttggatgcgttgcaataaatcgtcggcgtttcggtagcgtcggtagattgtggtctttgctacccctgaacgtcgtgcgacctcttcgatggtcaccgctccgataccatcggaaatcactatccccaatgtggctttcatgattttgcggtcggtttgctcccgtaatcgctcacgtcggccacgtactgtgccgacgtcttcctgcgtggttttttgcaccgtcttccgcgtgccctcttgcgtggttccgcccatcatgccgcgatcactttcgtgctttccagcttgcttacgtaccaatggttgaacttgaccagtggaatgcgcagtagcaggcctatcagcagcagcggcggaatgaacagcagtagcgcgccaatcgcaaaccagtaatcgttactgtagattccgccgatcgccgcgcgcattgctgtgattgaatgcgtcgcaggcaggaacgggctgatgccgctgatgattttcggcagcacggccagcggatatgcgccgttcgctccggagatctgcatgacgagaaacagcacgccgatggctttgccgacgttgccgaagctggccacgagcgtgtaggtgaagaacgagaacactaggctgctcacccagccggacagcatgaacagcagcggatgcaccgcctggacatggaggaacagcagactgcctcccaaggagaacgtgctctgcaatagtccgatcacgccgaacacaccgtaatgtccgagaaacagctgatgcggtttcgggtcgccgagttccttgcgcaccttacgcgagacggtggtcttgagcgtcactgccatgagcagcgaaccgacccacagtggcaggatcgtgtagaacggtgccatctgcgaaccgaaattcttgactgggaacaccgcgttgcgtttcacttttacaggggctgcaagcgcggcggccaacgagtcggtattatcgctgagcacatctttgacggcgctcatatcgccgctgttcagcgcatcggtcaatgttcctgtgaatgcgcccagttttttgcccgcgccggccagactatcggcggtggaatccaacacgctgctgatggcggtcagattcttatccgcggtcttggtggtgccgttcagattgcccagcgcgcctttcagatcggccgctgtggcattgagcgcggtggtggtgctggtaatggacgtggcgatatcgtcaagttgcggtttcagttggctctcatagtcggttttgatgccactgacggacgttgccgcctgctgcgccagtttcttgatctccgcacgttcggccgtggtatcgcttactttggcgtcgatgttgtcggcgctgccattcagcgccgatgctaggtcgttgagctgtgtgatggtggtgccgacgttggttttgagatggtcgatggcgttcctcaccgcttccggcagcttttcgtttgcgctgagcgcgtcgagcgaatcatagatctgctggtagctttgcgcctgcttgctgatgttcgtggcctggttgcgtaatgcgttggcggtgttgccggcctgcgtgcccgcattgccgaataggctgtccacatctgcttccatggctgtgaagctgttggcagaatcagtcagagccgtgcccagcgcggtggtgccggtcttcaacgcgcccgtcagatcctccacgccgctgccggcttgcttgagtgttgttcctacgcttttcgcattgccgctgacattggcgatcagaccgtcggaggactcaagcagatgccgtgcgctttgggtcagcgtgctgaacgtgcggagcgttccggaagcgtcggtgagcgtttccgcgaagtcgctgatattgccgttgaactgcgtgagttgttcctgcgcggctggcttgtcgagttggttggcgagctgcgatgccacactcagcgcggtgctggtcagtgtttcggagaacgtctcgttgacctgcgcgctgaccgtatcggcgccttggcctgtgatcttcggagccaaggcgttcttcttttcattgttgtagtaggcgatttcggcgtggttgccatcggatgcgaagaacgtcatcatacgggtgctgaagttctttggaatcaccacagctgcgtaatatttgccggatttggtgccgttgatggcttcttttttggtggtgaaggtccagtcgagctgatcgttggaacgcagcgtgttaaccacttggtcgccgatgttgatcttcactggaatgaggtcggaccggtatccgtcgtcctcattggctacggcgaatttcagattgccggtattggcgaacgggtcccagctggcggccacgttgaaccatgtgaagatgccggggatcacaacgagtccgatgacgatgatgatggagacgacgttgctggtgattcgccggatgtcgccgacgaacagtttccagatggttttcatgcgttgctcctttcctcgttgttttcgttgttttcggttgtctcggcggtctcggtagtctcggtggtgtccgtggcggcatcgttcgcggcggcgcttggaccggtcgtctgcattttctgcaccagtatggcgattccgtcatcttcattgtggttgacgcccgtcacgttttccgtcgtttctttgatgacgctggtattgcgattatcggatgtcgtgcgtttgccgctggtgcgtctccgcgttttgcgcagcagtctgttccgccgttcctgttgcgcccgctttttgcgacggatgcgtgccgcttggcgctccaccagcatggattggatcgattcatcgctcaaatggccgagctccacttgacggttcagattatcgcgcatgtattcgatgaccatgaggaagcccatgatgagcagaatccagacgacccacgtggccagtaccaccactttctctccgttggtgaacgagaacaccgccgccagagttaccggaactacgaatccgatcaccagagctccgcgcttgagtttcgggtacagttccgcgaaccgacttgcgcgttcctcgatcacctcgcggtagccgcctttgtcggccagcacctgaatggcttgggacatgttgtatccgcgttccggaagctccacttcctcgccgataatcatgtcgctttccttgatttcgcgggcgaagagtcggttgaggttgaccaacagaggacggaccaccaggccgatgacgaacgccatgccggcaaacagcagcagcgtgccgatcgccttggtccaatggccgtcgtagaagccggcgatggtctcgcggaatgcgtctatcgaatagctgaatggcacgaacggatagaccatgcggaagaacttcggcatcatctcgatcggatacaggccggaagcgcctggaatctgcacgatcaccaacgccacgcacaggcccttgccgatgtgcatgaacgtggtggacagcgcgtacgtgatgctcagatataccagcgatgtgatcatgccggtcagtatgaacagtggcgcgcaagccgtctgcacgccgagtatcagatcgccaacggtgcagatcgcgccttgaatgacgcccatcgtgccgagcaacaggtatcgggccagatacttttcggttgcggtcggatcgagaccctcaagcccctcgtcgtccacctccactttgtagatcaccacaaaggcgaacgcgcccacccacagtgccagattggtcatcagcggagccatgccggagccgtaggagttgacgggatacacgttcttcgtgtcgattacggtcggggactccatgaacgaggcgatcttatccgcgtcaagcgaaccgctgccggtcaacgatgcgagcagatccgcagtgcccagcgccttcaggtcggtgctgacggtggtgagcttcgtctccatcttcgccagctgctggtcggtttgctcaaggccgatgcgggcgtctgacgccacttggtcgagttggtcgagcacgatgttggtttgcctgaccacgctgtcctggctggtcacggtgccggcaagtgttccggccgtcccagccagcgagcccagcgcggaattcagtcgcggcagtgcgcctgaattgatggcgttgcgcgccgtgcctgcgcttttgagcgagttctgcgtgcctatgttgaaatcggtggacagtttggatacgctgccggctgtggcctgtgtgttctcgctcagggttttgaggtcggcgagtgttccggctgccgtgttgttggtattctccagtttgctgatgatttgctggtattgcgcgttgtcgctggcggatttgagcttctcgagcagtttcgcattgctgtcggtgatgttttgcatgccggtcaccgcctgctgtgccgatccacttgccgcggataccgccgacgagatctggttgatgctggctgtggattgcgccgtcgcttgggaaacaagtccggatccggtttccagcgcgctgttggcgttggacgaaagcgtgttgagctgggtttgcgctgtgccgatggcggtggatgcgcctgctagtcctctgcctgcgctcgccgcggccagctgcacgtcgttcagggcattgcgtgctgcttttgtctgctgtggcacattggctaactgggtgtcgagatccgcgattgcggagcgaatcgtgcctacgttccgcttggtgttgtcgagttcgccgatggtttcgttggcgatggcgttggtgttgccgctgatggtgccgttggccgagttgacggctttgacgagcacgtcgctgacggtggagacgaaggtgttgttgacggtgcggtcgaccacggtcgcgccttggtcggtgattttcggcgaaatcggactcgccttctcgttcacgtaatattcgagcgtggggcgatgcttgctgttggtgacgacgttggccagatcttcgctgaagtcggaagggatgacgattgcggcgtagcagtcgcccgactccaccgcttccatcgcgttggctttgcccatgaactcccagccgagctggtcgttgctcttcagcgtgccttcgatttgatcgccgagattgactttgccgagcagcgcgttgtctgtgccttcgtccatgttggccacggccactttgatgctgtccgtgttgccatagggattccagaacccgtagatgttgaaccatgcgtatagcgggggaatgagaatcaggccgatcataatcacccacgtggcgggtacggtgaccaatcgtttgaagtcacggcgcaggatctgcagtacgttgtgcattgtctctccggtttggcgaatcaattcccttatatggcgatacgtgttccgtagcgctacgcggttcgtatcgtataccgtgctcttggacaaagccaacacgtattcgctcaacgcgtcaacgtaccgcttgcgtgatggaatcgctattcttgctcgtctgtggccaaaagaggctgtcggcaacgcctgcctgcgaatccgtgcccccgacctcttcttcggcggcggatattgcccatgtttggtagcgtggattgcgggaaggagcggcatatgaacgaaaccgcacaatccgaggaatccgccgcggacgaatccgtcacgcaggcaaccctaggcaaggtcgctgaggaaagcagggcgatcgcatcggaggctgagattacggccatcgaagaaggcggcaggcagtctgtcggaggtggaatcagcaatcccgccgatcgtcgtctaccgctgatcgcccgtatctacggcattgtcatgctcatcgaaggtgtggtgatgatgcctgtcatcgtgctggcgtgcctatatgcggttagagccgtgttgtcgggcgaattggaattcaacgcgctcaatctcaccacgattctttcggtgatccatgccgccgtgctgttggtcgccaccgcgtgtctggcggtgtttggcgtgatgcttatcctcaataggcgtcggcatatcgcgcaatggacctatctgatgattccgctcacgcttgccgagggactgctgtctttggcgttgaaagggcttggcgtgaatcttgtcggtccggtcgtgcagcttgctgttctgatcgccctgcatatcaccgccgatccgtcgctgcgtgaggagcgtcgtctgcagttcgcgcttcgacgtatggatgcccgtagcgcgtacgaaagtgcggcttcccgaggaatggccggccgtgatttgactggcaggggctatatttcgctggatttcttcaatctgttctggctgttcaccattggttgtgtgttcggtttggtgatcgaaaccatctaccatttcatcctgttcggcgaataccaggaccgtgcgggcttcctatgggggccgttctcgcccatctatggtttcggcgtggtgatcgtcaccgtgttgctcaaccatttgtggcagtcgaattggttgctgattttctgctcaagcgcggtgatcggtggcgcgttcgaatatttcaccagctggttcatgcaggccgcgttcggtattcgcgcatgggattacacggggcaatggctttcgattgacgggcgtacatccggcaaatacatgttcttctggggcgtcctcggcttggtttgggtcaagttgattctgccgcgattattgcgattgatccagcgtattccgtggaagattcgctattcgttgacgctggtctgtttcatactcattttcgtcgatggcgtgatgacgctgatggcgcttgacgcttggtattcccgcatggctggggttgcgcagaattctcctgtttcgcagtttttcgccacgtatttcaatgatgatttcatggcgcatcgttttcagaccatgacgatcgacccttccaccgcggggcgtatgtaggcggtggaagggttttcgggcggctggctggacggcgttccggctggccgctttgccttagatgggtaattgccgcagaaataggattgctgctgtttgggtccgcacgcctatgcggcgatgctttgcgccagctgatggatgagatcggggcggtgtccgctccatgagaagtttggtgagatgaccaccggaatctgcttgaatccggcgttcttgatttgttcgaaggttgatggattctgcgtcaggtcgaccgccacataccgcacgcccagtttggaaagttcctgttcggtggcctcgcactgagggttgctcggattggtgaagacggtcacggtcattcttttcctccctatgcaaatcggcttcctttggtgtggaaagccttgtcggccacgttttttgattttgcctggctgggcaggccgttcatcagtatacactacctgtagtggcgtttcgcgcactcatccactgcatatagtgtggaattccccaaaatactgaaatggtacgaacatatgttcgattttcaaagtctagcatctcgtcaaactgcgccacgccgaacgtgtgtggtccgggtttgggcgtgttcgcggtttgtcggacgcttatgcctgcgatcgtgatgagttccggatggggtcgcctggagcccgatatgcgagaaggtgataatggaaagccttgaaaaccgttgaaccacaggttttcaaggcttaaaagcgtgccccccgtgggattcgaacccacaacccacgacttaattaggcgtcctctagatccggaatcggaaggccggcagaaacccacggcatatgaacgccattcgtattcgagctgcgggtgtggcgatgaagtggaaaagacgagggaacgcccacgtgtcgccgccgatcgcaccaactgcatcgtatctttccttgtactgcgttacctcatgctgatggtcgtggaagcctcggcgaggaaacgctgagaaccacaccagacatacgcgccggacattcattggccggctttttgtttacaaggaagtaaaaatggaattctcggatcatagacaaccgccccgtgaatggacaccctggctcgacgaatgggtgggcgcgatgcgcgcgcagggcaattcacccagaaccatcgagaactggtggtacgtcgtggggcacctcgcgctcaagacgcgaaaaagccccgaggacatcacaggcaaggacatcatcgactggctgaaccggggcgtgggcgccaactccaaacgctccgacgtcaacgcatgcaccgcgtttttcggttgggcgtgcaggacggggcggagaaaagacaatccaatggatctcgtgccgaccgtccaccgagacaggcgcaagcagatacccgcccccgtcgaggccgtggagaaggccaaacattgcgcggacaagagggcgctgctgaccatcatgctcatggacgaggcgggactacgcagatccgagctcgccacgatgcatacgcgcgacgtcatcgacgatctgacgggcaaaagcatcatcgtccacggcaagggaggcaaggaccgcatcatcccgttgagcgaccagctcggacggatcgtgtcctccctgccggaaggatacttcttccccggcgaacatgacggccacgtatgccacgacaccatctaccggatcgtgaagaacgcgaccggatggccgccgcacgcgttccgccgcaagtccgccaccgacctgtggagggcggccggcgacgccatgaaggtcaaggagatgctgggacacgagtcgctgcagaccacgcagaactacatctacgcgaccctggacgacctgcgcgacgcggtggacgagctccgcgcgtaccggggaacggacgcacgggaaatccaccccgaaaagatactcgaagcgtacaacgtccctcccgccatcacgagactgctgctcgacagcatccgcaaccaggaatgaagcacaccgtccctctggtccaccggaccagaggcgggaactcgtggtcttccccgtgaaccccatttggtcggctcgttgtcgcgatttccggggtatatcccgtgtggagcatgtcagtgtgcggcgctgcggcgggacacgcgatgcccggtatgggtggaatgctcctgattttttgcgggaacggcgttcatcggcctccccggcgctgggcggccaatgccgtatggtttgtcggcaagagacatgacaggctcttacatgacattacaccgggatattgcatggctctatcaattacccgctacaacatattaggttttctctggctccggttgtttggcgtcgggtgcatgggtagtatcggataccgcaaacgttgatgatgaaagcgaggttccggatgccggaggaacaggtcgactggagggagaccattgattgtctgctcgatcgagcgaaaaggccgttcgtcccgatcgataagacgtttgtccaaatgcctagggggagcgcgagacgagaggggccattggcgactttcgtgaaaaacggggaccttcgggggttgaaggcctatttgctgatcgtcgcgtccgccagcagcgcggacgagagcggtgaatggtacacgacgctccccttgcaggcgtgggccagggcgttcggatgcttcgagcgcgcgagcgggcagtcggcgaagaccgccgccgggaaaatattcgccaggcttgaggagcgtggtctgatcaagagaacgcacgacggcgggaaacgcgacgtcagggtgcggctgctcgcgcaagacggatccggagaggactaccggcgtccgacaacggggttcctccgcctgtcccacgagttctggaaatcgaggatcgacgaacggatcagtctgcctgcgctggcgatgcttctcgtcatcctcggcgagcgacagccctgcgagctgccctccgaacgaatgcccgaatggtacggatggtccgcggacaccgcggaacgcggattccgtgaattggaggctttggggatcatcgacaaacactccagctccaaaaagacacccctcagtccgaccgggttcaccagggtaaacgagtattccgttcttcctccgtatgacaaaagttcactggaacgggcccgccgcaatcgaaaaggggataaacatgagtgagataatcgcgtggggagacgaaagcgtgcaacggcagggcggcatcgcccccacgtactacgtgggggtttgcatctgcggactcgaggagaacgaggtccgccaacggctcctcgcccccgtccggaagaggattccgaagttgcactggcgagatatgacgtccagcgagaaacaacgctccatatcagtggtcgagagcctgtcactgcctcacatcgtggcagcggcagcgcccctggacaatatcaagcccgacagggcccgccacaaatgcctggaacggctgcttcccgaactggaacggcggtacggcgtgacgcgtctcgtgctggaatcgcgggaagccagccaggacgaacgggaccttgcctgtgtccgcggactgagaagcagaaacttcatccaccgactgcgtgtggatttcacgtccggcgcgtcggacgctcgactatggatccccgatcaggtgctcggagcaatcggagacgccgcccgtggcggcgaagaccattcggggctgatcgcgtcggtgcgcaggctcgatgtggatctcagcggccaatgagacggacaaagcccctgccccgacatgcgtgagagatgacgcggcgcaacgcgaggcaacgtaaaattgcgtcataacgcatgatgacgtatcataacggtaagccatcctccgaggaggaaacggaagtgggagccggacaccctgtgcatcatgggggccggctcctgcgtttgtgacgggcgggacatgcccggtcttaggagccggcaaacggaagcaacggcgcgggaagaagtaggatcccctgggaatggaaggcccgcccgggcttacgctcggacgggccgggcgccgctactggcggccactggtcgtcaccgcgtatgccgtgatcgacagcaccgcgatgtcggccgcgatgggatgcatcgcgggcgcgaggcagatgacgatgatcgccatcaaccacacgtgcaggccgccgcgcggcccctcacccttgttgagcatgactgctctccttgttgaataaagccgcgccgcgactggcgcggcaacgtcgcccggcggtcgccggacggccgagtcgcgtcctcgctacaagacgttcatcgacaaccgctatcgtatctgctaggatggagctgccggttgaagcatcgctaacttccccctaatcaggcgggcatgcacgactttcggggatggccgataccggtgagcgtcccttgtacgctcttgttgaataaagcgttgggccggtgccttcgggcaccggccctttgcgttgcccggtgaacccggccgccctgccgacgtcacgatccccgttccggtatcatcccccgacaccctcctgccatcctctgacccaccggaccagaagcccagccatccgcctgcccgcgaaacgacgacctaggacaagccccgcatcccggacccgtcccccgacgaccggtccccgacggatatataagcgtccggctcataaagaaatgagaaaaggaggacgcatgcgacaagatccgaacgacagcagcgtcgtggtcccgcgcgcgggacgggaccacgacgaacggacagaacggacgatacgtgagggaagccgggaatggtccgagaccgtgagcctgtcaccggccgtcctgaaggtggacggcacgcggatccgctacaccgaccagttcaggacgcacctgctacgagagctgctcgagggacacggtccgaccgacatgttccgcaaggtcggcctgcccccggaactgatcggcgggaaacggatcgaacgctgcgcaaaccacacccgcaaaagcggccgggtcatggccctcctggaacacgtgggcgacacctggcccgacgcgccggacgacgcccccgccgccggcggcgaccgctccgaacacgcgccggacagggcggacgacccatggaggacaatcatgagcatgagccgccggatcaactatctggacgaacgcgtacgggaactcgaacgactcgtggcgggcatgccgcagcccgacaccgaccgcccatccaacgacggcgaaggggaatagacgcatggacgaacacatcctggaacgcgtacgccgcctgctcgcgatcgcgcacgacacggccgcctctccgaacgagcagacggtcgcgctcgaacgggcgcagaaactcatcgaccggcacgccatcgaacaatgggaactggaacgcgacgacccgtcccgccgcgagcccgtgaccgaacgcttcatccccctgaacccgtcgcccgtcaacggactcatgaacgaactgctcgcgatcgtcgcccacgcgaaccgctgccgcagctcgtaccgatggcataaagcccgcaacggacgtcccgtgatcgccggcgtgaccctgcacgggacacgcacggacatcgggaacgcgcagaccatctggacaggcatggagaccagccgcgcgctcatgtggcgcgtccgagcacgccgcacaccgaacgcgaaggagaacgccgccttccgcgacggctactacaagggcttcgcccacgagatcgcccgccgctacgccgctctcgaacgcgacatggaaaccccccgacgggcagcgaactcgtcctgacgagacgccgcgccgtcgacgaatacatgggaaccctgacctggtcgaccgaacatcccagattcaacatgcgacgcgtcagccgcgcggcctaccggatgggcacgcgggacgcggcccgccaacagctcggcctgaaacagacccacggggacaccagggccggacgcgtgacgacccatcccgaccggtgatatataaccccggaacaggcggaatcacatgcgatatgttcttctggggtgtgctcggcctggcatgggtcaagctgatgctgccgtggctgctgcgcctgatccaacgcattccatggaagatccgctattcgctgaccgccgtgtgcctggcgctgatgctcgtcgacgcggcgatgacgctgatggcgctggacgcgtggtattcgcgcatggcgggcatcgagccggattcgccggtgatgtcgttcttcaacacgtatttcaacgatgatttcatggcggaacgtttccagacgatgtctctggatccgggcaaggccggccgcctgtgacgcctgggacggccgcggtgggtgttaggaaaccgttaacaatccgtccgtgggcgtatgggttccgttagattcggagcatgacttcgctcagggccatatcatcaagatgcttattggaaataggtccggccgcgcccgcgaacgcggcggcggccggaccgtgcatctgatgattggagaagagcaacatgccttggtgggttgatgccgcctatgtcgtgggcgtagtggcgctgttcatcgtcttcgacctgatcgcgaaggcggtggatcgtctatgatggctgttttctgcgccatcggcgtcatattgggaatcgccggtgtggtgtatatgggggtcgccctgtgccgcccggagcggttctgagggccggggaagagtcttaaggttccgaaatggtatatctctatgcttttatggcgttcggtttgatcgccttgatcctggcggccatataccggccgttgggcgattacatgtatcgcgtgtacacgaccgataaggatctgttcttcgaaaagtggatctatcgcatcatcggcgtggatttctcgaaaggacagtcctggaaggcgtatttccgcggagtgcttggcttctccgtgatgagcctgctggtcctgtacctgctgcagcgcgtgcagtcctggctgccgttctcgctgggcttcgacaacgtgccggctccgctggcgttcaacacggccgcatccttcgtgacgaacacgaactggcagtcctattcgcttgaccagacattgggctattccgtccagatcgcaggcctgtgcgtgcagaacttcgtttccgccgcggtcggcatcgccgtatccatcgccctggtgcgcggcttcatgctgcgccgctccgatacgatcggcaatttctgggtggacctcatccgcggcacgttccgcatcctcatgcccctggccatcgtgatgggcaccatcctcatcgcgttgggcgtcgcacagaacttctcgggcttcaccaccgtcgccaccgtggctggcggcgaacagaccatcatgggcggcccggtggcctcccaggaggccatcaaggaactgggcaccaacggcggcggcttcttcaacgccaattcgtcccatccgtacgagaacccgaacatgtggaccaacctcatcgagatcctgctgatgttggccatccccgtcgcgctgacccgcacgttcggccgcatgatcggcaacatccgtcagggctatgcgctgctcggcgccatggtcgtcctgttcggcatctccttcttcgccgtcgtgagcttcgaatccttcgtggacgatccgctcacctccctcaccggaggctccatggaaggcaaggaggaccgcttcggcatcgtctggtccgcgctgttcggcaccacgtccacaagcacgtccaccggcgcggtcaactccatgcatgattcctacaccgcgctcggcggcatgatgtacatgttcaacatgatgctgggcgaagtctccccgggcggcgtcggcgcaggcctgtacggcatcctcgtcgtggccgtcgtggccgtgttcatcgcaggcctcatggtcggccgcacgccggaatacctcggcaagaagatcggcccgcgcgagatgaagatggcctcgctgtacttcctcgtcatgccggtcaccgtggtgctgttcgtggctctgagcttcgccatcccgggcatccgcgaagacacgttcgcggccctgaacaacagcggaaaccatggtctgtccgaagtggtctacgcgttcgtgtccggcgccaacaacaacggctccgcattcgcgggcctgtccgccgacaccccgtggttcgacacgatgatcggcctggccatgctcatcggacggttcctgccgatcatgctggtgctaagcctggccggctcgctggccaagcaggatgtcgtgccggagaccgccggcacgatgaagaccgacaacaagctgttcgttggcctgctcgttttcgtcattttcattatttccgcgctgacgttcttcccgacgcttgctctgggaccgttggcagaaggtttggtggcataacatgtcttccgcgaccgcaaacgacgtcatcaacgacgtgcgtaccagcaacaacgcatcgttgccggcgatgctgggcaagagtctgccggcggcgttcaggaaattcagtcccgccaagatgcggcacaaccccgtcatgttcgtggtatgggtgggcgccgcattcctgacgctcctcggagtgttccagctgttcattccggaactgcgcgcgggcgagccggtgtatttcacctggatcatcgccgtgtgcctgtgggccacggtgctgttcgcgaacctcgccgaagccgtcgccgaagggcgcggcaaggcccaggccgacgcgctgcgcaagacccgcaccaccacgccggcccacctggtccgcggatacgatgaaaaaggcgatcccgacgcacgctcgttgtccgtcgccatcatcgaagtcccgtcctccgacctcaaactcggcgacgtggtcgtcgtcgaagccggacagctcatccccggcgacggcgacatcatctccggcatcgcctccgtggatgaatccgccatcaccggcgaatccgccccggtcatccgcgaatccggcggtgaccgctccgcggtgaccggcggcacccgcgtgctgtccgaccgcatcgtcgtgcgcatcacccagaagccgggcgaatccttcgtcgacaagatgatcgcgctggtcgaaggcgcgaaccgtcagaagaccccgaacgaaatcgccctcgacgtgctgctgagctcgctgaccatcatcttcctgatcgtcgtgatgtgcctcaacccgcaggccggcgcggtcggcacctccgtcagcctcaccgtgctggtggcgctgctcgtctgcctgatcccgacgaccatcggcgcgctgctgagcgccatcggcatcgccggcatggaccgtctggtccagcgcaacgtgctcgccacgtcgggccgcgccatcgaagcggccggcgacgtgaccgcgctgctgctcgacaagaccggcaccatcacgtacggcaaccgtcaggcatccgaattccacgcgctgccgggcatcgaccatgacgacatggtccgcgccgcggcgctgagctccttggccgactctacgccggaaggccagtcgatcatcgccctggccgaacgcgaaggccatcacttcgacatgatgccgggggcggaagcggtggaattcaccgccgagacccgcatgtccggcctggacctgcccaacggcgaccgcatccgcaagggcgccacctccgcggtggaagcctggatcgaacgcgaaggcggcgtcatgagcatcgaagtgcgcgacgctctgcacgaccgtgtcgacaccatctccgcgcaaggcggcaccccgctggtcgtggccgaacagctgtccaccggcgaagtcaaggtgctgggcgtcgtccagctcaaggatgttgtcaaggaaggcctgcgcgaacgcttcgccgacctgcgcaagatgggcatccgcaccgtcatggtcaccggcgacaacccgctgaccgcgaaggccatcgcagaagaggccggcgtcgacgatttcatcgccgaagccaagccggaagacaagctcgcctacatcaaggccgaacaggccaagggacagctggtcgccatgaccggcgacggcacgaacgacgcccccgccctggcccagtccgatgtcggcgtcgccatgaactccggcaccgccgcggcgaaggaagccggcaacatggtcgacctcgactccgacccgaccaagctgatcgacatcgtccgcatcggcaagcagctgctcgtcacccgcggcgcgctgaccaccttctccatcgccaacgacatcgcgaagtacttcgcgatcatcccggccatgttcatggacaagttccccggtcttgccacgctgaacatcatgggactgcacagtccgttgtccgcggtgctgtccgccatcatcttcaacgccatcatcatcgtgatcctgatcccgctggccctcaagggcgtgcggtaccgcgccgagtccagcgacaagatcctgtccaggaacctgtccgtgtacggtctgggcggtgtggtcgccccgttcgtcggcatctggatcatcgacctgttcgtgcgtctgattccgggattctaaggaaattaggtaagggaaacgattatgaaatctgcattgtcgttgaatctgcgcagctactgggccggactgaaggccgtgctggtctgcacgctcgccgtgatcgtatacacggcgttgatgaccggcatcggcgctctgggattccccgagcaggccaacggctcgatgatcacgaactccgaaggtcagatcgtcggatcgtccctgatcggacagtccttctccgatgccgacggcgaagccatcgacaagtatttccagccccgtccgtccgcagccggcgacggatacgacgcggcggcgtccagcggtgccaacaagggacattccgatgaggaatatctcaagaccatcgaagagcgccgcgacgccatcgccgaacgcgaaggcgtggacgtgaagcaggtccccgccgacgcggcgaccgcctcctcctccggactggacccgcacatcagtcccgaatatgcggccatccaggtcgagcgtgtggccgaagcccgtggcatggacgtcgaagatgtcgaacggctcgtcaaggagcacaccaccggccgtggtctgggcttcatcggagagcctgtggtcaacgtcgtcaccctgaacctggcgttggacgacatggagtgaatccgactctgaggcgcatcggatacggtgcgcctcagatgtcatcaggccaaaaactgggataatccgtagatgaaggacatcccggacggatgcggcaccgccgcgcacgacggtgccgcatccgtccggcttgaggccacggaacgtatggcatgcggcggaacttcgaaatggagggaatatggcggtgacgaagcggggtgcgctgagggttctgctcggtgcggcgcccggcgtgggcaaaacatatgcgatgctgtccgaaggcagacggctggtcgaggagggcaaggacgtcgtcatcgccctgttggagacccatggccgcaaagccacgcagaacgccgccaaaggcctggagacggtgcctcggcgctgtatgaaataccgtggcatgtggttcaatgaaatggatctgttcgccgtcatcgcgcgccgcccgcaggtcgccctcgtcgacgagctggcccatacgaacattcccggatgcacgcacgaaaaacgctggcaggacgtggtcgatctgctggacgccggcatcgacgtcatcaccaccatcaacgtgcagcatatcgaatcgctgaacgacgtcgtgcggtccatcacgaacagcgaacagcgtgaaaccgttcccgacaaggtgctgcgttccgccgacagcatcgaactgatcgatctgcccccgaagaacctgcgcgaacgtctttccgctggcctcatctattcggcggaccgcgtggacgccgcattgagcaactatttccgtgtgggaaacctgaccgcattgcgcgagctggcgttgctctggctggcgggcaacgtcgacgaagcgttgcaggaataccgcaacgaacaccacatcaacgcgaaatgggaggcccgcgaacgcgtcgtcgtcgcgctgtcgggcggtcctgaaggcgaacagctcctgcggcgcggcgcaagggtcgccagggcgtccggcggcggcgatctgatcgcggtgcacgtcacggccgaggacgggctgcacggatccagcccggggctgctggtgcagcagcgcgaactcgtcgaaaaactgggcggcacataccatcagatcgtcggcgaagacatctccgacgcactgatctccttcgcccgcgccaacaacgcgacgcagatcatcgtgggcgtctctcgacgcccgcccctcgcccggtggctgggccggccgtcgtcggcgaacggcatcatcgcgaattcgggcgacatcgacgtgcacgtcgtcacccacacgttcgcggcgaaaggcatgcgcctgccgcgcatgaaacgcaccatgacgatgcgccggcgcatcgcaggctgcatattctcattgctgtcggtgccgcttctgggctggctgctcatgcaatacagcggcgtggatgcattgtcccgcgattccctgttcttccagctgctcgtcgtcatcgccgcgctgatcggcggcgtctcgtcggccactttgtgcgcgttgctgagcggtctggtgctcgactacgtctacatccagccggtgggctcactgcatatgctcagggcgcaggacgtgatgaccatcgtgctgtacatcctcataggcatcatcgtgtccttcgtcgtcgaccgggccgacgagaaggcgcggcaggcccaacgtgcgaccgcggaatcggaagtgctcgccagcgtgtccgacgctgtgctgcgcagctccaatccgttgcaggcggttctcgaccgcacccgcgaggcgttcggcttcacctgcgtgcgcctcacccatgacggcgtcgatgtcgcggtcagcggcgtatgccccaccggggaggagccggacgtcatcgaccttgacgcggtcatcacgccgccgtccgacggcgccgatcagaacggcgaatcccatgacgggcagacctccgcctcacgtgatgccgcatcctccggaacgccgcggaaaacagagccgattcgccttgaactgtacggcagcgaaatcgacgcggccgaccagcggttgctgcaggccatcgtctcccaggtgcagaccgtgctggaacacgacgtgctgcagcgcaaggccgacgaagtcaagccgctggccgccgcggagaagctgcgcacggccctgctcaacgcggtcagccatgacctgcgccgtccgctggcctccgccacggctgcggtgtccggcctgaaacaggtcggcgacgcccttggccccgaaggccggcgcgaactgctcgacgtcgccgacgtcggcctgcacgatctgacacgactggtcaccgacctgctcgacgtgtcccgtctgcacgaacgtgcgatgccgatatcgctggtggcggccgacgtcgcggaagccgtgatgcagacgctggacgagctgcatgccggtccgaatgccatcaacctcgacctgcccgtggacctgccgctggcggtcgccgacccgccgctgctgcgtcgtgtgatacacaatgtgctcgccaacgcgcaacgctacaatccgccggaccatcgcatccgcatcgcggtctccacattccgttccgtcgtgcagatccgcgtcgtggactacggcccgggcgtgcccgacgaccgcaaggacgagctgttcgcgccgttccaccgtctgggcgacacggacaacaccacgggcctcggcctgggaatggcgctgtcgaaaggctgcatcgaatcaatgggcggcgccatcgacgcggaggacactccgggcggcggcctgaccatggtgatcacgctgcgcgcggcggacgagcgctatgcgatcggggaaccgttgtccgaagaggacgcgcgcgcctgcgccaccgcattggactcggacatgtgggacgtgaccgccgccgtcagcggcgtgatgctgcccctgagcgtggacgaatcacgtgacggcgaattggggcgtttcgccgacgccgaatccgataccgcggtcgccggtgacatggccgctgcggacgagcataccgacgttgccgatgtgacggctgctgagaagggagaatagacgcatgaaaatcctgattgccgatgatgacccgcagttcctgaaggcgttgcgcatcacgctgcgctcgcagggctacgagatcgtgaccgcatcggatggcgtgcagtgcatttcggcggcggtggagcatcatcccgatctgatggtgttggatctgggcatgccgaaaatggacggcatgggcgtgatccagggcgtgcgcggctggacggacgcgcccatcctggtggtgtcggggcgtaccgatgcacgcgagaaggtcgcggccttggatgccggcgccgacgattatgtgaccaagccggtgtcgatcgacgagctgctggcgcgtatccgtgcgctggcccgccgtatcccgcagaagacggagacgccgatggtttcgttcgggaacgtgaccgttgacctgtccgcgcatgccgtgttccgcgtgtaccacgggcggaaggtgcgtgtgcgcctgacgccgacggagtggaaggttctggagatcctggtgcgcaacgccggacggctcgtgacccgtaaggatctgctgaccggcatttggggcgcggagcatgtgaacgactccggctatctgcggttgtatgtctcgcagctgcgcaagaagatagaggacgacccgtcgcatccgaagtatctgaagacggagcagggcatgggataccgcctggacctgccgtctgcgggcggcggcgaatagaggccggggacgggtgaaggcgggtggaggctgggcgggcggcgtctgtccgcccagcctcgcgttatgcgtcgtatgggaggaatcatcgaggttgcggaaagcggagaggaaaacagccgataaacctgcgccacacgtcgtatgggaggaatcatcgaggggctgggcggccggttttgcccgctttgtttgccggtcccgcccgcttcaatcggggagaccgctgggcgcgatgcgtcgaaatggctttcaggctgcgagattctgcgcgagctgacggatcttgtccggctggtggccgctccatgatgcgttcggggagatgacgataggaatctgcttgaatcccgcgtccttgatctgttcgaaggtggacgggttctgcgtcaggtcgacggcgacatatcgcacgcccaaacgggtgagctcctgttcggtggcttcgcactgtggattgctgggattcgtgaagaccgtgaccggcatcgggcatcctccttaaagcgcgtagtcgatatgcggttgtcagtcggcgtggacgtaaaatccgctccctctagtgtacccactgtttgtagtggtgtgtcgtggggctattcactagatgcagtgttcgacacgcctcgaattcaagtcattcgaacatatgttcgaccattttggcacctttgcggaccgtcaggatgtgacctaaaccacatccttcgtctcacctgtcggtcggtcttctccgcttgctcgctctcctgacgcttttgaccgcagattccggcgtgttgcggtcaaaaccgtcaagatgtaatgcgcactgcagcggttggcggagtatggggtcggtgggttcgatccagcgggtgcaattcggcgggtgtggggctgccaaggtgtggggctaccaaggtgtggggttgacagggtgtggggttgacagggtgtggggttggcaggatgtgggactggcgcgtcggcaggtgtgggaccgaaccgccggcaggcgtgtgccagagtatgacaaaagcccgaaaaccattgtggcaaacggctttcgggctttcaggcggtgccccccgtgggattcgaacccacaacccacgacttaaaaggacgctgctctaaccgttgagctagaggggcaacagcaacatagtatacagcatattcggaccagtcgccaccgcgggcgtcgcgcggacgtcaaagtggtcatcggagcgttggcatgcctacaatcgataccatgtcatgcaccacaatccttgtaggcaagaaagcaagttacgacggttcgaccatcatcgcccgcgacgacgattccggttccggccgttacgatccgaagaaattcgtcgctatcgcgccgcaagagcagccgcgccactatcgcagcgtgctcagccacgtcgaaatcgatcttcccgacaacccgtgccgatacagcatcgtgccgaacgtgctacccaaccgtggaatccttgcggaagcgggcgtgagcgaacgcaacgtggccatgagcgccaccgaaaccatcgccgtcaacgaacgcgtgctcggtgccgacccgctggtcgtattgcagccagccgacgaaatcgcaggaaagccggaaatccctggcggcattggcgaagaggacatcatcaccctcgtgctgccgtacgtcaacaccgcgcgcgaaggtgtgaagcgcctcgctgaactgctcgaaacatacgggacgtacgaatcgaacggcatcatcatttctgatgtggacgaaatctggtacgtcgaaaccatcggcggccaccactggatcgcccgccgcgtgccggacgacaaatgcgcgattattcccaaccagcttggcatcgactatttcgatttcgacgacgctttcagcgacgcgcgcgaattcatgtgcagcgccgacctgcaggaattcatcgaaacgcatcatctcggtcgcgcgtcgggcatgcaagtcggcatgaacggcggccactgcaacccgcgcatcgtattcggcaccgccaccgtgaaggaccacatttacaacacgccgcgcgcttggtatatgtaccgctatctcgacttggacgacgcggaaaatcacacgcccgaatcggatgatattccatggtgccttgaaccggagcacgccgtgaccgtcgaggacgtcgacttcctgctcggctcgcattacgagggcaccccgtacgacccgtacggcacgcagggaacggaggaaagccgccatcgctaccgtccgatcggcatcaaccgcaccggacacatggtggccatgcagattcgcccgtacgcgcccgtcgaaagccgttcgatcatgtggatttcgtacggttccggcgcgttcaccacgtccgccccgttctatgcgaatgtcgacgacacccccgcctacctgcgcgacaccacgccggaagtctccacggactgcctgtattggacgaaccgcctgattgcaacgctcgccgacgcgcacttctacgagaccagcaacgcggtcgagggcttctcggaagacgtccgctccttcggccaccgtttggtggaacgtacggatggcgagcttgcgattggtggtgcggaggcggacgccagtgctggttctgtgtccgtttcggtccgtctcgcggcggccaacgacgaaatggcggaatatttgcgatcgcgcaatacgaagctgctcggcgacgtgctgtatacgtccagcaacctcatgcacaacagtttcgccatgtcggatcgctggaactaagcccgctgacgcttcacgtgtccgattctggcgaatcggacacgtaggcatcaaaataaagcgctcctgtgtccgaatcaccagaatcggacacaggagcgcctggccaatcgcagtaatcgcgtgccttccataccgctataccgcgaaactcgcgcgaaatcagttgaatccgaccacgtgctccgccacaaaataacctttgcggatcacgaaccggccgagcgaaccgtgcaggttcagcgcacgtgacatcgccttcttgcgcacgtccgcgtaaatcgtcggcgaatatgccttgatgtctgcccaaagctgctttttcttctcgtaattcgcgtgatctcgcgagaggatcatgaatacgctcgccacggagctttcaatcgcaagaaaatgaatcatatagcggtacaggccgtctggcaccgtacctcgttcgggggtggcgcgcaccatgcactggttgacgagccgcagctggtccacgcgtcggatcatcacgtccgtctgcacgctctgcccgtcgcggccgatgaaatagtggtagaacggcgtatccacgtattgcagcgacttgacccacgggaacggctggtacgcgtagatgaagtccacgtagaacgtgtgttccggcagctgcatcttcgattcgcgcaccacggcggtacggtagatcagcgcgtgcatgagaatgtattcggtcaggccgaaatgtcccagatcgtcccaagtgagccgcttgccgggctccatggcgtgacggaagttcacgacgtgcttgttgcgcttgcccaccttgtcatacacatagttggtgacgagcatgtcgagcggctcgtccttgccgacctcgccgcgcagcacggccatgacctgttcgagcgattccgggccgacccaatcgtccgcgtccacgaccttcacgtacatgccgctcgccgccgcgatgccggtgttgaccgcgccgccgtggcccttgttctcctgatggatcgcgcgcacgattcccggattgcgcgcctcgaacgtcttcgccatctccagcgtgccgtcggacgagccgtcatccacgatcagcacttcgatgtcgtcgttgcgcttcgacgcgatcaacgattcgacgcaccgttccaggtattccgtcatgttgtacgcgggcaccacgaaggtgagcgtcttcttctcctgcatattcttcctcggatcgggctcgtgtcgggccgtgcggctggccgaccgctccggccaaaagcataacgaaactaacgtagcaccatgtgcggttccggggcgcggttttgcgcacaaacggcaccctgaaatacgcaatctgcacctgaaatttcccctagggtcatttcgggtgacggtatgtcagttttcgtcaattgttgattgtttttgcgattcgtgcgggctttgcggtttttgcgattcgttcgtctcgtctgattcgtttgattcgtctgccgcttgcgatttgcctactgcttgcgatccgtccgtcacggtcgtcccgtccgtcgcgtcatctcccgcagcaaccgccttctcctgcgatttcgcggccttcttgccctgcttctcctgcttggcgatcgccttcgcttcccgcgcggcctgcttttccgcctcgcgggcggccttttcgctttcgtagcgcagttccggcttggcttccatgcggctcagcccataccatgccaggttcacgatgtgcgcggcgagctgctccttgctgagcttgcgctggtcggcccagtattggcaggtgtacacggtcatgccgatgagcatctgcgcgtaatacggcacgcttttggccggcagatgctggcgtttgaacgcgtcggtgagaatgtcctcgacgcgtacggcaatgtctccaagcagcgaattgaacgagttggacgggtcggttttcggcgaatcgcgcgtgagcacgcggaagccttcggcgttctcctccacgtaggtgagcagcgcaagcgcggtgcgttccacgatttggcgcggatgcgcctgcgggtcggacagcgcgttgatgagaacgtcggtgagcgcgcgcatctcgcggtccaccaccacggcgtacaggccttcctttcctccgaaatgttcgtagacgatgggtttcgacacttttgcggtcgaggcgatctcttccacgctcactgcttcgaatcccttggccgcgaacagcgatcgaccgatttcgataagctgttcgcgccgctgatacgacgtcattctggatgtattggccatactgcctagtttttcacgccccgtggatagctccttgaccgtctgacccccacgtatcgtccgattctgcggaatcggacacgtgtgtcgtattgacaatgttccattgcggctttaatatatttaataaataataaattttattaaagggggtgatgtggaccatctgccagaatggttggccaaccttgcggaggaggatttggccttcattaagaacttcgtgctatcgtcaggatctctgaagcaaatgtctcagctgtatcaagtctcctacccgaccatgaggctccggcttgacaggcttatcgaaaaaatacggttgaacgacaacgagacggaggatccattcatccttttggtgaagagtctcgccatcgacgatagatacgacgtcgacacggctcgaatactcatagacgagtacagaaagagaagggatgaatcatgagctggacatggatcgcattattaatcgagatcctaggcataatcgccgtattcgttctggtcttcctcatcgcgaggagcctgattcgctacgcaaattccctaaagaaaggagacggttcttcaaagcaggcagcagaagacaaaaaaatcactcttcacgatttgtaaagatcgttaccaggcatatcacctgcacgcatagctacaacgaggtaaaaatgcgtaataattaggtactcacttcaatgccttgcatggtagagcaccttattcctttggtgaatcggacattcgtggtgcgtccgcggggcggaggcagcgtgtccgttgcgctttttaggctggagccatggatacgaatgtgattattgcgattgttgtggccgtggtcgtcatcgcggccatcatcattggcgcatggtggttcggcaaggcttcgaaacggtccgtggaacgggccaccgacgaggccgtggcaaagggagtgcagctcgccaccgaagacaccgagcacgccggcaatgccgatgccgaccatacgcagcatgccgaagtgagcgcggcctcggctgaggttgccggaacggcggcggtcaaggcacagaagccgtctgtatctgcagtagcgtccgcggccgaggaacctcccgtcgcgaaaaccgtggtggaaacccctgaagctgccggcacccgcatgcagcgcctcaaggcgcgcctgtccaagtcgggcaatccgttcggcaaggctctgttcaacatcctcgccaaggaccagctttccgaagccgactgggaagacgttgaagacaccctcctgcttgccgacgtgggcgcggaagccagcgaacagctagttgaagaactgcgtaacgatgcccgaatcgcaggccagtccgacccggccgaagtgcgtgccgcgctgaaagacaagctgctgaagcttgtaggcattgacacggatcgccgtctcaatgccaataaggaaggtgccaacaagccaagcgtcatcatcatggtcggtgtgaacggcactggcaaaaccaccaccgcgggcaagctgtcccgactgctcgtctccgaaggcaagcaggtcatgctgggcgccgccgatacgttccgcgcggccgccgccgaccagctggagacctggggcgccaaggtgggcgtgccggtcgtgcgttccgacaaggacggcgccgacccggcgtccgtcgcgttcgaagccagcgccaaagccaaggaggcgaacgccgatgtgctcatcatcgacaccgcaggccgcttgcagaacaagtccaaccttatggacgagctcggcaagatccgccgcgtcaccgaaaagaacctgcctgtggacgaagtgctgctcgtgctcgacgccaccaccggccagaacggcatgacgcaggccaaggtgttcgccgaagcgatcggcatcaccggcgtggtcctgtccaagctcgacggctccgccaagggcggcatcgtcatctccgtgcagaaggagcttggcgtgcccgtcaagctcgtcggcctgggcgaaggcccggatgacctcgccccgttcgatccggaaggcttcgtcgacggcatcctcgcctgacgttcccatattttccggatttgcgatttccgtagcgaaaacctcccgtcacgttccgtacgtggcgggaggttttcgtattgcgattactgctcagcgccagccgtaccggcagcgccagcccccacccccggcaccttccggatcgtcagcttcaatagcagcggcgcgaccagcgtcaccagcgaaatgatgaagatgatcgtcgaatagtattcgctgccgagcacatgctcgttgaagccgatctgcgcggtaatcaacgccatctcgccacgtggcaccatgcccgcgccgatcatcagcgccgaagcgccgccgaaaccggccatgcggccacccaaaccgcagccgacgaccttcgtgatcacgccgagaaccgtcatgatcgcaatgaacacgatcatcttcgtatcatccacgcctgtggtctgcaggccgatgcccacgaagaacaccggcacgaacaacgtgtctccaaccggctcgatataccggtccgcgtcctccgcgtaatcgctgttgcttaccgcgatgccggcgaaaaacgcgcccaccgcgtagctcaacccggccagattcgacgcccacgccatcgccaggcagatgatcacggccatcaccgcgatgccggacggcgccttcagcacgccagccagcgtcatcagcgccggcgccacccaaaccaccaccacggcggccgccacaaagaacagcacctgcttgagcagaatcaaacccagccctgccacgtccacgctgccggtgttgacgagcgtgcacatcacggacagcaggatcacgccgatcacatcgtcagccacggccgcgccgagaatcgacacgccttccttcgaatcaagcagtccggcttccttcagcaccgccacggaaatcgacacggacgtggcggagaacaccacgccgatgaacgcagccggaatcggcttgaagccaaacagcaggctcaccccacccatgatggcgacggggaagaccacgcccatgcaggcgatgatgatcgccgccttcgaatacttcttcagcaactgcaggtcgcagccgacaccgcccaaaaacatgaggatgatgatgccgaggtcgctgaacaatgacagcgaatcgctcatgtgcatcacgcccagcagcgaagggcccacgagaatgccgacgagaatctgcccgatcacttccggcagctgcgctttgcggcagatcagcccggaaaccgtggtcagcatcaaaatggcgcacagtgaaatgatgaacgttgccatggtcctcgccgctctctcgttacgcgcgccatacgttcgccgcaccgcgcgttcggtgtacatgccacgcgctcgccgtacgcggcgttctcccgtcgcgtgccacgcgtgttccgtaagtttcagctacccaacttactccgtccgcagcgttgcccgccgcttccgtccaccgtcgcaatttcatattgcgattgccgggcgattatgccttccgtatttccgtaccgccagtttcgttggaattccgccatttttcggcgtaggttgacgtttcgcgcggatggcgttacgttggcgtaacacgtcgtaacgttttcaaaacgcggccggcgttccatatcgttctgtcagccccacacgatggggacggaaatgttgaaccaaatatagagaaagaaagaggagggtgacatgggccagcttgattctggaaatgccgcgtggatattgacttccgcgtcccttgtgttcctcatgacgcctggtgtggcgttcttctatggtggcatggtccgcgccaaggccgtgctgaatatgatgatcatggaggcggccgcactgtccgtcacgatgatcatgtgggtgctgtggggttggtcgatcgcctacgccggcacctcggtcggcggcatcttcggcgacccggcaaccggcttcctgctgaaggacaccatggtttccgataagggcgtcttcacatcggcggcgctgaacggcaacaactacccggtcagcgtggacgtggccttccagtccgcgttcgccatgatcaccgtcgcgttgatctgcggcgccatcgccgaacgtgtgaagtactccacgtggatgattttcgtggcgctgtggatcacgttcgattacgctccgctcgcccacatggtgtggaacggcggcctgctgtccgctgacggcgccatttcccaggcgatcggcgcagccgcccacgatttcgcaggtggtacggtcgtccacatcaacgccgcagtcgccgctctggtcatcgtgctgatcatcggcaagcgtaagggcttcggcacgcagccgttccgcccgcacaatgttccgttcgtcatgctcggcgccttcctgctgtggttcggctggttcggcttcaacgccggttccgccttcgcagccaacggcaccgccggctacgcgtgggtttccacgtccgctgcaaccgctgcggcaatgctctcctggggcttcaccgagaagatccgcaccggccactacaccgcaatgggtgccgcttccggcatcgtcgcgggcctcgtcgccatcaccccggccgccgatgtggtctccccgctgtgggccatcgtgctcggcgccatcgccggtgtgctcacctgcctggcctgcggtctgaagttcaagctcggctatgacgattccctcgacgtcgtcggcgtccacggcgttggcggcttcaccggcaccgtgctcatcggcttcttcggcgaaggcaccggcctgttcgcaggcggcgactggaggcagctggtcgtccagctcatcgtcgctctcgtggccatcgtctggtccgccgtcatcaccggcatcatcgccttcgctctggagaagacgatcggctggcgcgtcaccgaagcccaggaagtcggcggcatcgatcttgccgaccagggcgaacgtgcttacgattttgctggtaccgccagctccgtcctcaaggaggtgaagtgagatgaagctcattaccgctatcatccagccccataaactcgacgatgtcaaggaagccctcgcagccgcgggcgtgcacggcctgaccgtgtccgaggcaaacggttatggccgtcagcgcggccacaccgaggtctaccgtggcgccgaatacaccgtggatctcattccgaagatccgcatcgaggtgctgtccgacgacgccgatgccgaaaccctggttggcgtgatcgtcaagtccgccggctccggcaccatcggcgacggtaaggtctgggtggctccgcttgactcggtgacccgcgtgcgcaccggcgaaaccggttccgccgccatctgatccgtccggccttgtgatcgggccgattcggacaagatgaaataaagacccccgggcttgaagttcgggttatcaattacgacacatccccgtacgtgcctcgcgccgtgcggggattgtcataagtcgtcataggtttcataaggaacgtgcgttatgacttcagcagtcgatggtctcaaacaacggttcatggccatgagccagcccgacgccgacggcgtctaccgcaatggcgcggcgaaacgcaaagcccgcacggacttggccatgggcaatctcacacagttgtggaacgaagcctgcgaggcggtttccttcgatgttccggcaaccggcatcggtctcggcgcggtcggttcgctggcacgtggacaggtgggccccagctccgaccttgatctggcggtcatctacgaaccgcacgcgctgaccgaccagcagctcaacgagctcgccaacaaactgtggtatccgatttgggattccggcctcgacctcgaccagtcggtacgtaccgtcgcgcaatgcgaggccgtcaccgaccgcgacctgcccgcagccatgggatggctggacgtggtgccgatcgcgggggacactggacttatcgaaagcacagccgtatccatattggaacgatggcgcaaggccgcacgcaaacgtctgccggaactgctcggctccgccaaatcgcgcctcgacgaattcggccgcatggcctacatcaaccagccggacatcaaagaggcacgcggtggtttgcgcgactccgtattggtgtccgcgctcgccgcatcctggcttgccgaccgtccgcacggcacgtatgacgacgccgtcgaacggttgctggacgtgcgcgactgcatccatctggtcgccggcaaagatacgaacatgctgctatcgccctaccaagccaaagtcgcggcgatgctcggtctggccgatccgacgctgcccgatggcgaacgtgaggcgaagtcgatcgacgatctgcaaacgttgctggcacgcgttggccggcagatcgcgttctcccttgattccaccgcgtcgcgcgccgagcattcgctgacgcacgacaagccgcgattcgccttcttccaagtgttccagccgcgcggtggcggcaaacgtcaggcaccgaccttcgatgtgatcgcccccggcgtggccaagcatgaagaggaaatcgtgctcgctccgggcgcggaaccggccgccgacccgaacctcgtgctgcgcgtggccgtcgcagccgcggaatacggactgccgatcgccccgggaacgttgtggaatctcaaaaagtgccctatcggcgaccgcaactggacggacgaatcgcgtgaactgttcatacgactgctggcttccggccccgcgctgctcaacgtgtgggaagacatcgatttcatcgacgtgcccggcaagctcatccccgaatggttgggcgtgcgcaaccggccaagcgcgtccgccgcgcaccgctatacgatcgaccggcacatggtggaggtcgtcacgcggctcggccgtgaaacacccagcggtgggcggtatgacgaccggcattacgaggcgctgctgctcgccggcatcctgcatgacatcggcaaacgaccgggggtggccaaccatgcggcggaaggcgctcggcatgcgaccgtggtcgtggaacgcatgggattcgaccgcgacatcgtccgctgggtcacgctgctggtacgcgagcatctgacattgtcggagttcgccacaggccgcaatcccaatgatcccaacgtcggcgatgatctggccggccggctcgaccataatcccgtgctgctcgacatgctgttcgacctgacccgcgccgacggctcctcgttgggggccacgtccggcgagaccatctccaaacagtacgggtggagcaaatggcgtgaaacgttggtgcgcaccatgtacaacgccacccgataccacatgtgagcgccggtttctcgcatgcgccaagccgatatgcccccgtatttctcgtcgtttacggaaaagcggggtgcatatcaccttccgttcacttcggcaaatcgaaataagggaatcggggtgcatgctttaggatgtccccaagttgtccactcagttatccccactctgtggataagtcgaaacgttttccacatggttatccccaatatgtggataactcggcttttttcgactttcttatccacaccaaagccattcgcgcgtgtcgttcggtggatgcggagattcatccataatctcaatgcaacaccggtcgtgacggcacgcacgtattatggttttcctcggtattgaacacattcgattgactgctgcggttggagggacatggcggagaacgactcttggaacaacggttcggcgcagaaccgcggattttcgaacgctggaaacggtgcgaacggcatgaacggccgatccggccaagccgtgcgcgacgccctgttcgaccgcgtgccgccgcatgacgacgccgccgaaatggcggtgttgggcggcatgctgatgagcaaggacgccatcggcgaagtatcgcagatgatcgacgtgtccgacttctaccagccacgcaaccaaaccgtgtacgaagcggtcatcaaactgttctcggcctcccagccggtcgacgccgtgctggtggccaacgagctgctcgccgaaggcaatctggaaaaagtgggtggctccgactatctgcacagcctggtcgcatcggttccgaccgccgcaaacgccacgtattacgccgacatcgtgcatcagcgcgccatcctgcgtaatgtgatcgcggccggcaccaaaatcgcacagctcggctacaccgcagaaggctcgcaggccgaagacgtcgtcaacctggcgcaggccgaagtatatgagatgtccaccggcaaagtgcggcaggactacgcgccgatcggcaccgtcatcgccgatacgcttgaccagctcgaccgtctgcaaagcggcgaagtgtcccgaggcgtgccgacgggcttccgcgacatcgacgacgtgacgcagggcctgcagcccggccagatgatcgtcgtggcaggccgaccggccatgggcaagtccacactcggtgtggatttcgcccgttccgcggcactgcatcacggattgacgaccatcatcttcagcttggaaatgagcaaaaacgagttggcgcaacgtatcatctccgctgaatccaacattccgctcgccgccatgcgccgcgcggacgacatcacgccggaacgttgggccatcctgaacgagttgcaaggcaagctgcagaacgcgcccctgttcatcgacgacagcccgaacatgagcctgatggaaatccgcgcgaaatgccgccgactgaagcagacgaacgatttgaaactcgtcgtcatcgactacctgcagctcatgacctccggcaaggccgtggaaagccgccagcaggaagtgtccgacttctcccgtgcgctgaagctgctcgccaaggagctggaagtgccggtggtggcactgagccagctgaaccgtggccccgaaatgcgtcaggacaagaagccgcagctgtccgacctgcgtgaatccggctctatcgaacaggacgccgacgtggtgttcctcgtgcaccgtccggacgcctacgacaaggaggaccgcccgggcgaggccgacatcatcatggcgaagcatcgcaatggtccgaccgacacgttcaatcttgcgttccttggcgcgtattcgaagttcaaggacatgccccaggattaccagtcccagcaggaggcggtgtgatatggcttggaattccttcgcaaccccgttgatcggcaaggccgtgcgcgcggcctcccgtttggcgcacggcggtggcagcgcgttccccggcaaaatcgtggaacgcatcgacccgcaattcctgtcgcgcacattggcgcaactgccgctcggcgtggtgctcgtctccggcacgaacggcaaaaccaccaccacacgcatggtggccagcatgctgcaatcgctcggattgaaggtgttcaccaacccgaccggctcgaacttcacccgtggcgtggtttcgtcgctgcttgcggaagtctcgctttccggcaaactcgacgccgacatcgcggtgctggaactcgacgaggcgtacgccgtgcatttcgtcaagcaggtgccgcccgactactgcctgctgctcaacgtgatgcgcgaccagcttgaccgtttcggcgagatcgacaacaccgcgcgactgctgtccaaagctgcggaagccaccaccggtaccgtcgtgctcaaccgtgaggacccgcgcatcgcccgtcttgctgacgtggcgcatacggaagacggcgtggaagtacgctacttcggccttgacgaatcgttgcgcggcttcttcccgtcggatgacgacatgagcaccactgttgacgcggaagcgcacgacagtgcggaacatggcggaaatattggcgatactgccgatgccgttgcggctgccgcgccggccacatcgcaaccgcaggacggtcccgacgcgctgcccgccgacgtgacgttgcgcgccgtgggcgaccaccgcgccaccttcgcgatcgacggcgaaacgtatgagacggccgtgaaactggaaggcgtatacaacctgtacaacgcggccgccgcgctcgccgtggtgcgcgccgtcgcagcggacgcgcaggcgatgttcctgccgttcgaagacgcgctcgccgacagtgtcgacgcggacggtgccgataccggtaccgaaacggacggcaacggctcgcatgacgccatcgaccaggccgctgcggacgagattctgcgcgcggcaggcgtctcaccccgtatgatcgccttcgcgcacgccaccacgcaggccatgatcgacaccgccggcgaggtcacaccggcattcggccgaggcgaggtcatcaccgtgaacggcacccccgtggaactgctgctcgtcaaaaaccccatgggcttccgcctgtcgctggcctcgttcaagcccgaaggctgcgacaccatgatctgcatcaacgacgaatacgccgacggccgcgacatgagctggctgtgggacgtggacttcacctcgctgcgcggcaccggcgtcaaagccgtgtccggcgtacgcgcgtgggacatggccctgcgcctcgaatacgatcaggtgccggtcgaatcggtcagcaccgacctggaggaatcggtcgtgaacttcgtgaacgcgaattctggcacccccaaacacatctactgcacgtacacggccatgctgaaaacgcgtgccgcgctcgccaaaatcgccgacgtggccgacgccggcgtgggcaagtgagcgccgcgcgaaacgaaaccgcgcaatcgcaaagcaaaacagcggaaggaagacgaggagacgatatgagccaggtcatcgacatcgtgtcgctgtatccgaaggatatgaacatctacggcgattccggcaacgtgctcaccatccagcgccggctcgcgctgtacggctacgagccgcgcgtacacgcctacaaccagggctgcgactggcccgagcacgtggacatgattctgggtggcggcggccaggacaccggccagaagaagatcatcgacgacttcttccaacgcgccgacctgctgcgttcgctcgcggcggacggcgtgccgatgctgatgatctgcggcctgtaccagctgttcggcgagtatttcgaaacggtcgacggctcccgactcgacggcatcggcgtgatcggcgcgtacacggtcggccaggaaacacgcatgatcggcaatcttacggaaacctccgccgatttcggcaagatcatcggctacgaaaaccattccggacagacgttcctgcgtgacggcgtgcagccgctcggcaccgtcgaacaggacggcaccggcaacaacggcgaggaccatacggaaggcgcgcgcgtccacaacgtgatcggcacgtacatgcacggctcgctgctgccgaagaatcccgcgatcgccgatttcctgatccgcaccgccgtcgaacgccgttacggcacgttcgatccggccgccgccggacagacggacgcgcaacgggccgccctgcatcgcatcgacgaaatcgccgaccgtgctcgccgcgtggccatgtcccgtccgcgctgacggctgccatgccggttcgccggcaatcgcaccgcctgcgctgaacgccggatatccgccactttttatgcgattgaccggtttcgctcggcgcagatgtgaagaaaatgcgatagagtggtaccaccatcacctaaaggaggacatcatggctgattttaattttggtgacggcctgcgcaaggtctttctcgccggcgtcggtgccttggcgaccactgttgagaagagccaggaaatcgtcgacgacctcgtcaagaagggcgagctgaccgtcgagcagggcaaggccctcaacgccgaactcaagcacaaggtcgaagaggctaaggaagcccctgaggccaaggatgcagccccggccgaaaccgaagacaaggccgagtagctccagtctttcgtatcgccgtctgccgcgcatgtgagcgcccggacggcgatttgctatgcccgcgcgacgccggcgaaacgttcgtctggcatcgcgggctttccagccgatttcccaaccgtttgcgagcagtgacatgtctttgaaacacccatccgacaagccggacgcggcacgccccgaaagcgtggagccagtcacgctgtccgacagggtcaacgcggtcatcaaccccacggccgacccttcgccggacgccgcctcccaagcaaacggactgacggatgagcttgcccacgaatccgcggacgatgccggcgaaacggacgataccggcaaagcggccggtgtcaacgcgcaatcgtccgaaaccatcggcatcttcggagcgcgcaaagacacgttctccgcgcgctaccatctgacccgccgcggcaaactccggcgtcttgcgcaaatcgcgcagatcgccaacaaattcgacgtggttcacggactcacgcccgtcaaaatgcgtctcatgctcgaagcgctcggccccacgttcgtcaaggtcggacagatcctgtccatgcgctccgaaatcctgccgcaatcgttctgcgacgaactgtccaaactgcgcgccgacgccgaccccatgccatacagcacggtgctgcaggtgcttgaggacgaatacggccggcccgtggacgagatcttcgaccatatcgaccccaccccgctcggctcggccagccttgcgcaggtgcatcgtgcgaaactgctcaccggcgaggacgtggccatcaaagtgcaacgtccgggcgtgcgcgaaaccatggcgcaggacgtgtccatcatgcgcaccatcgcgggaatcgccaccaaaaccatgcgcagcgcgcaggtggtggacctgtccggcgtggtcgaggaactgtgggacactttcgaatcggaaaccgacttcctcatcgaaacgcgcaatctggcggaattcaaacgattctgcgaacgctacaaatacatggactgcccgaagccgtacccggaactatgcaccgaacacgtggtggtcatggactacgtggaaggcatctccgtctcccatccggacgagctgcttgcagccggctacgacctgaaggaaatcggcaccaaactcgtggacaactacgccacgcaggtactcgacgaaggcttcttccacgcggacccgcaccccggcaacatcatggtgcgcggtgggcagatcgtgctgctcgacctgggcatgactggccggctcaacgccaaaacccgttccgtgctgaaggacatgatcttcgccgtggccgagcaggattcccccaagcttgccgacggtctgctgcgtttcgccggtgccgaggccgatccggaggattatccggcattgctggccgatctggacgtgatcgtcaaggaattcggcacagtggacctggccgaactggacatcgccgccatgctgacggccctgacgcagatggcgcaacgccacggcatcgaagtgccgagcaccgtcaccacggtcggccgcgcgctggtcacgttggagggattgcttgacgaattcattcccgacgtgaacatgatccagatcatctccgaccacatcgcgtcgagcacgtcgaagaaggatttcgccaaggacgagacgaaatcgctggctctcgaaagccatcaggcgctgcacagtctgcttgccgccgccaacgagctgaaagtggcgtcccgcatgctcacgcgcggccagctgcgcgtcaatatggagatggtcggttcgcaggagccgatccacctgcttgccaacatggtgaacaggcttacgatggcgctgatcgtcgtcggattgttcatcggctcgtcgatcgtgtactatgcgggcatcaaaccggtgattttcggtattccgatcgttggtttcctcggctatgtgatcgcgttcgttttgtccgtctggatcgtgttcgacatttacttcaagggacgttccaacaaaaagcgatgacgctagtctagggggagagtggattcgcgttggatgaggcggcaggggaggtattccgtgccgtggtggggctggccgttgatggcgtccatcaggtagcgggcagctttgcggccgatgagttccgtttcattgtcgatgctggtcagcggcgggcgggagcttttggtgagcacgtcccaattatcgtggccgatcaccgccacatcctcaggaatgcgtagatgctgcgacttcaacgcgtcaatgcatcctcgtgccagctgatcgctctggcataccacggcgtcgaacttcacgccttggtcgagcagcagtctggtggcggcacgcccccaattctcgtcccaacggccatagcgaatcgggccagccggttccaaaccaacctcggccaacgcttccaacgcgcccttggtgcggtcggtggaggccgtatacgtttcatcgccgccaataatggcgatacggttgcgtccgcacgaaatcagatgattcacggccatgcgcccggcgtccacattgtcacacgtcaccgaacaatcgttgatatcggtggaaggaccatacacatacaccagcggcacgccccaatcacgccccagcgacgggcgcggattcgtctcgcactgcacaatcagcaggccgtccactttcagcgacagcagtttctctacatggctgcgttccagcgcatcgtcaccgcgagcattggcgagtagtaccgatgtcgattgtgcgcgcagctcgttttcggcgccaataagaataggcgtggagaaacggccttgcagatcggaagtgaccaaaccgatggttccgcttctgccgcttgccaacgattgcgccagcttgttcggggaatagttgagttgccgcgctgcctccatcacgcgctcgcgggtgtcttcactgacgcgcggtttgccatgcagcgcctttgaagccgttgccaaagacacgttggccagcgctgctacatcttcaagccttgctgttgagtgagtatctgcagttgccatgatgtttccccctttttacggtgtggcgaaaacgttggctgcgcgtcgacgcgcttcgccgcccttgtattgcgtaatattatacgacaaaactgcgaaagttttcgcatcgtgtcaaaaagtggacaaaacggctttatgtagccgattgctgacattttcacttgcaaatgcgaaactttcgcatttgcgaaaataaacacatttttctttcgcattttctgcatctcacgtcatttttgctgtcataaacgattcttagaatgctaagaatcgtttatttataacggttttatcgacgtgaatacctttgcattttgatgtgcgaaagcgattttgcaaaatctggagaaaaccatatactgagaaaaggctttcgcattacggttcaatcgaaggagaacaaccggaaatcgtgagggcagacggcggaaggcccgccggatggctcaaagctgagcgatacatagagaaagaagtagacatggtgtctttcaacaaggtcactcgcgttattgccggcatcgcggcaaccgcgttgcttattccgatggctgcatgcggcggtggttccagcagtggtggatccgcggctccggccgatattccggcagccggcactgatgacggcactgagatcaccctgtggacccgttctccgctggagcgtcaggccaagaacgcggtgaaggcctacaacgcctcccacaagaaccaggtcaagctggaaatcattccgaacgacgatatggaaggcaaggtcggtggtgcctcccagaccgattcccttccggacattctcgccggtgacgtggtgcgtattccgtactgggcttctgaaggcatcttcaccgacatcaccaagcagatcgacggactcgacaacaagtccgacctgcagcagggccacattgaagccggtaccgtggatggcaaggaatacacgctgccgttcatcaccgacgtttccgtgatggtatggaacaagaatctgtacaaggaagcaggtcttgacccggagaagggtccgagcagcatcgacgagttcgttgagcaggccaaggcggtcgcggccctcaacaaggacggcgtggcaggctcctacttggccggccagtccggtggcgctctcgtgttcgacctgttcccgtccgtgtgggctgacggcgaatccgtgatgaacgcagatggcaccgaagccaccctcaacaacgattccatgaaggccgtgctcgacgcctacaaggaactcgccaacaccaccaacggcttgggcgcaggttccaaggaagaaacaggtgccacctggaccgctccgttcgccaacggcaacatcggtgtgatgccgtatccgaacacctcctccaccgcactgttcgaagctgagaaggacggtggcttcgaagtcggtgtcaccccgatcccgggcaccaaggaaggcaagacctccacgttcctcggcggcgatgccatgggcatctccaaggactgcaagcacgtcgctcaggcttggaacttcctcgcatggctcatgagcgatgacgcccagaaggaagtcttcgcagccaacggcgacaccgcatccaacatccagaccctgaagaccgcctacgacgatgccgatcctcgcgtccagaccatcaactccgtaatcatcgacggcaatggccagaccccgaagtccgcagctttcaatgaggccttcaacgcagccggttccccgtggcagctgctcatccagaacgcagtctggggcgatggcgatctcaaggccgacaaccaggccatcaccgacgtgctgggtcagtgaggtgagccactgaaaacgaacttctcctcctttttctcctttccccgatttacataacttaagaacaactgaatatcgaataactgaatatcgaaaacaaaaatagacagaccacagttgtggtctgccatgaagatcgacaataattcaaaaacaatgtcggtcttcatggcggatttcaacggccgcgcgagacggaatcgcactgtcaaacgcatatccaatcgcttggccatttatggtcgaaaaccccgaacgattcaagagagagtcgccaaaagtgttccaaggagggaatatgactactgtttccaagaacgctgcgccagtgaagacgcatcgttccaaggccaaggcggaggcaacccgtcgtggcctgctgtatgcgctgcctgattggctgatgatcatcatgctgttcttcgtgccaatcgtgctgctcgtcatcatggccggttcccgctggtcgttgatgggcggtaaccgtggttggaatttccctgagaatttcgtcaaggttttcgaaaataaactgctcggacagtcggtgttgttcacacttgaatacaccgtgatcgtcacgattttcctgctggtgcttggccttggtctggcgctgatcgtgcaggaaagcaccaagtggaacaatatgctgcgcacgtgcttcctgctgccgtccgcaaccggtctcgcctccgcttcgctgctgttctacgcgctgtactccccgcaggtgggccccgtcaccaagatcctgagcttcttcggattgatggatgagggcggctccgtgctcgccaccggccagagcgcgctgtgggctaccattattgtgatcgtctggcgtttctccggctactacatgctgctcatgatgatcggcctgcaggccattcctggcgacctgtatgaggccgcgcgcatggacggtgctggcacgtggcgcattttccgttccatcaccctgccgctgatgaagccgaccatcgtgatgtgcctgatctactgcgtcaccggttccatcctcgcgttcgaccagttcttcattctgaccaagggcggtccgaacaattccaccatgaccgtagtgcagctcatctacaacttcgcattcgattccaagaaggatctgggcatggcggccgcactgtcgctgatcgtgcttgcggccctcgtggtgatcaattccatccagatgcgcggtatgcgcgacaacaccaagtgagcaaggggagggaactcacatgactactccattgtggaagcgcgtaatcgtctatattctcgaaggtctgctggctctggtcttcatttcgccgctgatctgggtggtggtctgctcgttcagtccgcagcctggttccgcacaatccaagggctggggtgtgaacaactatctgacgttgttcggctaccaggaaggcctgccgaagtacctgttcaactcggtggtggtgacgttggtcgccgtggtgttctccgtggtggtgtgcacgctcgcaggctattcgttctcccgtttcgactatccgggccgcaatctcggattcatggtgacgttgtccattttgatggtgccgtatgcgtctctgctgattccgctgatggtgtggtacaaggatattggtctgaacgattccttgctgggtgtcggtttggttattaccttgttccagctgccgatgagcacgttcatcatgcgtaatgctttcgatgcgattccgaaggatatggaagaggccgccatggtcgatggctgcaactccctgcagtcgctgattaagattctggtgccggtcgtcaagccgtcgatggtcactgtcggtctgcttgctttccttgaggcatggaacaatttcatgattccgctgtacctgtcgagttcgtcgaacgccacgctgccgctcgctttggtgaacatgcgtcagcagactatgggcgtcattgattacggtgccaccgaagctggcgtcgtaattctgatgatccccgcagccatcctcttcctagccctccagaagtactacgtcaaagggtttatggctggagccgtcaagggctgacatctggcgatgtcagcccttgggagacagtccactggactgtctccaggctccagcctgagcagaaccgaaggcggagtagccaagagccgtcaagggctggcgaagtccttaatcttaaggaaatatcatgaatgtaactattacttctcctttctggaagcagcgtcgcgaccagatcgttgaatccgtcattccctatcagtggggtgtgatgaatgatgagattgccactgaagttccggatgatccggccggcaatcagcttgccgataataaaagtcatgccgtggagaatctgcgtatcgcagccggtgatgaggccggtgaatttcatggcatggtcttccaggattccgacatatataagtggttggaggaagcggcttacgcactgtcgtatcatcctgatccgcaattgcgggaactgtgcgataaaaccgtcgacctcatcgcacgtgcgcaacaatcggacggatatttggacactccgtaccaaatcaaaaccggtgaatgggcgcatcgtgagcgtttcacactgattcagcaaagccatgaaatgtatgtcatgggccactatattgaggctgctgtcgcctatcatgaggtgaccggtaaccagcaggcgcttgacgtggcgtgccgtatggcgaattgcatcgatgccaatttcggcccggaggacggcaagatccacggtgctgatgggcatccggaaatcgaattggcgttggcgaaactgtatgatgcgaccggtgaggagcgctatctgaatctggcacggtatctcatcgacgtgcgtggtcaggatccgcagttctacgccaagcagatcgccgctgtcgacaacgactacattttccgggatctgggattctacaagcccacgtacttccaagccgcgcagccggtgcgcgagcagcagaccgctgacggccatgctgtgcgcgtggcctatttgtgcactggaatcgcacatgtggcgcgtattaccggcgatcagggcttgctggatgcggcgcatcgtttttggaacaacatcgtgtcgaaacgcatgtatgtgacgggtgcgatcggttccacacatgtgggggagtcgttcacatacgattacgatctgccgaacgacaccatgtatggcgaaacgtgcgcttctgtggcgatgagcatgtttgctcgccaaatgcttctgttggaaccgaatggtgaatatgccgacgtgcttgagcgtgagctgttcaatggtgccatcgcgggcatcagccttgatggcaagcagtattactatgtgaatgcgttggagacttcgccggacggtttggacaatccggatcggcatcatgtgctttcgcatcgtgtcgattggtttggctgcgcatgctgcccagctaatgtcgcgcgattgatcgcgtcggtggaccgttatgtgtataccgaacgtgacggcggtcgcacggtgctcgctcaccagttcattgcgaatcaggcaagttttgattccgggttgcatgtggagcagcgttccgattttccgtggaacggtcatgttgagtacatggtggaattgcccgctgaggcggctgattcggtacgtttcggcgtgcgtattcccacatggtcggctgattcctatgcgctgacatgcgatggtgttgctgtgaagacggctccggaaaacggtttcgtatatttcgcagttgctccgggaactgcattgcatgtggtgctggatcttgatatggcagtgcgattggtgcgtgccaactctcatgtgcgttgcgatgcaggtcgtgttgcggtgatgcgcggtccgctcgtctattgcgcggagcaagccgataatgccggcgatctgtggacgtaccgtcttgctgatggcgtggatgctgcggatgccacggttactttcgagagtgatttgcttggaggtgttgacgcggtgacgttgcctgccgttcgtgaggctgcggatgccgtggacgccccgttgtacatgtccgctcagcgtgacgcctcagatgagcggacgtcgctcaagctggtgccctactacgcatgggccaaccgcgaactcggccaaatgaacgtgtggttgcgcagctaaacaaaagaaagacttgctacctggcgctatgagtgccatggtgccgggaagcgggtgagcgcggcgtgatcgattggagccgaatgcgccgcgctgactggaatgagagaccggctgccccttatggggtggccggttttgtcatagcccctagtataaaacgggaaaatgcgaaaactttccttttcgcataaaagccatcgtatggcagttcacttagaaaagcattggagaaaactgaaagaaaatttgcgaaaccgtattcgcgtcatgtattcttgaaatgtcggtggacgctccaatctcatgtccatcgcacgactctcattcctacagaaagaaagttggatgccagggaacgagccttggcagccaagggccaacgatggtccatgtaggaggaattgatgacaccatcaacaaggaagaaagggattgtcacgtcattgggcgtgctgacggcagtggccacactgttgtctggcggtgtgacgaccgcatacgccaatgacgcgctgaccaatccgaactctgccatggggtatccgagtttcaagggggccgccgacccgattccgggcaccggcgtcgctttcgatccctcgacaagctacctcaagcaggtgttcgatgcggatgttgccaacggtgccggaaccgacactgcacacgacttctggatcgacaagatgctgacgcgcacaggcaccgcaccaaacggtaccggcaccaacgatgctggcgactacaactatgcgggcgcagacaagaacgaatacctgttctcacgtggccgtgccgcattcatgtacacgcatacgccggaagcacttggtttcgtaggagatgtcgcatactgggatcagaccggcaacgacggctttaccgttgaggtaagcattggcggttccaagcagaccctgcgcgagaacaccgacaagcgcaagcagacgccaagctacttcaccacggaattcaccaacggcgacaagaccattaccgtcaccgaagtcaagtacatcacctacaccaatgtgatggtcgcgaatttcaccatcaccagcaccaccggcggtgacgtaacgctgacagcagcctcgccattcgcacaagacggcaatgacggcgacactgaactgaccggtcgcttcaatgtgaagaacgatctgaccaccatctatccacggttctccggcaacggtttcaccgtaaagaacggcaaactcgcttccaccctcaccttggaagcgaacgtgccacaaaccaccaagctgcagcttggcctgatcgccaacgagttgccggactccaccgcggaatacgaagcccgattcaacggcgatctcaccgatccggccgcttcctacaaggattccgtgaccacctacaaccagtggtgggtcgataacattccttacgtggaaacccaggaacacaatatcgacaaaactgtgttctaccgctggtggctgagccgtttcaacatgttggacgccaatatgccgggcaatacgttccagtatccgacctccatcgaaggcgtgctcggatacaacaaccagatcgtgctgacatccggcatgttcatcaacgacaccaagtggttccgtaacgccgaatactcgtacggcacttgggtgtcggccgggcagacagctaagaaaggccagtccgggtattactactaccacgacaatccgggcgatccagccaattggaaccacagctacacgcagtacatcaccaaggccggttgggactcctacaaggtgcacggcggcccgtcatcattggctgaagcgttgggtgattacggttccgaagatgtcaaaggtctgctcaattcgcaaagcgagccagacagcaacgacaaccagaatagcaacggcaacaatctgatcgactggtcgtggtggtccatgaccggcaacgatgccgacgcggtgtcgttctccgaacccggtcgttccggccagcgtatggaccgtgccgacggttccgccaacatgtgggccaacgccaatgccgccgcgcaagcatacaaggctgccggagacaccgaaaaagccgctgaaatgcagcagatcgccgacgccatcaagcaggatgtgctcgacaacctgtgggattccgacagcaaactgctgctgcataagtggctgaacgacggtcaattcgcgaaatacaaggaactcaacaactactatccgtattccgaaggtctgatgccgaccggcaatgatgattacgatagtgcgttgcgcttgttcgaagatgccgacgaattcccgattttcccgttcttcactgcaaatcaggcagacaagaaggcgctgaatttcccaggatcaaacaatttctccattatcaatgcaactccgctgctgcaaatctattctgcgggaatccgtgattataatgctgcagacaacggatatatcacgaacgaatcgttcaagaaactgctgtattgggttgcgttctcgcattatcaaggaggcgacaaccagtatccggaccagaacgaattctggaatatggataataattccgcaggaagcacgattccggagaagaacgccgacgccagcaagaacggtggaaaaatcacctaccgttcctggattcaccacacccagcttggcaccaccaactggacgattgtggaagacgtggcaggtatggttccgcgtgaagacaacaagatcgaactcaatccgatcgagattcccggttggaaccacttcaccgtcaacaacctgagctaccacgggcaggatctgtcgatcgtatggaacaacgacggcacctacaacgctccgaagggatataccctgtatgtggacggcaacgccgtgttcacctccgataagctcgcccacctcatctacgatccggccagtggaaccgttgaggttgccgatgattccggagcggtgatcaccggcgcgaccaccgccacaatgccgaacgccaacgaagtgacctatgcatcgaacagcagggttacgcagatcttcgcgcagtccggacagaacgtggacgaagcatccaagagccagaccaacgtggccaagggcgccgatgtggaagccacttacgaaaccaagggatacccggcaaccaatgtagtggacggcaagaacgtgatggaatccttctggggcaccaagggatccaagaacgccaaggattcgctgaccgtaatgttcaagaatggcgtgcagaacatcgacgacgtgcgtttgtacttctaccagacctcgtccagccagacgatttccggctacagtgagccgtcggtgtacacgcttgaatatcaggatgaggccggcgcatggcatgtcctgccgaaccaggtgcgtacgcctacttacgcgggagccaactacaaccgcgtgcagttctccaaggtcgtggccaaagccattcgtgccaccttcactccgcaagcaggtcaggccattggcttgaaggagattcaggcctacgaaaccgacattgtgccggaagacgaacctacgaaccaggcgccaagcgttgacgcctacgttgccagcagcacctcgtccggtgcgcagctggtgggcacggtgaaggacgacggcctgccgtctgacacgctcaccaccacatgggagcaggtgtctggccctgaaaacggcgaagcgaagttcgtcgacgcaaccgctgccaacactacggtcacgttcaaccgtgagggtgactatgtactcaaactcaccgcattcgacggtgagaagaccggtttcaaggaagtcaccgttcacggcattccttccgacggcacggtgaatgtggcttcacagtccactgcgagcgccagcttcactaatccatatcaggcgaaggacaacgccaagaaggttatcgacggtcaggtgttgtataccaatactccgaatgagacttggaataattggggtgacaataccggtaccgagccgtggctgcagcttgcctgggatggcactgttccgttgaagaaggcgaagctgttcttctggactgacggtggcggtgtgccgatggtcaagttgtggaagttgcagtatgcggatgagaatggcgattggcaggatgtgaagcttgccgacggccagtcttataccacgatgcaaggtgaaggcaatgaggttcgttttgccgaaacggtggagacgaacaagttgcgtgtgctgttcccgaagggtgccattgttggtgctaccgaatttgaggcgtatgcgcttgatccggtgagcgtggatggcgtgaatcgtatggtgcagactggcagcaaggctgccgatgtgaatctgccgaagacggtgagtgccagctatacggacggttcccgtcgtgacttgagtgttgcgtgggatgccatcactgacgatcagcttgcttccgatagcgagtttgcggtttccggaacggttattggcgcgctcgctggaaccaaggtcactattggcgtgcgttccgacgcgcagtctcagactgctggtgcggctcagccgatcgaacagacggtgtaccagaattccaagtcggtggctttgccgtctgtggttccggtgcgattccccaacggcatgcttgacgatcgcacggttatgtgggatgaggcaagtgttgccggcgtcaagttggacaccatcggcgattatgaggtgtccggcacggctgagggttcaagctcgcaggccaagattacagtgcatgtggtcgccgatccgaatggtggtgccgatcctgatcctgagccgacgccggatcccaagccggagcccgatactccgttgactggttggattgaaggcagggccattgacaccacggtgagtgccgaggcgagctggtctccggcttccggcaagctcaacgatggtgtgctggttgacgatacgtggccgtctgatgatgacgccgatgtgaatggccgcgtgtggggcagctggggtcaagcttccgctggcatgtacgcgcagtacacctggagcaaggaagccaccgtcgattccagccgtgtgcagttctgggccaacttcgcggagcgtaatgatgccaagggtggtttggatgttccggacagctggaagattcagtacttggcttctgatggtatatggaaggatgtggagaatgcgcaatactccaccgtgcgtaattccccggcctcacgtgcctctgacgatgctcaaggctggagcgtggccacgttcactccggtgaagacaacgtcgttgcgcttggtgcttgatccgccgaccgccgagggcgtcaccttcggtctggcggttgccgagtggggcgtgcatgctgcggaaagcactcctgatccagaaccgactcctgacccggatccaacccctgatccggaaccaagcgtggacaagagcaggctcgaatccaccatcaacgcagccggttccgtgcaacaagctaatttcacgccgaacagctggaaggcattctccgaagccatgggtaacgctcaaaaggtgtatgcggacgagagcgccacccaggatcaggtggatgcggccatcaagcagcttgaagaagcccagcagacactggtgaagaaagccgataccactgagttgaagacggttcttgaccaggcacagggcgtcagcggtgacctctacaccgaagccagcgccaagaagttggctgaagcagtggatgccgcctccaaggtgctgaacgatgagaacgccacccaagctgatgcggatgccgcagtcaagcagctgaccgaggccatcgccggacttgaactcaagccagcaccgaagccggacgacgacaagaccgaccccaagccgaatgccaagcccggaaacaagccggtttccaagtctgaagtcagtgccgcaatcagcagcaccggcagcaatgtcatcggcatcgccgtcgtaggaatgatcgtcctgctgacgggagccgccatcatgctgacgcgccgcaaccgcgactagcgctagcaattgctcaagtcctcttacggatcgcacgaggaataccaacgtaacctaagcaatccgtaagaggacttttcaatatccaatcgtgaaaacaggaatattcatgagcttttcgcacatctcacatgcgtcgatgaagacgctggtggcaggcatcgcagccgcagccaccttatgcacgggagcaatcgcaaccatgcagacagccaacgcggccgacgcaagtaccgcgcccagcgtcgccggacacgcctacaacgatctgccggtcggcaatcccgacgtcaccgtcacacaaatcgacaacagtgcgttgccggcaacccttcgcaaccccatcgggcagaacgaaggaaccaatacccccaacgacctgtcgcaaaactactattccgcagacgcatccacccttgaatacgatggcaaactcttcgtattcacaggacacgacgaggccgaaccaacctacgggtccttcaatatgaaagactggggcgtctacgtaaccgacaatccggaatccggcaaatggacgcactacaagaccatcgccaaagccgacctgttcgactgggcaaccggcgacggagcctacgcaggacaagtagtagtcgacgatgctggcaccgcagacacggccgacgactggttttactactacgtgccagtcaaagacaagaacgcagccgcgggagccgacccgttctccatcggcgtggccaaatcaaaaagccccctcggaccatgggtcgacgccatcggagcgccgttgctgactaccacgcagacgcaaatcgaaaccatcgatcccgcattcttcgtggacaatgacggtaccggatatctgcacttcggcaccttcaatagcgaactcgccgtaaaaatgcagcgggacgccaacactggccgcacctcatatgttgccgtggaaaccatggacggaacggcggacggagcgccgaaaatctacaatatgcgtgacgccgacgcgctcgccaacatacccgactacgatgccagcaaagacgtgcttggtagcgactatgcgaaccaagtgaacgcgtcgctgaccttgggcaacaacggcggcgcttatgccaacgggcccaaaggcttctttgaggcggcatgggtgttccgtgaaggagacacctactacaacgtgtacgacggtggcaaacccgggtcgggagtggcgacctgcgtggaatccaactatcaggcgtgcgtgcaatactccacgtcggcaagccctcttgggccgtggacgtaccaaggcgtaatcgtcgaatcgggatcgtccaccaccatgcatccgtcgattcaacgattcggcggcaaatggtgggtcacctaccacactggagacaagactggtggtactgacttccgccgtgcagtctgcatcgatgaagtgacgtggaatggcgggcgcataaacgccgtttcacatccgaccaaagccgaacggttgcaaccctcacgcaacgtggccccctatgcgtcagtggacgcgacctacaccgaaacacccgcctacaagggttccgtgaacgacgggcgagtgctggaaactgctgtagtaccgccgaaccattggacgaactatcgaaagatgccacaaacacaatcctccgattcactgatctaccagtggagtggcgctgtacgtgtgaatggatcgaaagtctggttcgataccgatgcgaacgcattgcgtgcccctgcctcatggaaactgcaatatcttgacgcagacggttcctggaaggacgtgcccaattccagcgaatacggcgtggatacaggcaagaacgcgcctaatgaagtgacattcgacgcagtgaccaccactgctctcaaacttgacatgaccgcgcaagccgttgacgggggctatgcttccgttggcgttcctgaatgggaagtatatgcgcaacagggagcagttgtggctgaacagccagccgacgtctacgccaagaccggagatgcgccggaattgtcgaacacggtgaaagtcgcgtacggctcggaaacagtggaaactccggttttgtggcgcacggtgtctgcttcttcgtatgcgcaggcgggtgagttcaccgtgcaaggtgtggttgctggcattgaaaccaagcagcaggctgatgatctgacagccggcaacgtaaccgtgaccgtacatgtttccgacgattacgtaaaaccggctgataccattgctcctgccgtgcgtgtggcattggctggcacggctggcaatgatggttggctggtcacttcaccgatcgctcttattacggcttccgacaatgcggctgcgccgatcgcaaaactcgaacttgcggtcggggatggcgcatgggtgaccgtcggaacgaatgtgaacactgcggtaaaggctgtgactggcgagggtatagtgagtgtgcgtgcgcgtgccactgatgcggccggcaatgtgagcgaaatcgctgctgcggaagcgcgtgtggatgctacggctcctacggtaaccgcctcggtagatgcggcttcccgcactatgacattgaccgcctcagatggtgctggatccggtgtgaaaacggtggaataccgggttggaaacggcgaatggcagcaatatgaagaaggcgcggcgattactgcttcttcgtcgaagcgcgaaacggtgagctatcgggcttcggacattgctggcaatatgtcggctgcgggcgtcaaagatattccatccgatacgtcggtgccgttggccggctatatcgagcaagatgccgttgctactgacgtggacaaaaaagcgtcttcttggacagctggtgttgccgcgcttaacgacggcaaaaccattccgggcgattgcacggttgataacgcctgcatttggggtacgtggccgaataccggtgaaatgaagctcgactacgaatgggatcgcgaagtcaccatcgattccagccgtgtgcaattcacctccgatggagggggcttgggaatgccggcgtcgtggaaactgcagtattgggatgctggaacgaatgcgtttgtggatattcccgatgccacatatacattggtcaccaatgctcccggcgcttacggtaccgataacggcggatggagcgaggcaacctggactgacgcggtgaagaccactaagctgcgcatggtgattcaatccggcagtgcatcgccggctgccgccgaatggcaggttcatgcacctgaaccgactccggacccgacccccgatccgatgcctgagcccgagccggaaccaacgccaactccaaagccgactccggataacaataacaacagcaagcaggacggtaataatgccaagccttccgcgaaaccgcaatcatcgcagcaatctcagtctcaacgtaagaagaagctaagctctacaggcgtcgctactacggcaatcgtcattgccatgacggtgctggccacggcggggtgctgcatcttcgtagccaagcggggcaagctgcgtaactgaatccaaaacataaaagtggtaagttctcagcctcggcctctggactgaatatgtgtgctcgacgcactcaaggtaccgctacgcggtcttcgcggcaagtcgctcacttcgcctgaggaaagcccattgggctttcctcttcacggctcagtggccaagcctacgatcaagcacacgtattcagccgccgacctttggggccgacccctacgtttgtgtgaactcggacgtcatcggaccccattttgctcataactcgcctatgtatggcagatttgcgggtctgtcaggaagcatctcgcctatatatggcagaggacttcgctaaaaagccatatagggggtatgaaaacgcatgttttctgactccagtctgccatacataagcgagatgcctcgtgacacaactcgaaatctgccatatatagtcgagatatggctcggctgttggtggcttgagacggcgacatacgatcgcggattgcgtaggtggtcgccgtttttgtgatttatgggctaatctcagaagagacagattcgatggccgcgaacggtgtgaaccaacgcgagagaatgcgcgagcggccgcgtaagggaggaaagcccatgtccaaatcattcgtcaacaaggcgctgctcggcggtgcggtggcggcgggagccgcggtgtgggcgatcgccccgcgttccttctccgacaagcgccgtcattatgtgccggccgttccggacgtgtggtacgcgcaccgcggtctgcatgacgccggttccggcctgaccgcgcaatacgccaacgaaagcggcgaatacgtggcgctcgcccgccgcatggccatgaaagccgggtacggcagccctgatacacccggcgtgattgcccctgaaaactcgcttgccgcgttcgcagccgcctgtgaagccgggtacggtatcgaactggacctgcagatgacgcgcgatggcgaggtcgtggtggtgcatgacggcgacctgatgcgtgttgccggagatccgcgccgtatcgccgatctcacgtatgacgagctgactcgtattccgctgttcccgaccgatgcaccgggtgcctgcaaagccgcgccgctgccgttggcattggaggaaccgccgctggtcaccacgccggacaacgcgccggaaggctactaccagcatgtgccgctattcgccgacgtgctcaaagtggtggctggtcgtgtgccgctgattgtggaatataagttcgatgacaactccaagtgggatccgcgcgacgtggagcttatggagaagggcgacgcgttgctgcaggcatactccggcaagtatgtgatcgaatcgttcaatccggcggccgtgaactggtacaaggagaaccgtccggaagtgtgccgcggccagctgtcttggtggccgtacggcgaggacaagcccaccgatccggtggcgctcggcaaggaatacgcggccggcgcgctggtattcgactggatttcccgtcctgatttcgttgcctacgattggaagggcggcaacagcccgcaggtgaagctgacccggttcatgggggcggtgccggtgtcgtggaccgtgcgcagccgcgacgaattcgcgcagtgctgcgaccagttcgaccgccacatcttcgaagcgttcgtgcccgacgaacagtagccgactgatagttgcccggcgagcgacagcagccgggcgctagtcgacggactatgatcgacaggcgacagccggttttatatggtttcggcctgccatcgcatgattggtgcggtagcaggccgaatttttattcgattgatttattccgattggcagctcagtcgatcacgccgtacagacggtcgccggcgtcgcccaagcccggcacgatgtagcacttgtcgttgagcttctcatcgacggcgcacagcaccagcttgaacttgatggacgggtcgaggttttcctcaacgaacttcagaccttccggagcgcccagaatgcacactgcggtgatgtccttcgcaccgcgctcggccagatagtgggtggccgcaacgagcgtgccgccggtggcgagcatcgggtcgatcaggaagcactgacggccggtgagatcctccggcagacggttcgcgtacgtgatctgctgggtcgggttctcctcgtcgcgcttcatgccgaggaagccgacttcagcggacggaatcatcttggtcatgccgtccagcatgcccagacccgcgcgcagcaccggcacgataatcggagccggggcggcgatgtgcttgccgatcatcggagccaccggggtttcgatgggcttgtccacgacttcgatgtcgcgggtggcttcgtaggcctcgagcatcacgagttcggaaacgagctcgcggaacgtggaggacggagtgttcttgtcgcgaagaacggtgagcttgtgatccaccagcgggtggttcaaaacatgaatatccatggtttctaagcgtagtccatgtatcggctgttcggcaacgtgccggtaggtcgggcagatgaaacccagatgagcgccgattggatggcaatcgaaaatcgcaagaaagccagagaaaaatcaggaaaacatcaaaagaggagaaaagcgccgaaccacgaaagcgcctgtcggcgcaaaggccgctcgcagcggcaaaaaatggagcccggggctatgcatggcccggcgcgaattcctattgtacagtcgcgctcgacgcttcgcagcgccgtgtcgcgtggggtatgaaacgggggaaaattacggaaagcggcggtggaaagcagtagtggaaaacgacagcggaacggcctattccaatcgtccgcgccgccacagattcgccccgtggcggaaatccttggccgtggcgaacaggttgccggctgtgtgcatcagtttcgcagccttcgcgcgcgcccgcttctcaacggccgacgggcggctgccggccgcagcagacgtagcggaaccgtcggaaacatcagatgatccggcctcgctggaaccgcccagcgaagccagtttgcgcgcttcgatacgcaatcccaacgcaaccacgtcggtgaaggcggcggcccgctcaagtgccacggcgaaatcgcctgtaaacgcgccggccaaaatcgaatcggcggtacgtgcgatgtcgtcttccgtcggtgcctggtccacgccggcaatcgcggaagcggtggtggcgacgggctcgccgacgcgccacagtcgcgcgatcgattcgcggttcttccgcatccacgtacgcagcagatacagtcgccacagaatgcccggcagcgagtcggggtcggcatggctccacagttcggcgatcacgtccacgccttcgcggtccaccagcgtcagcacacgttccaccagttcggcgtcctgcgtgtggtgcacgcggtcaagcagcgccgcggccgacgcatggcacatttcgttgatttccgccggatcggcgccgccggcgatattgtcggccatcatctggtcgagctggccggggcgtgccggacgcggcgaaccggtgttcgtgaaaccggcggaacggctgggaacgactgaaccggaaccgtagtgcatgttagtagacaatgggggagaccttctgaatgtcgatgatgctggggccttgcggtgtgtcgatgatgaacagcgacatggcggtgccggtaggcatgtatggcgattttgcgatgagctgcttggcaagctgcttacgcgcgcacaggccgcgcaaatggtcgtacatgccgccgatgaccggccggtgcatgcagatggccgtggtttcgcggctgttgagcgtctgcgtgatctgctcgcggaacgccagccatgagaccgccggatgctcggcgaacgcgtcctccgtcaacgcgttgatgtgttccatcggccgttcggtctgccagctcagcacctgcaacgtctcctggcagcgcagccacggcgaggtggccagtcgcgtcgggttgaaacaggcgagctcgcggttgagggcgaacgccatcgccgcgcctttcggcgtgattggacggttcgcgtcggtgcccttccacgacttgcgcgattcagccttcgcatggcgtacgatcagcagattctgcgcggtcgcggcaccctcctgcacgcggtccacgaacactgccaacgtgtccttatcggtcgaatgggacagtattttgcgcgcctcacgtacggaaacccagacgatatcgttgatttcgcccacgtccgcgcggtgcaccgggccgaacgcgtccagcagatgttcggcgtcgtcggcggaaatcggctgcgccatccaatacaacgtgtgcttggtgtcggccgtgcaatcgtgcgaatgccgggtcttcttgccctcttcggacaacgggtattcgatttcgcacagatacggtccgagtttgaccggcgaccccgtctcttcgccgatttcacgcaccgccgcatgccgatgcgtctcgttctgctcgagcttgcctttcggccagctccaatcgtcatacttcggacggtgcacgatacatacttcaatgctgtcgagctgttcctgcgcggatttgctactggcgatcgcaggatcgttcgcgatatcgctgcccgccttccatcgccatacgatgccgccggcggcttccacgatgcgtctcgtcttttcgctcatattgtcctattctaggctgggccgggctggcggcggcgcgtgacgtccgaacatacagaaaatggccgggcccgcaaggtgcggaaccggccattcgcctcgatcgatcagtgccttaccggtcgacgcgtgtgtttcttgatgaggtattcctggctgtcgaccagcggtcggccttcctcatccttgcaatggcgcacataggtgccatcggcctgcatatgccaagacgcggtggaatcggccatctgcagatcgacgtacttgatgagctcgtcgatctgctccggagccacgatgcggaccagcgcctcgactcgacggtcgaggttgcggtgcatcagatcggcggaaccaatccacacttccggaccggccgcagggccttcgccgatctgcgggccatcggagttggcgaacgcgtaaatacggctgtgctcaaggaaacggccgaggatcgaacgcacgcggatgttctcggaaagtcccggaacgcccggcttgagcgcgcagatgccacgttccacgatgtcgatcttcacgccggcctggcttgcacggtacagcgcgtcgatggtcttctcgtcgacgatggaattgaccttgatcttgatccacgcttccttgccggcgcgtgcggcgtcctcctcgcggcggatgcgctgaatcaagccggaacgcacggtgcgcggcgccaccagcagacggtggaagctcgacttcggcgcgtagccggacagctggttgaacaggcgggtcatatcctgaccgaccaccggatcgcaggtcagcaagcccaggtcggtgtagatacgtgcggtcttcggattgtaattaccggtgcccacgtggcagtaacgacgcaggccgtcggcttcctgacgcaccacaaggctcagcttgcagtgggtcttgaggcccacgatgccgtacaccacgtgcacgcccgcgcgttccagcttgcgggcccacgcgatgttggcgtcctcgtcgaaacgcgccttgatctcgaccagcgccagcacctgcttgcccgcgtgcgcggcgtcgatcagcgcgtcgatgatcggcgaattgctggacgtacggtacagcgtctgcttgatggccagcaccttcggatcggccgcggcctgcgccaggaacgcctgcacggacgtcgagaaggaatcgtacgggtggtgcagcaggatgtcgcgctcgcggatggcggcgaaaatgtcctgcgcacgggacgattcgacttcggcgatctgacgattggtggtcggaatgaacggacggtacttgagatccggacggtcgatgccgccgagctcgaacagcacggtcgcgtcaagcggcgccggcaggcggtagacctcgtcggcgctcacgcgcagctggtcggcgagcagctgggacaggaacgggctggtctcgtcggagatctccaaacggatcggcggtccgaaacgacggcgcagcagctccttctccatggcgttgagcaggttctctgcatcatcctcttccacgtcgatgtcctcgttacgggtgacgcggaaggagcgggcctccttgatgatcatgcccgggaacagggattccaggtgggcgatgatcaggttctccatggtgatgaagccatagcgcacgttggtgttctcgtcttcggtcagatcgtcgaccggcacgagtcggttcaggttgccaggaaccttcacgcgggcgaagtgggatttgccggatgccgggttctccaccagcacggcgaggttgagggagccgccggaaatatatgggaacggatgggccggatccacggcaagcggcgtcaggacagggaacacctgctgacggtagtagcgcgagaggcgctcttgctcggccgcggtgagcttgtcccagctcagcagcacgatctgttccttcgccaggtcggggaggatgtgatcgatgatgtagtgcgcgtgctcgtcctgcaggcggtgggcctgctcgctgatggcgcgcagctgctgcctcgggctcagtccggaagcggccgtcacggcgatgccggtgtcgatgcggcgcttcagacccgccacgcggaccatgaagaactcgtcgaggttgttcgcgaagatcgcggcgaagctcgcgcgttcgatgaccggcaggtcctcatcctgggcgagttcgagaacgcgcttgttgaacttcagccagctcagctcacggtcgaagaaacggtcgttcggcagcggttcctcgcctgcctgaagctcgcgcttatcgttcttatcggtctcagcgatatgctcagctatctggctgcgcaggatcgcctttgagggtgcgtcaaaaatctgtgccatagttatctactttatcctcaagtgcttggaatgtcttgcaaaactcaggaaaattaagcaggagttaacattcgttcgccgagttggtgaaatatgcttccgacacgccgttttttcggggaaaatgaacgtgaatgaacaggcaagcgttgcgattcgcacagcatggagcatttttgcgattcttgcgatcggaaagcaacagttgcgataaatacggaacatcgtcctgtttcggtttgcacttgccgcaatggcgagcataattacgaagtacaagaacaactgaagagcagagccccacaaggtgtgtatgaccgagataggttgttacgttgaacgggcattggatagacttaccgttacgacgatgttgttgtgcagcgattctgctccgaagattcttgcaggaaggcccgcttcggcgggtcttccttttttgttgcgctgcgccgtgctgcgttgcgtaatgtcttgcgatgtgccgaatcgcgttgcgatgtggataagtgtggatgacacgccgagggtgtggataacccacattctccgaccacaggtgccgtttcggcttgaatccatgtgcggtttcgtttttcaatcggcggtatgagcgatgcaatttcttcattacaggtccctccggtcccattgccgtcatacggaggccgtgacgcacgcgtgacgtgttcgccgaaaatccggtcgcagccagcggccagagtgcggcagccgactcgatcccagcaaaccgttcggcgggaaacagccccgccgcaacggttctatacgccacagaacgccatggacgcgcgaacgtcggcacgatgggccgggcctgccgtggcgggcggtttcatgggttcgccgttggaatcgtcatccacacggatgaaacccgttgaagcgcaaccggaacctgctccactcaacgtcgtggtggtcggatccgccgtcgccggagtcggtgccagcacgttggcggcgctgctggcccgcgaactaacggaacgtggatgcaaaagcgtgctggtagacgcagatctcaacggtggcggtcttgacgtgctgctcggtgtggaagatgaagacggttcacgcttcggagacatcagcgccccgctcggcaaagtggacggcaaagcgctgctgcgagaactgcccgtgtgggatggcgtgccgctgctggcctgcaatccatggcgaagcgaaaacccgcaatcctgggagatccaggcatgcatccgcgcgctcgcgcaggtgaaggacgcggtgatcgtggacgccgggcaatggcgtggactcgatgacattccggaactggcccaggccacacacatcaccgtggtcgaaatgacggtgctcggactggcccgagccaaagtggccatgcaatcgcgtggaacggcggaacggcagaaacatggccatatcgtcggcgttgaaccgcgcggcgtggcacgtggacgtggcgtgaccacgctggaagagacggaaaactatcttggtcattccctcgcggcggttgtcaaaccggacgccaagctgtgcggcgaactgctggacggcctgggcctgcgcaggccgaaccgccaaaccgtcaaagccttggccgcgctcacggatgaactgcaggaatcgttggaaggcaagcgggtgaagcatggaactcggaccccttagcgccatcgcctcgcagccgggcgtcacggacatcgcggtgacctgcgacggcacggtttgggcggattgcggccaaggcatgcaggaagtatgtctgctgcgccgatgctttccgtcagcgcagtcgattcgtgaattcgcagtgcgattatgctcgcaacttggccgacggcttgacgacgcctgcccgatcgccgacgcctccaccgtggacggtctgcgcgtgcacgccgtcatcgcaccactggtgccgcaaggcgcggccatcagcatacgattgcccgatgcggtctcgcccaatctggaatcgttggcgcgcaacggcatgtttccagccgaatggctgcccctgctggccggactggtgtcccgcaaggcaagcgtgctggtgacaggcggcactggtgccggcaaaaccacgatgctcaaagccatgctgatgcgatgcccgccgaacgagcgcatcgtcaccgtcgaggaagtgcgcgaattgggcatgatccaacatgccaaccacgtgtctctggtcacacgcgaagccaacacagaaggtgccggcggcataggcctttccgaactgatctgcgcgacgctgcgcatgagaccggaccgcgtggtggtcggcgaatgccgtggcggtgaagtcgtggatctgctcagagccttgaattccgggcatcgaggcggcatgaccacattgcacgccaatcaagtggaggcggttccggcgcgattggtctcattgggtttgctggccggattggagccacgcgccacggcggcgctcgccgaggatgcgttcgacgtggtgcttcatgtggaacgtatcgccggcagacggcgcattgcgcaggtcggcagattggaagcggtggaagggcgattgcatgggcgtctgctggccgcctgggatggccgtacggtccgtgccggccaacgttgggatggattcatgagccgatggagcgcatgatgcgtgatgcgtgtggttgggaatattgcgccgcatggctggcgtcgatggccgtctggctgtggctgaatcggaacgcggaatgggcgggattgcggcgattacagcgtgtgctggttcgcttcgggcttcgttcggctgacgatagcggcggggccgatggagatggaacttgtgatgatgaatccgacgggcatggcagaacagtccggaacgatgggggaaaccgggatgcatcgccacggatgccgaccatcggcgctgccgcatgcgtggccgcgctgcgggcgtccgtacgcagcggagccaccttggtccaagcgttcgaggaattacagggcgctcctttcgcagtgcctgaactgacccgtttccgtattgacatggccgtacgaagccgctgctcgcttcaggaacaacacaagcatgtgaatcagcttggtgtggaacttcatgcggcctgcacgttgagtctgcagttgggctgcgagatgagccgatgcctggaggcagtcgcggcgtcgttgaagcggcgacggctgctcgatgacttgcgtgccaacgcttttgccatgccgcaggccacggtgaagctgctgatggcattgcctctgttgacggtgatgctgggggaatgcatgggagcccatcccttgcgattccttgtggaagacgtgaaaggatggatgtgcctcggcttcgccggctgctgttatgccgtcggctggtattggattcgcaggctgatgcggcaggagcatgtgcgatgagcttggcatggccgatgctggcagcggtgggcgccgctggcgcgacatggctgtatgaatggtcgccagccagaaatccgcccgattccgacgtgcggtcatgcaatctgccattgcccttgatattggaaatgttgagcgtggcgatacgtcaaggagcgtccattccacgcgcgctgattacggtcggaaacattgtggaaggcgagttcggcggtgaattgcgctcggctggagaacggctgaatagtggcatgccatggaatgaggcatggcctgacgatgatgattgcgccgtggtccgtgacgcgttctcctcatcatggtcgagcggctcctcgccggtgaatcggttggcaaccgcaatcgagcagctggattgggatgaacggtcgcggattgaacagtcggcggcgaaactgtcgattcggttgttgctaccgaccggcctgtgcatgctgccggcctttgtcgccattggcgtgattccggcggtgatgtcgtttctgtagcggccgattcgccatggggtagtgcgggttggtgcgaattggctcaaatttgctcgaatcggaccgcggtcggaatgacggatgatgcgcggtccgttccgtcatgccctaatcgcttgtggataagtgtggatgacacgccgagggtgtggataacccacgttcttcgaccacaacccacgaaaaccatgccatcgccgatgccaatacctgacactgagcgtacccggtcaatcggccgggattagccgaatgaaaggagcgtcatgaacgacgcaatgtcaatcaatgtcgatggttcgccgggtctgatgggtcgcgtcggccagaagttatgtgcggccaaggaacgtgccaataaggcggtctgcctattggacgcgcgcatgcgcctgctgaccgccgagccggagaagggcgcggtcaccgccgaatacgcggtggtgctggtggcggccacggcattcgccgcggttctgatcgccatcgtgaaatcggatgtcgtgaaaacgctgctgaccggcctcatcaagaaagcgttgagcgtggggtaaccatgcttgcgcgatggtggagacgccatgcccgtgacgccgattgcggaaccgtcaccgccgaattcgcggtggtgcttccctgcgtggccgcggtggcgattctggtgctgtgtttggggcgtgcctccatagtgtccatgaactgtcaggacgctgcggccgccggtgcgagggccatggcgattgacgccggcggcgaagcgaaagcccgcgccgcggcgcaaaccattgccggtggcggttccacggtgtcgttcgccgccaatgccaacagcgtcaccgttgtggtgcgttgcccggttgcggcggatccgaccggcgtgctgcccgccagcgtcgtgggcaaggcaactcggtatttctgattgcgatgttcatgacagcgtgctgtccgtaacggtttttgaaaggcttccaatgcgcggcaagaaaggaacgacttccgtgaaacatgacgtgaaacagtatgtgcgacgtgtgtcgcatgtgttgaaaggcgcggacgaaggtgccggaaccatatcgggagtcgcgctgatcgcaatcgtcgcggccatgctcggtgcggtcgccatggcaggcaatctgctgctgtgcgtgcatcgcgcgcagaatacggccgacctggcgtcggtggccgccgcgcagtcgctgcgtgacggtgccgccgacccgtgcgcggccgcatcgcgtacaacgtcgggcaatggaacccggctcgaatcctgtgccattgaaggcgaggatgcggtggtcgccgtgcaggcggccacgcaggtgccgttcgcaccgtgggtcgtccggcagtcacgtgcggggcctattgcctgtgattaggagattgccggacagtcgttgcatgacggcacggaatgttcagctgaaggtaatgggcaatctggcgcttgacgtgaaacatggttatcgtacaagtatgagcaagacgtcacatgcgaatacgaccgttgccgtggtctgcaatccgacatcgaacaaaggcaagggcgcccaagtgggcggtcatgtcattgatctgctgcgcggagccggacgcaagcatggcttcgacgtaatcgatgtgaccggcacaagcttcgacgattccctggccaacgcccgccgccgcggcgacgaatacgattatctggtcgcggtcggaggcgacggcatggtcgcgttaggcgccaacgcagtcggctgctccggcaaaccactcggcatcgtggccatcggctccggcaatgatttcgcacgcggactggatttgccggtcaatcgcgtcgaaaccgccgttgaaggcattgtcggtgcgattgtgcgcggcacgcatatcgacgtggacatgggcttggtgacttcgttgcctgacggtcatgccatcgattcgaccgacggaaccgatgtttcacagtcgcgctcgccgatcgaccgctattatgcgggcatgctgtcgtgcggtttggacgcaagcatcaacgaccgcgccaatcattcgcatctgccgaatggctcgctgcggtatttcgccgcggtcatcgtggagttgactcacatgaaaagctacggataccacatcaaggccacgctggccgacggttcggtggaggagcgggatatcatctcgccactgctcaccgtggccaattcccgccatatcggcggcggcatcgaggtgtccccgtattcacggttcgcggacggactgcttgatctggtgtggcttgaccatgtgccgaatttccgggagtgtgtggacgcggtggcacgcgcctaccacggccgactgctgggcagccatgctttcggatggaagcgggtgcgcgacattgaaatcacccgcgccaccgaaggggatgagcctccggtgttgatggccgatggcgaatacgtgggccatttgccggtgaaggtcttagccaaggacagtgcgctgcgtgtgctggtgccgccggccgtggcggaagcgcaggcggccgacagcgaggaacgggtgttggaaaccatcaaacgtgacggtcgtgaccctcttaccggtagattcctcgcctgacgtcgttttccgtcagccagccggtgccgctcgatgcccctccggacactgaacggccgttatatgttgcttgccggcggaaatgatgcgtgtgggagcaccgtcacagatattcgtccaaatgcagcgtctgtgccgccacctgcctgacaatgtcatcgtcaatgtcaggatgcagtctgatcagcgagatcaagccgacgatcagcgtgtagaaggtctcatgctcgttgcggatcggcatgccgtgcttttcctcgaattcacgtaccgtggaaccgcacaggtattcggaaatgcggtccgcggcccggtcgatgaacctcagatacagtgcagcgttgccatcctcgatgagacgttggctgaacgggccctcatcggcgatgagcgaacgggtcagccgcaccacatcgtcaagcgccttcgagatgttgccggcctcgcgatgctcgttccactcttccaggcgggcgatgacttcgctgatgacatcgtcgagcacggcacccgcaacctggtctttgtcttggaaatagtggtagaaaagcgatctggtcatgccgacccgttcggcgatatcgctgatcgtgatcttcgaaaaccctttttccaagcagatctcacgtgccgcctgcacgatctgcaagcgacgcgcgtctccaatggtgctggtggacgcttccggtttcccggtcatggctctctcctcccaatcgcgtggcaacgccttgtgcggcatggtggtgacgcacgggttttaggcgcgcaacagtcagcgttcgtgaccgacggcacgccgatcacacggttcatgtctgatttccagagtaccggctgcgccggttgtagatcagacagacacgcgatggacttgcggagatggtcggcttcggcgcttcccgattggcgaacgtgtcgtaattcatcgatactctagaacactacggcggaaggaatttgcgatggcactggcactgtatagaaggtatcgtcccgacacgttcgatggcgtgatcggacaggatcaggtcacggttccgctgatgcgtgcgcttgacgagaacaagctcacgcacgcctatctgttctccggaccgcgcggctgcggtaaaacgagttccgcgcgtattctggcccgctgcgtcaactgcgccaaaggtccgacctcgcatccgtgcggcgaatgcgccagctgccgtgaccttgccaccggcggccccggctccatcgacgtggtggaaatcgacgccgcctcccataacggtgtggacgatgcccgtgaactgcgtgaacgtgccggattcgccccggcccgcgatcgctataaaatcttcatcctcgacgaggcccacatggtcacgccgcagggcttcaacgcgctcctgaaaatcgtggaggagccgccggagcatgtcatgttcatcttcgccaccaccgaaccggacaaggtgatcggcaccattcgctcccgcacccaccactatccgttccgtctggtgccacaggaggtcatgggcccgtatcttgagcagatctgcgccgacgagcatatcgaggccgaagcgggtgtgctgcgcttggccatgcgtgccggcggcggatccgtacgtgacacgctgtccgtgctcgaccagctgatggtcggtgccgtcgacggcaagattccttacgattccgcggtcgcgctgcttggtttcacgccggacgcgcttatcggcgaggcaatcgacgccgtcgccgacaagaacggcgaggcgctgtatggcgtcattcaaaaggtcgtggtcggcggattcgacccccgacgtttcgttgaggacctgctggcgcgcgtgcgcgacctgttggtgctcaccttgggcggtgagcgtgcggaaagcgtgctgtctgacgacaccgcgaccgagaacatggacgatctgcatcgccaggcggcttcgctgggattggccgcgcttacgcagatggcggatacgatcaacgccacgctggccaacatgaccggtgcgatttcgccgcgcatgcgcctggaactgctcgccgcccgcctgcttgccggtcgtgagacgggcgtggtcgcgcaagccgccgcaccatcgtccggcatgccggaagctgggcatgcgggcggtgccgcagcgtctgaatcgcagcgtccgtccggttcccgtaggtacgccgcgcaatcggcacgtggaaggcatgccgtggaaccgtccgcggctcccacgaatccggccgatgccgtcgtttccggagcggcctccgtattggcggaagtccagcaggcgatgggtggacctctgtcggaaggcagcgagccggccgcttcagccgagtccaagccggttgaaacgcagtctgcgccatccaaactatccaatgccgaagcttccgctcccacccagtccgtggctcagtccgcgccccagcctgcggcaacggacgatcgcactcccgaccagaagtgggacgcgatcgttgccggcctgcctgaggatgtccgtcgctacgtggaccgcgagaaagtgccccgcgtgctgctggacggggccaaaggccgactgtggattaaattcgacaagtcgttgagcaaatacgcgttcgccaaggccgtggccaaggaagcggtcgacggcaccaccaatgtggtgcagatcgtgcgcggcgaagtgcataaggtgttcggccccgatgtcactctcgcgccggccaagaagcttgccgacggttccaccgcggtgccgtggagcaagctcagcccggaagagcagagcaagatcaacgcgcagctggtgcaggaacagctgaaggccgccacattgctgaccgcgaacctcggcaaggaggttgccaaggagccggaagacgacgatccgtggaacaccccaattccgcagacgcccatcgccgaaggcaacgccaacgacgtacagccgccggaacaccacgtaaaacatgtggacgtgccggatgtgagcgatgacgtcgacccatgggccacaccactgcccacgccgcagacggacggccaggagcaaggccaaccgaatgggccggagcagccgcggcaaaaccagccggaacagcacagcgaacgacatagcgcacggcaaagcgcccgcgaaatgcaatcgcaacaggcccagcagccggcatcatcgccggcaggattcgcggatgacccatggggagcccccatgccggtgcaggcgggaccgccggagcctgaagtcgccccggaagacgacgaatactccatgagcgacgaatcgatcggcgcatcgaacgctttggacatgaacgacctgaacagggtgttcgaagtgaagaaagtcgaggaattcagctcggacgatccgcataatccgcgcaacatgcaggtgaagaaaacacttgacgactgacaccggccaccgcacgtcgcatgtcgcttatcgtacggcgagtaccgggcgctggccatcagacgtcagtcgcccggaacgtggctgcggcaaccagtcaacgaaaggtatgaaccatggctttggcctatgacggcgccatccaacgactcatcgacgcgttcgccaacctgcccggcatcgggccgaaaggcgcgcaacgcatcgccttctacctgctcaacgcgcccgacgaggaatcgcaggcactgatcgacgccatcacggaagtcaaggaaaaagtacggttctgcgatatctgcggcaacgtgtgcgaaaccagcccatgcccggtatgcgccgacccacgccgcgaccacagcgtgatctgcgtggtcgaagagccgaaggacgtgatgagcatcgaacgcacccgcgaataccggggcatgtaccatgtgctgggcggcgtcatcaacccgatggccaacgtgcagccaagcgacctcaacatcgccaaactcatcgaacggctcaaagacagcgaagtcaaggaggtgatcctcgcgctcaacccgaacgtggagggcgaggccaccaccagcttcctctcgcagctgttgagccagaccgacatcaaggtgacaaggctcgccagcggcctacccgtgggcggcgacctcgaatacgccgacgaaatcaccctcggccgcgcgctcgccggccgtcgcgccgtatgagcttcgctggcatggcctccgcgagccgtcggtcccgcgcccagctcatactcaaccgctgtccagcaacgtgttccgcatgttgggcgcggttggacttgacaaaatggatgtttcctataataggcttcacttgccgaatcaggcaggtgatacgttgaagaagattggataagttgtggctctcatcgtgcagaagtttggcggctcttccgtagccgacccagaatcgattaagcgcgtggcccgacgcatcatcgaaacgaagaacgccggcaatgacgtggccgtcgtggtctccgccatgggagacaccaccgacgacctgatcgatcaggcgctcagcatcgattccaacccgccggcgcgcgagatggacatgctgatgaccgcaggcgagcgtatttcgatgagtttgctcgctatggcgattcatgcggccggttctcatgcatactcgttcaccggttcccaggctggtttcatgaccgacgcgcagttcggcaccgcgcatatcaaggccgtgaagcccgatcgcgtgcgtcgtgcattggataagggttccgtggcgatcgtggccggtttccaaggcgtgaacgaaggcggcgacgccaccacgctcggccgtggcggttccgatacttccgccgtcgcgctcgccgtggcgctggatgccgacatctgcgaaatctacaccgacgtcgatggcgtgttcaccgccgatccgcgtatcgtgccgaccgcccgtcgcattcccgtcatcgactacgaatcgatgctggaaatgtcgtcctgcggttccaaggtgctggcattgcgttgcgtggaatacgcgcagcgattcggcatgccgttgcacgtgcgcagctccttctcccaccgtcgcggcacgctgatcgtgccggaaggcgtcgatccgcgcaccctgccgaacatctgaacggcagccgggcagcgtaatcgcaggcaatcgcaaataattgcaagacaacgcgaaaacgaaaataagactttacaaacaaaggtaagaacatgagcgaaaacaacaaccagtccatgggcgacctgttccccgacctggggccggaagtgccgatcatctccggcgtcgcgcacgacagcaccgagtcgctggccaccgtgcgccgcgtgccgaacgagccgggcatggcggcgaaggtgttcaccatgctggccgaggccggcgtgaacgtggacatgatcgtgcaggcctccgcctccaccggcaccgccgacatctccttcaccgtgccgggcaccgctgcggccaaggtccaggaagtgctgcaggagaagcagggcgagctgggcttccagtccttcgacgtcgacccgaacgtcggcaaggtggccgtggtcggcgtgggcatgaagacccattccggtctggccgcgaagttcttcaacgcgctgagcgacaagggcgtgaacgtgctgatgatctccacgtccgaaatccgcatcgccgcgcttgtaccgctcgagcagctcaacgacgccgtcaaggcgctgcacaccgcctacggtctggacgccgaccaggtggaagccgtggtgtacggcggcaccggccgctgatagtgctggcttcagtttcccggtatttttaaagggcatggttttgcgaccgtgcccttttcgtttgctttttacgattcacgccgtacgttgcataccgtgccaagcagtccccaaacaagcaaaaggccggctccgaagagtcggccttttgcttggctatggctcgtttatgcggcttacggtttagctacccaagccgcataaacgtcgcatcacttcttggtgatgtaacccaacgccttaagcatttctgcgctttccagcgcgccaccggcggcgccacgcagggtattgtgcgccaatcccacgaacttccaatcgaaaatggaatcctcacgcagacggccgatggaaacacccataccaccctcgtaatccacatccttgagcacctgcggacggtcatcctcggtcaggtactggatgaaatgcttcggagcgtgcggcaggccaagctcggcggccttgctggtgtagttgaccagacggtcgatcagctcgtccttggtcgggttcttaccgaagttgatgaacacggtggcggtgtggccgttgagcacgggcacgcggatgcactgcgaggtgatgcgcagcggaccgtcgaacggcacaatctcgcccttggcctcgtccacatggccgaagaccttcagcggctccttctcggacttcgcttcctcgccggagatgaacggaatgatgttgcccaccatttccggccaatccttgaacgtcttgcccgcgccggaaatggcctggtacgtgctcacgatgacctcgtgcggctcgaattccttccacgcggccaaagccggagtataggcctggatggagcagttcggcttgacggcaatgaaaccgtgcgtggtgcccaggcgcttcttctgatgttcgatgacctcatagtgctccggattgatctccggcaccaccatcggcacgtccggagtccagcggtgggcgctgttgttggacacgaccggggtctcggtcttcgcgtattcctcttcgatggcgcggatctcgtccttcggcatgttcaccgcggagaacacgaagtcgacgtccttgaccacgtcctcgacgtcggccacgttcttgacgaccatgtgcttgacgaactccggcatcggggtttccatcttccagcggctgccgatggcctcctcgtaggtcttgccggcgctgtgcgcggacgcggcaagggtgaccagttcgaaccacggatggttttcgagcagcgtcacgaagcgctgtccgaccatgcccgtagctccgagaatgccaaccttaatcttttcggacataacaacctttcgcttatgctggaacggttttccaagttttgcaagtttgattttgcttacgcttgaggtcgaccagccggccccaaacgacgtcgtgggcggccacacgcgttgttcaatcttacgaaaacccgccgtcatgtccgccgagctatccgtatgctggtcggtaatcgcgctcgcgtacactggtagacatgtcgaaggcatcagaagaagcgcagaagcagctggatcgtatcgtggcgttgggctacccggatgtggccgatatgtcggcagccgcgttccgctcgcttgcgcgcccgcttatccgtgcgttggaggattgcggcgatgaagctggattgggcacgcagatccttctggtacctacgcgcgagctggtgtctcctgaatcgctgatcgcccgaacctccatcaaccgcatggcggggttcaccaccatgccgccgcgcgatatcgccagcttcctgccgcaggatggtttcgagccgccggaggggccgttctatctggtggtcgagccgcacaccggcacctgctatatcaaccgcgagccggacgtggcacgcaagctgatcgattccgacgagcgattgccgttgactttggaagaagggcttgcgatcgccacacagcatccggaatggctgctggaaaagaacggtttcaacctgctgggctcgcgttccgctgacggccgcgtaccgagtatctggatgagccagaatgctccgcgattgggcgcggtgtggccgaattcccgtcatacgtggctgggtaacgcctactgcatggcccgtcgaggcgtgagcctgttccggtagtttttcggcttaccgcgccggctccctataatcgatttcagagaagaaactgaagcaggggagaagccatgttctgtacgcaatgcggttcgaagaacgctccggagtcgaagttctgcacgaactgcggcaatccgttggtctccgttccggtgcagcctgatgccggacaagcacggatttcggatgatttttccgtcgattccacagcggtggaaacccctgcatcgcagctcgcaccgcagtctgcggagcaacccgaggaacagtctgcggcacagcacgaggaacgccctgcagaacagctcgcttcgcagccggcagacgcgattccgccggtcccgttgccgggcggcggcacgctgcccgtagcgcagcccgcgacttcggctgcatcgcaatccgttccgtcggcgccggaaactcttgagccggaaagcgacgggactgcgcgtgccgcgtccccgaatcgcaagctcatcatcggcattgcggtggccgcggtgctgctggtcgccgctgtggtggccggcattgtgacatacaacatggagttgtggggtggcaagtcgttgccggacgtggcggtggcgtctcccaaggactcgtcgaagactccggatgcgaaggtcgtggtcaggcagcttgaaggcaagggtctcaaagttaagcgcgtcaaggaattctccggcgtgaaaagcggcaagttccttggctatcagggaattcagtccggtggccgcataagggcgggcagtgtggtgacggtgcgcgaatcggccggccctggcgtgccggaaggtacggtcggcaagaaaactgaaagcgtggtgacaacgttctcgcagatgggcgtgccggtgcattacaagcaggtgattgtgtcggacaccagcaaaaccaccgagggaagcgtgattagcacgtaccccgcgcaaggccaaggcgtgaaggatggtaagaaaggcatctacatcggcgtggccacgaaaagcgacggcggcctgccgtcggacatcgtcggccaggaaatttccgacgtgaaatcaagccttgaatccaaaggctacgacgtgaaagtggagaaacgtctctcatcgaaacagtacatcggcaaggtctccggctccgaacctgggccgggcagccagctgaacgaaggccagaccatcaccctgtatcagggcgtggatgccaagggtgccaagcagacgttcattgaccacagcggaaccggtggagatgggttgctgatgggcacgagtgacgttgcttctggccagtggtgcaataaggccggcgactgcatcacgctaggacaggatgacagttattccagcggagacatcgttttcctgaaagtgaaagatggtgctgcgaacacgaagtacagcatgaccggtgagtctttgatttcctgcgatgcggtgcaacagccgtattgcagcagcaagaaagccgactatctgttgactggaaactctggagcatttgaattgttcccacacaaagcgttcgaaacgtattggtgtggcgattccgccttgggtggggaaggcgatatgcggagttgtgttgccggaaaggtccatgatattgattccgactcttcggatgcgtccgattatgagccggacggcagcggtaaattccatatgatggatttgttcgcggtgttcccagtcggctctgatgtggaatcagtagagaaaactggctattttgacgtgtctgcactcgcggctgcccaaaagcaaaaacctgtcgatatggaccgtccgttcttgatgtatcgtgacgtgaaccagtacaagaacggcgagaaggaatcaacctatacaagggactggttcgatccattcatgccttacaacggctacaacggctccaaggatgacaccgtcaaaatgaagcccgcccccagcggcgaaaccgcctactatctggtggaggacgtccagcccgactgggattccctcgaagacgccaacatcaagggcgtgtccgccaagagtcagaaatctaacggcaaaaatgcaagcaagaacgcagacaccaagaaatctgattcgcaatcggatgccgccactcggtctttgatgaagtccatcgccggaaagtacggtttcgcttccggttccggcggttggggcaccactatgacggtggcgtccgatggcacgttcagcggaacatatcatgattccgacatgggcattacgggagatgactatccgaacggatcggtcaccatttcgaatttcaaaggccgtttcaaggatgccaagaagaacgcggacggcagctatacgatgcaatgcgacaaatcggcgctgaaaatcgatggcaatataggagacacgtatatcaaaaacggtagtaaatatacggttgccgacccctacggcattgccccctgcggtacattcacggtatatccggcgggatacgacagttcgcagctcagcgaagcgatcgtcggctggagccgtgcgtggtatgacagcatgcccgcaaagctggaaacgccgattatcgtgaatgccgaggacacgaatctcggtagcgaatcacagcaagacgccttcttccaatcgaaatatcttgagtgatattcgataaggtcgcgttgtcggcggtgctgccgtcgagtcgctgtcgatcattgcgattgccacgagcatcgcattactgcgatttgcgcaacagtccccgaaccgcatacccgatcgcgccgcacgtcaccgcgcccgcccccagcagtgtggcgctgacctgcggcctgcgcagctcgttgcgcacgccgatcaggtccgtcacgcaatggtcctcgaagaacacgcgtaattcgttgctggaataacggccgaccagatcgccccacgtcagcatgcgcgtcacgtacgccatcggattgtcttcgcggaattcaaacagccggatgccacggaaccgcgatttcgggccgtagcattcgaaaccacaggtcggcgcgtatcccaaatcgatgtcgtgcacatgcccgacgaacgaattcttgtggtcgtgcccgcagaacaacgcgaaatagccgcccgcctcacgcagcgcgtccacttcgcccacgttcacgtcggcgcagccaatcgcctcgcccagccgcgaaccgggtcggcacacatcgcggtcgagcacatagcaatgtcctgcgaattcgcgtgcgccctccacggcgttcggcgtgtaggcgggcacttcgcgcaggcaatcgtagaattcctgcggcggaatgtgctggaaggcgatcgccggcaccgcctgcccgtcgccattgcgcctgcccagctcgcgttgcacgcgcttcagccattcgacggcttccggagagggggtgccgtagccgtcggaatcggccaaatcccagccgcgcgaattcgccgcgtatttcgcgtattcggtgaccgactgccgtccgttgccgtcgtccgcgtctgccgtgtcggcgtaatcgcccgaattgaccatcatcacgctcattgtgatacgccccgaaccgtcggacgcttcgatcggcaacgcgaacgtgcccggttcgagcgccaacggcgacgagccggcgacgggattcatacagccggcaaactcgcggtaaagatcgtcctgttcgtcggcgaggataccgcattggaaatcatggttgccgtacgtcgcagcgaaggggatgcgcgattccaacgccggccccaaaaacgcggcgaacgtgtcgcgcactttctgccgtgtctcgtcgagcagcgacgccgcggtgacgcgattgatggcttccgcccacgattccagcttgctggcagaaccgttgcgacctgcgcttttcaccagtttcggcgaatcggtgccgatgccgtcgatcatccaccgttcgtcggagggttgcgatttggtcagtgttttggcgattggatgacgtttgatgccgcggattttcgcttcgatttcggtgaccgcgcgcacgtgcgtaccgggctgttcgccacggcgacgtagaaacgtatcgatatatgccggatcgtagccgcggatctgatcgccggtgagcacgatgaggtcgggatgtgccttcctgatagcggcttcgatcagccgaatcgtgtcttcgcgcacgtccggaccatcctgaatatcagccatttgcagcacccggaacgtaccgtcgctgttgaatcgcaagctcatgatgcccactgtactgcggcaaatctggatatggggtgaaataagggcgcgaaaatcgcaaaccatgccgtcatatcgcggaataccggcaaaatatgggattggttgtcgctagtatgggcggcagtgcaggtaggtaacatgcacgtaacaatgtggattggcagaaggccgatccgactttacagataaggaggagtgatgggtcaggatcaatcgtcagtgtttgatctcgcggcagtcgccgcggcgtccaacggagggaacaacgacccgctgctgcctccggcgcgttacattggagctccgcaaaagcccagcaagatgccgtacaacaagtacgtcgcatatgataagcaggtgccgtttgatttcccggagcgtacgtggccgggcaagcgactgcagcgtgcgccgcgttggtgctccgtcgatctgcgtgacggcaaccaggctctcgtcaacccgatggattccgagcgcaagctgcgtttctggaacctgctcgtgtcgatgggcttcaaggagatcgaggtcggttttccgtcggcttccgaaaccgattacgacttcatccgcatgctgatcgagcgcgagctcattccggatgacgtcaccatcgtcgtgctcacccaggcccgtgagcacctgattcgcaagacttacgagtgcctgaagggcgccaagcgcgccgtcgtgcacttctacaattccgtgtccgtgctgcagcgcgaggtcgtgttccgcaaggacaaggccggcatcaagaagctcgccaccgacgcggccaccctgtgcaaggagctcgagggcgaagccaagggcattgacctgtactacgagtattctccggaatccttcaccggcaccgagccggagtacgcagtcgaggtgtgcaacgcggtgatcgacgtcatcaagccgacgccggaacatccgatgatcatcaacctgccggcaacggtggaaatgaccacgccgaacgtcttcgccgacgaggtcgagtatgtgtccaaccacctcgtaccgcgtgacgccgtggtgctgtccctgcacccgcacaacgacgagggcatgggcgtggccgccaccgagctggccgtgctggccggtgccgaccgcgtggaaggctgcctgctgggcaacggcgagcgtaccggcaacgtcgacctggtcacccttggtctgaacttcctgacccagggcatcgatccgcagatcgactactccaacgttccggaaatccgcaagaccgtcgaatactgcaaccagatcaagatctccgagcgccatccgtatgcgggcaacttcgtgttcaccgcgttctccggctcccaccaggacgccatcaagaagggtcttgaggcccgtcaggtggccgccgaccgcgctggcgccgatctggacagcttcgtgtggctcgtgccgtacctgccgatcgacccgaaggacatcggccgttcctacgaggccatcatccgcgtgaactcccagtctggcaagggcggcatggcctacctgctcaagaccaaccacaaccttgatctgccgaagcgtctgcaggtcgagttcgagaaggtcgtgcagaactacgccgacgagaccaagaaggaagtcaaggacgaggacatctggcgtctgttcaaggacgagtacctgccggtcgaggaatccggcgccaccgcggctggtgtcgtggtcggcgacagcaaggacgagaccctcgagcagtggggccgtctgaaactgctgaaggtgtccgtctcctccggcgaggatggttccgacaccgtgctcaaggccaggattctcgaccgtggcgtgaacgtcggcgtcgatgagccggtcgaacgcgaggtctccggcatgggtaacggcccgatcgcggccttcctcaacgccgtgagcaacttcggcatcgaagcgtccgtcatggattatgtggagcacaccatgtccgtcggcaccgacgccatggccgcttcctacgtggaatgccagatcggcgaggaagacaacacgagcatcgtgtggggcgtcggcatcgatacctctatcgtcaccagctcgctgaaggccatcatctcggccatcaaccgttccgagcgctgattgcactgattgcacggacgcgttgagcaaacgcgccggatatgattcgaggggcttcctgggtaaccgggaagcccctcgtcgttgccgtgtgccatgcgatgcgcccgctcacaagtgcgacaagcgcgttccatgatgcttcctctccgtggatgaagggtgtcgcaatgccgccacaccaagttgtacaacgatgtaaaacacggtatagtacatcgttgtaaaacctgtatctgcttactgaaggatcttccatgtcggccaattattccctgctgtgttatacacgcgaagccaccggacgcgaagaggcgaacaacgaggacatcgcctacagcatgcatttggcgctacgttccggcgatgacgccgagtggcagccgctgaacgaaaactatggcatcttcttcgcggccggtgtgccgatcgccgctgcgaccgcggagtcccgccgtgcgtgcacggccgcggcgcgcttcgccgccgacccgttcgacgcgcctcgccccgccaccgacgccgtcgcccatggcgtggtcatgcccggtatggatatcacgctgaaatcgctgaagaatccgttcctgttccgtctcgcggacggacgattcgccatcgccgcgacccgtaccgcccgcggcggtgagccggatggttccgaacggtcggcattcctgctcgccatcagcgatgatctgacggcgttcgaccagcgggggctggtgctgttgtgcaccaccggcggggtcaatcgcccgtccgtctctttcgacgccgcggacgcgtgctacgtcgtctcctggaccggtgacgatggcaaggcgcgcaccgcgcggacggccgatatcgtggccgccgccggatcgggggtgccgctcgatgccgaggaagcggcattcccgcagccgctgcgccagaccggggattgcggcattccgaacgccgtcgtcggcaacagcatcgccatcagtgagccggaggccgagcgcctgatcgagcgcttcggccgcatccgcaataccggaacgtccgtgcccgcccagcgaatcgatgcgggcctgcatggtgaggatgcccggaatgcggttctggccttggccgcgacccgtgcggaactgtcatacagcgacggctcgcaggccgcacgcgcggtggattggaacatggcccagcttgaggccatcgcccaggaggcctccgagggaacgctcaaggccggccagacccgtaccgtcgaaggtgtgatccgccagagcgtctatccggtgccgttcgcggtggagcgcgccgacccgtcggtgttcgcgtggaagttcaatggcaagccgatgttcatgttcatcgccaccgatgacaccgacggcaattgcgtggacccgaacgacggcagaacccatatgccgctgcgcatcgccgactccatcgaagcgctttccgatgccgcgggcggacgggccagggagatcgatctgctcgcatgcggcgatctcaatagcgaagatcgtccgatgaccggctgcttctgggctccggaactgcatgtgatcggcggcaagctgtcggtcctgttcatgccctgcttcgatgggccgcgcgtcaatcccgacggcacccccaacgatcgtgccggcaaaccggacatgtggaccggcagctgccacatcatgcagctcaagcagcattccgacggcacggatttcgatccgcgcgagccggagaactggacggtgcccgagcctatcctcgacccggatggcgagacgctcaatccaatccagcgcatttcgcttgacatgaccgtgctgtgcgattcgggccgctggtactacgcatggcagcaggtcggcagcatctggatcgccagcttcgacccaggtcgtccggcgaggctcaccagcaagccgaagcagattgtcgtgccggaattcgcatgggacaacatgatcgccgaagggccgaacgccatcgtgcatgacggaacgattttcctgatctactcgggctcgctggtcggcatcgactacacgaccggcttggtcaccgccccggctggacagggggccgatctgaccgacgccagcgtatggacgaagctcgattacccgctgcagaagtccggcgtatacaacgggcggtggcagcttggcaccggtcacggcatgtggtcgcatgacgaggacggcaacctcatctacgtgttccacaacgccgaatacgagcacggccgctatggtggccgcgacgcccaggtgcgccgcgtgcattggtccaaggagggcatgcccattctggatatgcaaacggcggaggagcttgaccccgactatgctggtgtaacgatggaggttggtttcttcgatgccgactgagtccgctggatgacaaaaggggtatatatgccgaagcgaacgggggggaacggcgagcatgtcgtgaccatgcgtgaggtggccaaggcggccggagtgtcgatcaaaaccgtctccaacgtggtcaacgactacgaattcgtctcgcaggccacgcgcgacaaggtcaacaaagccatcgcggaactgggatacacggtgaacgtatcggcgcgcaacctgcgccgagggcagaccggcatcatcggcttggccattcccgatctgcagatgccgtatttcgcgcagctgtcatcgctggtcatcgaagaagcgaagaaagtcggtctgcgcgtgatcgtggagccgacgcaatattcgcgcgatggcgagttggaagcgctgcacgggtcccagcagacgatgatcgacggcctgatctacagcccattggagcttggacaggatgacgtcgagcggctgaaggtcgattatccgcttgtgctggttggcgaacgcatcttcaccgaccaggtggatcacatcgccaccgagaacgtggaaggcgcgaagcgggccacgcagtatctgctgacgaccggttgccgccgcgtggccgtggtcggcgttcatccgggggagaaagtcggttccgccgcgctgcgctaccaagggtatcttgaggcgttggaggaggccggcgtcgaattcgacgatcggctggtcgtcgaatcgggcatgtggcatcgtagtgacggcgtgagggccatgaacgcgttgttggattccggcgtcgaagtcgatggcgtcgtcgcgctgaacgacatgctggcttccggcgtgatgcacgcgattcagatgcacggcttgcacattcccgacgacatctccgtggttggtttcgacaattccgacgattcacagtacctgtcgccggcgctgacgtcgatcgcgccgggacttgaggcggtagcccgtctgtcggtgaaagtgctcaaggagcgtatcgacggccgtgacccgaatgccgacaaaccgggggagaaggtcttccgcaaggtcgcatcgtcgctggtcgtgcgccaatccaccaaactccccatcgattccctcgtcctctgagctttcgcttgccttccggcaagtttctcccagcgtgcatacccattgagtcggctcttcccccaaggtgccgccgccgggcatgggcgctcggccgtaagcttggccgaacggccttgagtgtgtcgagcacccatgaccgacggcggcaccgacattggcatgaatggcgcaaacgatggacgcccatgcccagcggcagcaccgcatccaagcatcttccgacaatgacgcgcccaagttgttacaacgatgtaagaatgatatattcaacgttgtaaatactggaacaacggattgagaaggactaaacatggttgtttacaacaatccgatcgtgcttcagcgcgcagacccctgggtgctcaaggttgacggcgagtattatttcaccgcctccgatccggaatacaactgcatcgccatccggcacgcatcgagcatcaacgatttgcagaaagctccggagacggtggtgtggcgcaagcacgaatccggcccggcaagcatctacatctgggcccccgaactacaccgcatcaatggcgcatggtatatctacttcgcaggcgccgcaacggatttcgaagcatccggcctgccgacgcaccgcatgttcgtgctggagaacaccgacgacgacccgacctccgacaactgggtggagaagggccagatcatcaccccgatcgactccttcgcacttgacgccaccaccgaggtgatcgatggcgtgcagtacttggtatgggcgcagaaggatcccgccatcgaaggcaactccaatctgtatatcgccaagatggccaatccgtggacgctgggcagcgagcccgtcatgctgaccaagccggagtacgactgggaatgcatcgacttcctggtcaacgaaggaccggccttcctgttccatgagaacaagatctacatcacgtattccgcctccggcaccggagttccgtacgccgtggggctgttgaccgccgagcgcggcagcgatctgctggacaaggcctcctggactaagagcccggtgccggtgttcaagacctgcgccgagaacggtcagtatggtccgggccacaattcattcaccaagtccgaggacggcaccgaggacctgatgatctaccactgccgcaactacacggagatcaagggcgatccgctgttcgacccgaatcgccacgcgcgcgtcggtgtggtcaagtggaccgccgacggtccggatttcggcgtgccggaacctgataatctgtggacccccactaccacggacgtgttgcccgctgatggtggcccgcttgcgggaactccggccgtaggccactgaggggcgtggccggaggggtcaccccgtctataaccccatccataaagctggctgttgtcgtcggcgtgttaccgtttgtacaacgatgaaaatagctgtataatcaaaattacaacgttgcaaatgagcagggaggctcaatcgaaaaggattcttcccattcggattgcaacgaggagcggtccagcgatggtccgttgaggaaaaggaaggaaacaatgtctacatccaggcatcttaccgggttgcggcgctttgccaaggctgccgtagccgtgtgtgcgtcacttggacttgtgcttgccgccggaggctgtggtgcctcttcgggtgaaagcaagaccatttacttctggaacaatctggtgggcgatgacggtcctgcaatgcagcgcatcgtcaaggaatacaacgcccagagcgattacaaggtcgttttccagccgatgaacggcggcgatctgaccacgaagatctattccgtgatgcagaccggcaagaacatccccgacatcatcatcggcgaccagttccagaccgccgttctgcagtcccaaggtctgctcgacaccatggacgattggcagaaggtcgccccggacctcaaggagagcagcttcctgcccgccacttggaagggcgtcaccgtcaatggcaaggcctacggcattccgctgtatctgtaccagatggccatctactacaacaaggacttggtcaagaagtacaacctgcagtacatcctcgacgacggattcgtcaccatcgacgagatcaaggacctcaagggcaagctacccaagggcacctacgcgctgacttacggcaatctgccgtgggccttcatgtccctgctgtacggcgcgggcggcacgcttgagaacgatatggacgacctgaccaaggacgtgtggcgcaagcccatggagaagctcaaggaagcgtacgacgccggtgtgatcgccccgatggacgtcgacggcgagcaggcgttcggttccggcaaggccgtgttcgcgcagcttggcacgtgggcgcagggcaatatgtccaacaccttgggcgccgacaagatcgcggaagccaacaccctgcagtacagcgccgacaatccggtgaacttcttctaccagtgcaactggatgcagttgaaggatccgcaccgctccgcggcgaaatccgcagccgccgccgacttcgtcaagtacgtgtacgagcactggatggattggtctgaggtcggttccatctcgccggcataccgcgatctgaacaacccggagtaccagaagctgatccaggcgtccttcaccaacagcaagaaggaacgcgactacatcaagacctccaactacctctacggaggctatgcgaccgctggttggggcacatacaacgacatcgtctacggcaatgttggtcttgaagaaggtctgaagaccctcgacctcatggcccagggccaaatcgagattcaggaggaatcgtgatgagcaagacatctacgatcggatccgcaaaatcatccatgaagcgcaagaactccatctggcacgcgctgccgtacatcgctccgcacttcatcatcttcgccgtcttcggcatcatcccgattatcttcggcattggactggcgttcacccgctggaacatggtcggtgcgccgaagttcgtcggcctgcagaacttcgcgaagatcttcgaccccagcacctatttctactcgatcttctggcgtgatctcggccacactctgctcttcgtgctggtcagcgtgccgctgaccatcatcgtgccgctgctgctcgccgtggcgctcagcaagaagggactcaagggcgctggtctgttccaggcgatcttctacatcccaggtctgatctccatcgccgccggtgcactggtctggcgtatggtcttcaactcccagttcggtctgctgaacaccaccttccacaccgacatcaactggctcggcaagaacccgtacgcatggatcaccatcttcgtactcgtgctgtgggccggtatcggcggtaacctcgtcatctaccgttccgcgctctccggcgtggacgagagcctctacgaagccgcgaaggtcgacggagccggtccggtcaggatcttcttctccatcaccctgccggaaatcaagctgccgttgttctacaccaccatcatgaccaccacgggcgccttcaacgtgtggggccagccggtcatgctgaccaacggcggaccaaactaccagacccaggtgctgctgatggatatcaggaacctcgcgttccccgccggccctgcggccgccggcatggcttccgcaatggcattgctgctgggcatcatcctgatggccatcgccgcgatccagctgatcttcatgaataaggaggactgaagatgtccgctgcaaccacagtcaatgtcgcaagcgcggcaattcctgaaaacaaaaccaaaaaggtctccccgtcgctgatcgccgtctatgtggtgctcgtcgtgctggcagtcgtctggctgcttccggtgatctacaccgtgacgacttcgttcaagtcggtggccgaattcacctccaacgcgttcaacttcctgcccgcgaagtgggtgcttgacaactacatgacgctgatcgaggcatccgccagctacccggtcctgaactggctgggcaactcgctgattatctcgaccgtgttcgcagtgctgtccgtgtgcatcgtcgcgctcgcaggcttcggctattcccgtctgaacttcaagtaccgcgatacgctgttcttcgtcctgctgctcatctcgatgttccctgccgtggtcaacatgatcccgcagtaccgcatcatcgcctcactcggctgggtcaacacctactgggcctgcatcatccctggcctgggcaacgtggcgaacatcttcctggtgcgcaacttcatgaagggcatcccgaaggaactggacgaggcggccgaaatcgacggcgccactgatttccagatcttcacccgcatcatgctgccggccatccgcccgattctgatcgtcatcttcctgttcagcttcaccggcgcttggaacgacttcctgtggccgaccttggtgttcaacgacatcaacaagatgccggtcaccgctggtctgcagctgctgagcaaccagatgggccagtacaaccagatgggctccctgatggcggccacctgcatggccatcatcccgaccctgctgctgttcctgttcgcgcagaagtacttcctgcagtccctgaacatcacctccggcctcaagggctgataccggccgagtgagataatgcacaggtccgtccccaaacggacgggcctgtgattttatctttcccgagctgcgcatcgcacatcggatgaggccacaccacggaaaggaccgatatgaatccgcaaggcaacaccatgcagccgccggcaccattggctcgcaaggcggaacgagtgctgatgaccatcgccgccgcctacaacgtgatcatggcgtccatcacactgttcatgttcaccagctggttcaaaggccaagcctacgatctgctggaacataacggtttgctgaaaacggactattccgcggtggacaacgcctcgacggtggtgggcatctacgcgctgctggtgctgattatcggcatcgtcagcttcatcatgtccatgcggtgtctcgctcccggcaccaccagccggtgggtgatcatctggctggcaatcgtggtggtcttctccctgggcacgatggacctcatcggccttgcactgtattccatcaccttggtcatctatctggcccgcaacaaggccatcgcggcgcagcaggatgcgatccgcacatgggcccgcacgcatcagggctaatcctccttcccgaagaaagctgtcgctctcgtggcggcggctttcttcgtatccgcgcatgttgacgcggtacgttatcgaacacgcaattcacttatccaattcattcattcacaaccacaaggtgggaccatgaccgacacaaccgacgactacggttacctgctcgtccacttcatcgaggatccggacggctacgccgagaagatttacatggatatatccgatggagacaatccgcaccgttgggtgccgctcaacgatggaaagcctgtgctggcttcgcatctcggtaccacaggcgtgcgcgatccgcatatcatccgcaatcccgacaccggcacgtggtatatcatcgccaccgatctgcgtgtgttcggaggcgacggcggcggctggtacgagtggagccaccacgccagcacgaatctcatcatctgggaatccgacgatctgctccattggagcgagccgcgcatgctcgacgtgtcccgcaagccggacggctcccatctggagctcggcatggcctgggcctgcgaatgcctttgggtgccggactactatccgcaaggccatcatggcggtcgcggcgcattcgtcatgtactggtccagcaccgtgttcgacgacgaggataggacgcacgacgacaagaacgtctactgcaccgtgctgtggggcgccaccaccgatttcacgcaggacacattcgaatatggcggcgtattcatcgacaaccacggcgacgccatcgacaccacgatgatccaacgtccgctgccggacggcagtgtacgcacgtaccgcatcaccaaggacaacgcgcatggcaccggcatctggatggaccgcaccgacgcgaagcgctggtgggagccggggacggtctggaccaaggtgcaggaccggattggcgcaggctacgtgccggacggcaaccccggcggcgtggaaggtcctgcggtgttcgccaaccaccacaacaacggtggaccggacgacgaatggtacttgttcgtggacgtgattccgtcgatcggataccgtccgatggtcagccgcgatctcgatcagggctgggtgccgttgcaggcggacgattacttcctcaccgcgcatacgaaacatggtggcgtcgcctcgctgacacgcgccgaatacgaccgtctcgcccagcatgtgcatgcattctgacgaacgacgctgacgaccgtgcgcccgcgtgtgcacgcggcaaaactaagggggcttcccggaataaccgggaagccccctttgcgtgttcgctgaccgcgacggcaatcgcagtcagcgactgctattgctgcgatgtatcgccattggcgccgttattaccggaattatcgccactggttcctccgccattgccaccgttggtgtcgttaccgtcgccgttagcggggataccgccactattaccgccgtcgccaccgccctgaccggtattctgcgtttcctcggtctgattcggcgtggtctgttgggtgttctcctcggtgcgcggagtcacggtggtctgctgctttctagtccaggtcttctgcgcgccggtgccccacgtaccgtccggtccgccgaccttgccgttatcggtggcgtcggggaacgtttcgttcggcgtatcggccagtgcctgcttcatgtattcggtgaagagatgcacggggtaatcgctgccgccggtccagctgccgaatgcgggaatctcctgcgggttgccgttgtcgtccggataccacatcgccacagaagtcagcatggacggcgtgtagccgatgaagctcgctgcgttggaatcgtttgcggtgcctgacttgccggcaatggtgtgcccagtggcacgcgcctcggtggcggtgcctcgctggaccacgccggtaagcgccttcgtcacgagattcgcgttgttcgcttcgaacgtctgctccgccgaggtcggcgcgttgtacaggtcggtgccgttcgccgtctgcacttgggcaacgatatgcagcgtcggcttgttgccttggttggccagtgtggcgtatccctgcgtcatgtccttgagggtcaggccgttgttgccgagcacggtgaacgggttggaaccatccaaagacgaatcgtcaacgccggcctgccgtgcggtttcggcgattttctgcgcgccgagcttggtttgcagatccatgtacacggtgttcgaggattgttccgtcgccgtgtacaggttcacgtatcccagattctcgccgccgtagttgctcaccgtttcggtgatgcccgggaacgtccggtacgagttgccgttgaagtacgtgttgaggctgacgccttcgttgacggcggccagcaatgcgaacggcttcatggtggagccgacttcgtacgttgcctgggtgacgttgttgagctgcttggtcaggtagtcgtctcctgcgtacagcgagatgatggaaccgtccttggggttcaccgacagcgcgccgaactgcatgccgtcgggcacgatgccttgcatgccgttttgggagggactgatggtggagaacatcaggtcctgcttcgatttgtcaatggtggtgacgattttgtagccgccggtttccaggtcctgcttgctgaacgccttggtgttgacgagttcgttctgcaccatcgtcagcaggtatccgttcggtccggacatctggttgttctgttggatttcgatggtttgcgggaatttcgcggctttcttctcgtccggcgtgatgtagccgtcttcgtccatgatgttcagcacgcgcttgtaacgtttttcagcttgcttgggattcacgtcgggggtccatacgctcggcgcgggaatgatgccggcaagcatggccgcttcggagagcgtcagatccttcgcgtccttgccgaagtacgctttggccgctgcctggatgccgtatgcgccacggccgagatagatggtgttcatgtagttgcacaacacctggctcttgtcctgtgcttgggcgattttgaccgccaggaacgcctcacgcagtttgcctacgtacgaggtggtttcgcccagataatagcgttccgcatactgctgggtgatggtggaaccgccctgcctgctgccggtggtcaggttgttgtagaacgcgcgtgcgatgccgatcggatcgatgcccttattggtgtagaaggagcggtcttccgatgccacgatcgcgttgccgacgtagtcgggcaggtctgcgcagctgatgatttcgcggttctgttccgcatagctgccgatcggcgtggtgctgtcgttgtaatacacggtcgtcttttcagccagcgcgaacttttccggctgcgggatttccgtggtgatgtacatgtaggcgaacaggccgatacctgccgcgatgagcgccgcgaagatgccgagcacccatttgagcacgagatgcttgtgttttctggtctttttgggtgcgcgatgcgaagtgtgcttcggcccctggggcggcttgctcagcacttctccatggaccccgtaggtggtgcccacccgtggcgtcgtggacgttgcgctgccgctgcgggcgctttttgagcgtgagctgacacttcgtgttcgtgaaaccatggtttccaccgtagccgaacgacctgaaaaacaagggtgtagatggtgctgtccgactggaaaaacatgtttttgcgcagcttttttacaaatcgacaatctgttgacgactgccgtaatatggccgtttttcagtgatttttcagtttacaatgcggttgtgggtatgcttggggattggtatacctgcgaaatgcataacagaggagtcgttttcagatgagcattcgagtggctatcgccggcgtgggcaattgcgcctcgtcgctggtgcagggcgttgagtattacaaggacaccaaggacgaggataagattcccggcctgatgcacaacaatttcggtggctaccgcgtgcgtgacatcgaattcgtcaccgcgttcgacgtcgatgcgctgaaggtgggcaaggacctgtccgaggcgatcggagcctcccagaacaacaccatcaagttcgcggacgtgccgaatctgggtgtggaggtgctgcgtggcccgaccaacgacggtttgggcgagtactaccgtcagatgattacggagtcggacgccgagccggtggatgtggcgcaggtgctgcgtgacaagaaggtcgacgtgctggtttcctacctgccggttggttccgagaaggcggacaaggcttacgctcaggccgctatggacgctggctgtgcgttcgtgaactgcctgccggtgttcatcgcctccgatccggagtgggcgcagaagttccgtgacgctggtgtgccgattgtcggcgacgatatcaagtcgcaggtcggcgccaccatcacgcaccgcgtgctggcccgtctgttcgaggatcgcggcgtgcgtctggatcgtacgtaccagcttaacgtcggcggcaacatggacttcatgaacatgctgcagcgttcccgcctggaatccaagaagatctccaagacccgcgccgtcacttccgtggtgccgcacgagatggatccgcacaacgtgcatatcggcccgtccgattacgtggcttggcttgacgaccgcaagttcgccttcgtgcgtcttgagggcaccacgttcggcgatgtgccgctgaacctcgaatacaagctcgaggtgtgggattccccgaattccgccggtattgtgatcgacgccgtgcgtgcggcgaagatcgcgctcgaccgccacctggccggtccggtgctggctccgagctcctacttcatgaagtctccggccgtgcagcacgaggatggcgaggcccgccgcttggtggaggaattcatcaagggtgaggtcgaaggcaccgaagagcagcttgacgccgatgtggcggccgcgaaggccgccggcaaggatgtgtggcgcgcatagcgtgcgttgctgacggcagacccgcgatggcaatggcaaccatctcgtaggtctcgacccactcgcctgattcgtaggcagaatcagcatataatgaaaatccctatggcctggggtaatgccatagggatttttgttgtcccggaaacgctgcggcggtggcggccaatggtcgtgcgccgtcgcagcgtgaacgggaatcatatattgcgcaatgtatatcgcgtcactttttgaggagtggttcgacctgctgctcgtacgcggtcaacgcggtgtcgatcacgttgtgcatgtcgtaatacttgtacgtgcccaaacggccgccgaacacggtcctcggctcggccttcgcgagctcctcgtacctcgcgtacaacgccttgtcggcctccgtgttgatcggataatacggctcgtcgccacgctcggcgaaacggctgtactcctcccacaccacggtcctgtccgggttctgcgaagccctgcgctccgggttgaagttcttgaactcgatcgcgcgcgtgtacggcacgtccgggtcggagaagttcatcaccgggcatccgaaatggtcgccctcgtcgtaacgcacctccctgaagtccaccgtgcgccacttcagctcgccgagcgagtagtcgaagtagcggtccaccggacccgtgtacaccaccggcacgcccgccgcggccaacgccttcctgttgtacggctgggactcgtcgaagaagtcggtcctgagggtcacgtggatgcgcggatcgtcgatcatgcgctccatccaggcggtgtacccgtccgtgggcaggccctcccacgtgtccctgaaataccggttgtcgtagttgaagcgcaccggcaggcggttgatgatgcccgcgggcaggtccttcggatcggtctgccactgcttgcccgtgtagttcttgatgaacgcctcgtacagcggacggccgatcagcgaaatgcccttgtcgttgaggttctgcggatccgtgcccgccaattcgccggcctggctctcgaccagggccttcgcctcggccggcgtgtagtgcgcgtggaagaactggttgatggtcccgaggttgatcggcaggggatacacctcgccgtcgtgcgtggcgtacacgcggtgcacgtagtccgtgaagcttgtgaaacggttcacgtagtcccagaccctcttgttgctcgtgtggaacaggtgcgcgccgtacttgtggatctccgcgccggtctcctcgtccatgtagctgtacgcgttgccgccgatatggtcgcgcacgtcgatgatctcgaccctcacgcccaggtgctcgacggcctgctgggccacggtcaggccgaacaggcccgcgcccacgaccaccagatcgggatactccaccgcatcagtcataagaaaacaaccttccaaacgttatcgatgcttatcgcagccacgcaaacgcacaggggtggcgtgcgattccttctcaagtgtacccgtgcgtctagtcggtgcggcgaggtccgggcatggtgtaatatggcaagagcctccgcgtggcggtatgtcacccaactcccccagggcaggaatgcagcaagggtaagtggcctcttccgggtgcgtggaggtttttctatatcttctccgattcgttccccacagtaggggcgatgccgtattctcggtgactatgaccaacgaattcaagccacttgtccgagatccacagcagcctgtgaacatgcttcagcagcccacggcagcaacgcctgcggaaccgttggaatcgttgtcgttccctgatatgcgcgaagtcgaggcggtgctttctccgcaggatgtcaacaaaggcttggctcaggcggatccgctgacccgccatccgcgcgtgtccagcatcgtgctgtgcgtggtgttcggtctgctgatgcttgccgcttccgccggcgtctggtggcttggcgtgcgtaccatggacggccaaagctatgaggatatcgtctggtcgaaactcgataccgcgttgccgggttggctggcgccggtcgtgcacgtcttcgccatttccgcagtggtcatcaccgtcagcgtcatcatgggggcaatcgcgtttgccgtgctgatcgtgcgcaaacggtggctgtcgatcgcgcagctcgccgtattcggaggcctgtgtttcgccgcggccgaactgttgaagccgctgctgccacgcccgtatcttattaatttggaatcgaatcctaataattccgcgccttccgggcatgtcatctttgccgctgcggcaagcgtgatgctgctgtgcgccgtgccgcgcgtgctgcgtgcgctggtggcggtgattggctgggcgtatacggtgctggtcggtttgtcggtgatcgcggcgcaatggcatcgtccgaccgacgtgattatggcgctgctgatcgtcggcggactggcgttgctggcgcttgccaccacgttcgccagcggcatggatgagccgggcacgcgcgtctcgtcggcaagcgtgcagatcgtcggcagtgtgatgctgacgattggcgtattgggcatcctgtacggcgcgtatatcatctggcagattcagccgggactcgccatgagcgccgaatggacgaatgccggcgcgtacgtttccacggcgctgctgacggccgccgtttccgcgctggtgcttggcataacgctcgccatgcgtcagctgaccgcctcgccgttgacgaaactgggtttggtgggagcgccgcccgcaccgccgaagcgctgaaaacagccggttccgggcatgctgccgtccatacgccacacgggcggtttgccatttctccgtattcagtgagtattattgcgttgcaaacactagtaataaggagtggctatggctaccggcagcaagctcgttattgtggagtctcctaccaaggcgaagaagattggcggatacttgggctccggatacacggtcatggcatcggtcggccatatccgcgaccttgcccagcccagccaggtgccggcggccgagaaagccaagtacggcaagttcggcgtggatatcgaagacggattcaagccgtattacatcgtggacggcaacaagaagaaaaccgttgccgacctgaaaagcgcgctgaagaaggcagacaccctctacctcgccactgatgaggatcgcgaaggtgaggcgatcgcatggcatcttgtgcagacgctgaagccgaaggtgcccgtcaagcgcatggtgttccacgagatcacgccggaagcgatcaaggcgtcgctgaacaacacgcgtgatgtggacgccgccatggtggacgcccaggaaacccgtcgtattctggaccgtctgtacggctatgagctgtccccggtgctgtggcgcaaggtcggtccgggcctgtccgcgggccgcgtgcagtccgtggccacccgtctgatcgtggagcgtgagcgtgagcgcatggcgttcgtgcgtgccccctattgggatgtcaccgccacgctggaagcgcccgacgccgacggcaacaatgttgcgttcgattctcgcatggtgtcgcttggcggccgtcgtttggccggttccaaggatttcggcgatgatggccagctgaccgccgccggcgtcaaagacaacgtcgtgcagctggacgaaacgcacgcgaatgcgatcgcgcgatcgctggaatatgcgacgttcaccgtctcgtcgatggaaaccaagccgtaccgtcgccgtccggtgccgccgttcaccacgtccacgttgcagcagacggccggcaatcgccttggcatgagctcgcgccagaccatgcgtgccgcgcaggggctgtacgaaaacggtttcatcacgtatatgcgtaccgattcggtgacgctgtcgcaggaggcgatcgcggccgcccgtgaagcggtgtcgcggcacttcggcgaaaagtacttgtccgatgcgcccaagcagtacgccacgaagacggcgggcgcgcaggaagcccatgaatgtatccgaccggcgggcgcgcatttccgcgatccggctgaaatcgccaccaaagtgccggccgaccagctcaagctgtacaccctgatctggcagcgcacgctggcctgccagatggccgatgcgaccggttccaccgccaccgtgcgtctgtccgcgccgaccgaatccgacggcgaggccatgttccaggcgtccggcaccgtcatcgaattccccggcttcatgaaggccaccggcgagggccgccgtagcgttgccgacgcgaagaagagcgccgaggcggcgggcgtgaagattggcgataaggccgaaaagtctgcgaaggcttcgaagaaaaccgatgacaacgtttccctgccgccgatgcagccgggcgacgagcttgccgccgtggacgttgccgcggacggccacgagacccagccgccggcgcgctacaccgaagcgtcgctcgtcaaaacgttggaacagaaggaaatcggccgtccgtccacgtatgcgagcatcatctccacaatcatcgaccgcgggtacgtgtacgagcgtggccgtgcgctgattccgtcctggctggcgttctccgtcaccaaactgcttgaaacgaagttcccgaagtatgtggattacgagttcaccgccgatatggaaaccggcctcgaccagattgctggtggccatgagaccggcaaggcgtggctgacccgcttctacttcggttccggcgatggcgcggcccagtccgccgacgaggcgcatgagggcctgcagcagcaggtggcgcagcttggcgagattgatgcgcgtgagatcaacaccatcgatatcggcgatggcctgcacgtgcgcgtcggccgttatggcccgtatcttgaggacatgaagcatctggatgcggaaggcaatccgaagcgcgcctcgttgccggatacgctcgctccggatgagctgaccgtcgaggtcggccacgatctgattgaaaaccattccggtgggccgcgtgaactgggcaaggacccggcgtccggcggcgccgtcgaggtacgcaatggccggttcggcccgtacgtggcgttggtcatgccgagcgcggaagatgccggcgataccgctgccgagtccgccgcaggcaaggcgggcaagacgaagcgttccggcggtaagaaggcggcttccgaccgtccgaagatggcgtcgctgttcaagacgatgagtcccgaatcgctgacgttggaagacgcgctgaaactgctgagcctgccgcgcgaagtcggctcctacgatgaggcgaacgccgaaaccggcgaaatgcaaacggttacggtcatggccaacaatggccgttacggcccgtacctgaccaagaccggtgccgacggcaagtccgacacgcgttcgctggcttccgaagacgagatcttcaccgtcgacttggagaaggccaaggaactgttcgcgcagccgaagtacggacgcggtcgtggacgtggcgcggccaagccgccgttgcgcgatctgggcaccgatccggaaacccagaagcacgtgaccatcaaggacggcttctacggcgcgtacatcaccgacggcgagacaaaccgtacactgccgaagcagtatgcgcccgaatcgatcgaaccggccgaggcgttccgcctgctggcggagaagcgcgcgcaggggccgtcgaagcgtcgtggccgcaagacggctgcgaagggagccaagaagggcgctgccaaaggcgcgaaatccgcgaagaaagtgagcgcgaccgaacaggcgcgtgccgaccgccgtgccaaggtgcgtgaactggccgacaagggttgggcgaatacgcgtatagcgaaggagatcggctccaccgcgtccaccgtgaaggctgacgtcgactggctgaccgccaacgaaggctacgcgcgtcctgaagtcgttcccgcacgctgacgttacgcggcgcgcgaaacgtcgcacgatctgatgtcccgcaagacaatcggcatcgtgcgacaccaagccgtggccgaatggccgggcacggcaggggcgcacggtacagtgaaaggcatgcagggcacttttatctcgtttgaaggcgttgacggcgtgggcaagaccacgcaggtcgaacggttgcgcgcatatgttgaatctcagggccgcgaatgcgtggtcacgcgcgagccgggcggcaccgcattgggcgtggcgattcgcaaaatgctgttgcacggcgtggatacgggggatgagaacgattgtgccgacatcgccccgcgtacggaggcgctgttgttcgccgccgaccgcgcgcagcacgtcgcggaagtgattctgcccgctctgcaacgcggcgcggtggtcatcaccgaccggtatctcgattcctctttggcgtaccaggcgggcggccgcgagctgacggccgcggaaatccgaaacctgagcatgtgggccacgaacggtctgctgccggaacgcacgtatctgctggatatggatccggcgcaatcgcatgcgcggctgcagcatgccgaagaccgcatggaggcggccggcaacgacttccagcgtcgcacacgcgtcgcgttcctcgacttggctgaacgtgagccggaacggttccacgtcattgacgcaagccagtccatcgaagacgtgtgggcgcgtatcaaagccgatttcgacaccgtgagcaccgctgacgggggtatcgcatgagcgtgtggaactccatagtaggccaagcgcaggtggtcgaacagctgaaggccatcgccagcggcgacccgaaggccatcgcgcagtcgtggctgatttgcggccctcccggatcgggccgttccaacgttgcccgcgcgttcgccgccgcgctcgaaagccccgatcatggcctgaacgatgagccgaccaaaaccaccgagcaggtgcttgccggcacccaccccgacgtgagcgtgctggccaccaacaaagtgaccatcggcatcgacgaggtgcgtgacatcatcaccacatccgagcagatgcccggcaccgcgccgtggcgcatcatcatcatcgaagacgtcgaacgcatgatggaacgcaccaccaacgtgctgttgaaggaaatcgaagagccgagcccgcacgccatctggctgttgtgcgcgcccagcgcccaagacgtgctgccgaccatccgctcgcgcacgcgcatcgtcaacctggccgtaccgtccaaccaggcggtggcgaaattcttggaatcgcaaggtttcgagccgaatatcgcggcgcgtgcggcacgattgtcggagggacacatcggcatcgcgagcctgtatgccaaggacgaacgcgtcatgacggaccgcgacgagctcatcgtcggcgtgctcggcttgcatcgcgcgtcggacgccgtgctattggccggcaacctcatcgacaacgcgaaggcgcaggccgaagcggaagtcaacgtcaaagcgtccgaagcggaagccgatttccgccgcatcaacgggctcggacccaaagaccgcatacccccgaaactgcgtggcgcatacaatgcgatcgccaaaaaagacgagctcaaacgacgcgccaccagactcacgcgtgacgtgctcgaccgtgcgctcaattcggtcgccagcatctaccgtgacgtggcggtgctgcagaacaacgccgaggacgcggtggggctcatcaacctcgaaaaccgttccgccatcacggaattgtcggtacggctcgaccgtacgggggccgtgcgccggctggaggacatcgccaccgcgcgccgcaggctcaatggcaacggcaatccggttttggtgtttgaagcgctgttctgtgcgctgattccgtgattttcgtaatttccagtaattaccggcgattcgattcgcgattcaccggcggaacaccgaggaatcccgcacaataagctgcggggcgagcatgacgcggggcgcgcgcacgctgccgcctggcgcagcagtcgtctcagccgcgcctccggcaggaccggaagccagcaatcgcaagcattccgacacaatacgctcaaacggcgcacgcaccgacgtcagacggggcatggtggtacgcgctatggcggaatcatggtagccgaccaccagcacgtcctccggcacgcggattcccaacgcgtcgaacgccaccatcacgccgaatgcgatcgcatcgtcggcgcagaccacggcctccggctgcacgagcggcccgttgaacagccgcatggcacaatcgaaaccgcgctgcacggtacgttcgccgaactggttccagttttcgctggtggcaagcccgtaagtgcgcatatgcgtgtggaatgtggcgaacagttccgccgattcgaaagacagctcgttgccggccatatacgcggcggacgcgatgccctgctcggccagatgtttgacgatcgcctccatcgcggcgttttcgtcgatgcctaccacggacacgcgcggcgcggtctgccgtccgcagatctgcacgatcggcagcgtgttcgcgtactggttcagcgttccggcaaggtcagtgccggctgcgggcaccacgatcagcccgtccacatggcggttggccagcgattcgatgcgttccgcctgcgcttcctgcgtggctccgatgcccagcagcagctgttgcgattcggtgtcgatggtcggctcgatctcgtcgagcagttgcgcggagaacggttccgtggcgctcggaatgaccaggccgatggttttcgtcacgtcgctgcgcagcgcgctcgccgcgtagttgacggaatagccgagctgtttggcggcttcgcgcacgcggcgggcgatatcgtcgtccttgccgcgtttgccggacagcacgcgtgagacggtggcgatggacacgccggccgtcgccgcgacgttggtgattgagctgccgctgtcggttctgcctgccatgcgctgtcctttccgtcgtgtccggcttgcgtttgccggctccctaagtgtttttcaaaatgccctagagggtgccctgaacccctgtgtgcttctcggtcaaaggtctggtctgatggaccggttcgagccgcgaagaacctattaagaatagaacgaccgcccgtcgaatatggcgggcggtcgaaacgttcgtacgtcagtgcgtcagcgcgttatgcgcggtgcgtcactcggcgttgacgaggatgttggccaggttgtcggccacggcctcggcgttgtcgccttcgacgttgatgatcacggtgtcgccctgcttgatgcccagacccatgatggacaggatggagccggccggaacggcgttgccgccttccttggcgatggtcacggtctggccggaagcggtgacggcctgcgcgaacatggcggccggacgggcgtgaatgccgaccggatcgttgatgacgagattgcgggttgccataatggtctcctttgttgtggttggtggttggtttgcttacgttgggtcgtctcgatatttacacgtcgatgtatatcgatttttgcatatcgattgcattatgcggcttttgccggcatctgcatttcttgcgattatcatagcacagtttttacgaaacacagaaaacgtttaccggttttgttttgcgggaatttcgtgtatactaatcgcaggctgaaaatgatttaccggcaaagacggtggggatcattgcagtaactcacctacgcaaggcaggcataatcctgcaatcgtttgcgtatccatattttttcccaaggaaacaggaaaaggagttctcatgaacattaagggtgttggtatcggtcgtggcgtcgcagtcggcccggtcattcgcatggccgctccgctgccggaaccgtcggacgctccgcgcgccgaaaacatctccgcggaaaccgaaatcgcccgcgtcgaaaagtcgctcgccctcgtcaacgccgacctgaaccgtcgcgccgaagaggccgccaacggcgacgaaggcgccaagcaggccgccccgatcctgcaggccatcgccatgttcgcctccgatccgtcccttgcgcagtccatcaaggacctcatcaaccagggcaagaccgccgagcgcgccgtgctggaaggcttcggcgcggtcgaagacatgttccgcgccatcggcggctaccaggccgagcgcgcagccgacctgcatgacgtcggccagcgtgtgatcgccgacctcatgggcgctcccgccccaggcctgccggtcagcgaaaccccgttcgtgctcgtcgccgaagacctgtccccggccgacaccgccgcgctcgacatgagcaagaccctggccatcgtcacctcccagggcggtccgacctcccacaccgccattctggcgcgcgcccgtggcatcgtcgcggtcgtctccgccgccgaagccgccgaacttgagaacggcaccaacgtcatcgtcaacgcagccaagggtgagatcgtggtgaacccgagcgaagacgagatcgccgccgccgaagccgccaagtcccgtgccgccgcagccaaggaactgcgtggcaagccgggcgccaccaaggacggccatctgattccgctgctcgccaacgtcggtaagccgtccgatgccgcgaaggcgctggaatacggcgccgaaggcgttggcctgttccgtaccgaattcctgttcatcggcaactccgagccgccgagcgtcgaagagcagaccaaggcctacaccgagctgctcagccagttcccgggcaagaaggtcgtgatccgcatgctcgacgccggcgccgacaagccgctgccgttcctgactccggaagacgagccgaatccggccctcggcctgcgtggcctgcgtaccctgcgcgcccacatggacgtgctcgaaggccagctcaaggcgctcgccgccgccgacgccgcaaccgacgcgaacctgtgggtcatggccccgatggtcgccgaccagcatgaggccgactacttcgtcaaactcggcaagagcttcggtctgaagttcgtgggcgctatggccgaagtgccgtcgatcgccctgatggccgacaaggtggccgacgtggccgacttcgtgtccatcggcaccaacgacctgacccagtacacccttgccgccgaccgtaccctcggttccgtggccaactaccagaccgcatggcatccggcggtgctgcgcgccatcaagatgatctgcgacgcgggcaacgccaagggcatgccggtgggcgtgtgcggcgaggccgcggccgatccggatctggcggtcgtgctggccggtctcggcgtcaactcgctgtccatgaccccggtggcgctggacgatgtgcgcgcctccctcgccgaagtcaccttcgaagaggccaaggccaaggcggccgccgccctcaacggcgacttctacaagccggccgagtgatttttcccccttctttctttcgctcggctattccggactttgcggctgcgttatcgtggccgcagggttccgccactgcaaatgtgcctatgagagcgattcggttctgataggccctgtttcccggaatgaccccgttccgtgcgatcgccgcgcggacggggtcgtttcggctgagggttgcgccgattgctgcgattgcatcgattgagccaccggcgtagacgcgtcatacggccgcgtcgcgtcacgcgcatgcgcgatactggaagcatgaagatttccgcagatttcaccgtcattcccgacgcgttcgccaaggcggcgccgcctgagaactgcatcgacggcactccgatcgtttccttccccttctatatcgacgagctcgacccgtccgtgcagtttctgcattgggaattcgtcgatcccgattccattccggtgtgcggtttccagtggaaccattggtcgctcgccaatctgcccgtggacgcgctgatgtacgatttcaacgattcacatgcattggcgattccggccgatttttcccgcacggtttccgcgatgattcccgagacggtgcagggacgcacgtccgccgcatcgccgttgttgaagggccgcagcagcgatccggccgtcaccatgcgttacaacggcccgtacccgcccgaccaggaccacgactactacctgcacgtatggggcaccaccgcgcctctcaatggtctcaatcaaggcttctggctcaacgagatggaacgcgcgttgcgtaattccggtgcgatcgcggaccaaggcgctatcttcctgaccggcaaggcgtgaccggcgaaaccggcgagaacagccggcaaggcgcaaaccgcgtaatcgcaagaaaataccaaagaataccgcaaacgtaaacaaaacaaacgaaaggaacgtacatatatggcatgcaccacgattctggtcggcaaggacgcaagctatgacggatcgaccatcatcgcccgcaatgaggacagcgcgaacggcgaattctgcccgaagcgcttcatcgtcgtcaagccggacgagcagccgcgccactacaagagcgtgctgtcccacgtggaagtcgacctgccgggcgagccgctgcagtacacggccgtgccgaacgccgacctgaaggaaggtatctggggcgaagccggcgtcaacgaggcgaacgtggccatgagcgccaccgaaaccctcaccaccaacgagcgcgtgctcggcgccgacccgttcgtggagctcactccggccaagggcaaggaaggcgaggacggctacgagccggaagtgcccggcggcattggcgaagaggacttcctcaccctcgtactgccgtacgtcaagaccgcccgtgaaggcgtggcacgtctcggcgctctgctcgaacagtacggcacgtacgaaatgaacggcgtcgccttctccgacgtggacgagatctggtggcttgaaaccgtcggaggccaccactggatcgccaagcgtgtgccggacgaggcatacgtgaccatgccgaaccagctcggcatcgacgaattcgacctcgacgacgcgctcggcgaccaggaggagcatatgtgctccgcggacctcggtgaattcatcgaacgcaaccatctggacctggccgtggagaacgtcaccccgttcaatccgcgtgacgcgttcggctcccactccgattccgaccatgtttacaacaccccgcgcgcttggtacatgcagcgcttcctcaacccgtacgacgagcagtgggacggtcaggacgccgaccaccagccgacttcggacgacattccatgggctcgccagcctgatcgcaagatcaccatcgaagacgtgaagtacgtgttgagctcccactatcagggcaccccgtacgatccgtatggaaagctcggcgaccagcattcgcgccacatgttccgtccaatcggcatcaaccgtcagagccagctgtccgtcatgcagatccgtccgtaccgtccgcaggtcaaccgtgccgtgcagtggatcgcctacggttccaacccgtttaacacgctcgtgccgttcttcccgaacgtcgactccacgccgaagtacctcgaagacaccaccacgcgcgtcacctccgagaacttctactgggagaaccgcatcatcgcggccctgtgcgacgccagcttcgccgacaccgccaacgcggtggaacgctaccaggagaagaccggcggcatgggccaccgcatggtagccgccaccgacgagcagatcgaccgactggtggaaggcgtggtcgacgaattcgacgccgaggacgagatcggcgacgtgcagccgatggaaccggacgaaatcatcgaagccgtccgcaacggcgaggcgcgcgaagtgctcgccgccgccaacgagaccatggccgcgcagctcaaggaggaaaccgacaagctgctcgactccgtgctctacaccaccagcatgaatatgaagaacggcttccacatgtccgacttctgatattttctgcgattgcgcaatcgcaagaaattctacgaaaacccgcgtagcaaccggcttccgcacagcgttcgccacaaacagttccgtatgacggtcggcgcgcgtccgctgtgcgggagccggttttctttggtggcgcgtgcttattagaatggcgatcgtctttgcttttccgctcgtgccggcgcgcgttgcataggcgatgtctgtcgcgtacgttgtgcgccatacagcggaatgctttcccaagaaaggaacccagtgaccagcattgaggatttcaccagccaatacggtctggtgcagaagattgatgcgttcggctatctcgattacctgaagaagaatcctgatgcgccgcgcaagcatggcaaggtcgtcctcgtcaccgccgacaccccgctgaaggcgtcccgcggcgaaggcaagaccaccaccacgatcgcgctgatcgacgcgttgcgcgaacgtggcatcgacgcggcagccgtgctgcgccagccgagcatgggcatcaccgcagccggttccaagggtggcgcctccggtggcggcaaggcctccctgacccacccggagctgatcgactggggtctgtgcggtgaaatgggagccatcgaggccgcccagaacctgttggtctcctttgcggagaaggctgttgacgacggcaagctggacaccatcctcgtaccgcgcgtctccgaagtgccgtcccgttccctgcgccagatcgcagtggaccgtggaaagggcgacgtggctgagcgtgtggtgctcaccccgacctgcgagctcatgcagatcgttgtgctgtcgcgttccatggatgagatctccgagcgcgttgccaagatggtcgccggcacgaaggatggcaaggccgtgaccttcggcgaattcgttgacctgtggcgtatcaccggcatcctcggcgacgccgtgaagccagccaagacggagaccgtgaacggctctccggtgtacgtgcacggcggcccgttcgccaacgtgtccatcggcattccgacgctggtttccgtggagatggcgtgcgcgctgcatgacgtggtcatcgtcgaagccggctacggcaccgacgctggtgcgcagaagtggctcgacatcgcctgccgcgaatacgacgcgcagtggccgtccgcagccatcgtcgtgacccgcgcttccacgtggcgcgacgatccggatctggcatggcgctacccgttccacgtccagcgcctcgaaggtcttgatattcctaccttcccgcttatcaacctgtgggatggcgaggatgatcagattccggcgctcaaggacaccgccaaggaactggaattccgcgacccgatcatcggcaacctgtaccgcgacggtggcgacgcgctcgccccgcagctcgatgcgttcgtcgatgccgtgacgaacggttctatgccggccgaaccgcacagccacaagggcatggctctggtggagaacgtgcgttgggtcgccgagcatgcgtatggcgttccggccgaccgtgtgattctgaaggacggtttcgccgagtcgttgcaggccgccgagggtctgtgcgccagcgcgggcatcgatttcggctcgcttgctctggtcgcggtgaagtctccggccaccatgaccgacaacgaccgcgctccggaagccgagcgcaccgtcacgctgaagaaggtcgaagtgcattccggcgcgggcctggtgcacgtgaacctcaccacgtcgctgaccaccccgatgccgaagatcgtctgattttcttgcgattgcgccgcgtggcggtacgtcccgtaccgtcgagggcgctcgctaatcgttgattcggcgtaaatacaaagccgctggtcccgttcgggccggcggcttttttcgtgggtgatacctttacgttgtccgtttgtgggtgcgggcgtgcttgcatgtgcgcccccttttgctcacgagttgcggaatggggcgatttttctctcttatgagcaaaagggggtatgattactgacgattttgccggttttcataccccttttcgctcacgtcccgtagaaaaggcccgtttctcgcttttgtgagcggtcgggggtgctgatattgcgatttccctgccgtagtcaggcgagcttcctagacgtgcttcccgtaggtgaggtgagaggtttgcaatatgggcaaacctcgaaggaacggtggaaacttcgtcagaagtttccaccgttccagccccagtcagtcgtggcggtgtagcggatgtaagtgcggtcggccggaatgcccagctccttgcccagcgcggccatgatctgctccgtcagcttctcccaggcggaacccggcacggaacggccgaacacattcacttccacgtatgcggccggcttggaatcgtcaccgccgaaataaatcggcatattgtcttcgaacgggcacatcagccagccttcagacttgccgggaactgcggtgatggccttgccgtaggcggccttcagcgcctcgcgctgcccaggggtggtggatacggaaacgtgcgtgtggatgactggcattgctgctccttgcaatcgttgaaatatattgttcttcgttacccaagtttaggtggtctgcgcgcgagtgttaaatatcccgtgtgagaaaactgattgaacagcttatgaaattcggcattgtgggtgtgatcgccttcatcatcgactggggtattctaaacattctcgtcggcgccttccacatgcacaacgtgctcgccgccaccatctcgtttatcatctcgttgatcttcaactatgtcgccagcatgaagatggtgttcaagcatcgtgaggacatggcgcgttggatggagatcgtcatcttcgtggtcggcgcggtgatcggcctgtttatgaacgacgccatcatctggatctccacgtacggcatgaaccacgatgcctacgtgtcgcagagcaccgaatacctgatccgcaccaacgtgggcaagctcatcgccaccgccgtggtgatggtgtggaacttcctgacccgcaagtggctgctggacgatacgcacaccaatgcgatgaaccgcttgaagaagcaggagaaccgcctgactcccgaagagctggaggccaagtgggagaacagcttctcgcacaagctcggcgtgtggtcgctggaacatacgcccaagggctggccgaagtaactcccaaataacggggtaacgaaaagcgcgtccgaatccattgcgattcggacgcgcttttcgttatgcggattgtctgccgtgcctgccggttacccgtcggcatccggcacatgctccgtcacacgctcacgctggtgagcatcggctgctccgtggattccttgatctgcttgaagccgaacagggcgatcaccagcgaagccaatgccaaagtcgtcaccacgatgaagccgccatgcgagcccatgcggtcgatgaactgtcccgcgatcgcggagcccaccgaaccgccgatcgaattcatcgcgcccatccaggccatgccttccgtgaagcgcgtgggcggaaccaggtgcagcatcagctggttgccgttcacccacgtcggagcctggcagacgccgatgcacaggtagatgatcatgatcacccatagatgcttagcgaacatgaatgagccgatgcccagattcaccaccgcaaggcagaagtagaaacgtttccacagcggaatcttccaattcttcgcgccgtacacaagtgcgccgatcagagagctgagcgagaaacaggcgaatacgaaaccggtgtactgcttcatatgcgcttccgtggcgaatgcaacaatcgaaatgctggcagctgactggaatgcccccaggccgaaccacgtcacacacacggcgatcaggcctggcccccaaatcgattccttgcggcctgccgcaatatccgtggcggccttctgcatcgcggccttcacctcagcggccgtcttgccttccgcacgagccttgtcgcgcgcgtattctaccgccgcttcggtttgcaaagccttggaacgagcagcctcgcgctctcggtattctttacgtgtcatgccggcttcacgagccaactgcgtctgcgatttcggttcggtagaaagttccgtgaggaacatcagcgcgccgatcaccacgcacatgccggtgaacgagaacgccagcaggcctgaaattacggccaatgtggatgccagcggattgccgataacccacatgcattcatcgaatacgcccgatagggacagcgcgcggttcgttttttccgcatcgcccttgagcaatgtggtccaacgttgacggctcatcgcgccccacggcggaatcgcggccatgaacggcactatgcagaacaggatccacgacggcacgcgtgcggtgatgcaggagaccagcgcgatcgccgccaccatccacacgatgattgtgggaatcgacacctgccgttgaccgaatttgtcgaccagcttgccgagcaccgggctcgccacggccagcgcgatcgcctgcacggccgtcagcgcgcccgccagcgaatagttgccgtagtaatgctgcacggaaatcgtgatcgtcatgccgaccattgggaacggcatgcaggcgattaccgatccgacggagaatcgcgcggtgtgcggtatgcgaagcagctccgcataccctccgaaaagacgttggccgatgtctttgacgccgacgaggacattgttggtcatgtttgccgctcctttccgctcacggtttcgctcgtgacgtccgcagctttgcgtcgcgtgcggactgatggtggtggttcccctgaattattggttaaccgcttccgataccagctcgctgccccagtcgtccgaacacgtcaatcgattgacatgtttgacatgccgcacacggggagaaaggtgggatggtgcgtgttgtttgtgtgtctttgttgaccaaggcaactttatgcgcaggtaccgtcgtgacacgcggtacattagggcaggaaccaatattcgaatcgacgaattttttcacagggccggcgaccggcgaaacgtgctgagccagcacgtggccggcaggtccgaaacgcaagaaaggcggccaatatgccggcgacaaccatccatttcgtgcgccacggcaaagtggagaaccccgggcacctgctgtacgagcggctgcccggtttccacctgtccgacgtgggcgtgcgcatggcgcaggccaccgcgcattacatcgcggtcagcccgcagctgaacaccgtatccgccgtctactcgtcgccgctggaacgcacgcgcgaaacggcgggggagatcctcgaatcgctgaattcggtacgtggattgcgcggcgaggaaccgctggagctgcagacggacgaacgcctcatcgaagcgcgcaacgaatttcgcggcaagcgtatcggcttcggcgaaggcgcgctgtggaagaacggcaactggaagctggtacgcaacctgtggaagccgagctggggcgaaagctaccagtcgatcgcgcatcgcatgcaggacttcgccttggagaaagtggcggaatatcccggcaaacagatcgtggtggtcagccacgaatcgccgatttggagctaccggcacatgctggaaacggggcaccccgaacacaacatgctgttgcgccacaccgcgctcgcttctatcacctccatcacttacgattgcaataccgggaaaataatgtccattacctacgccgatccggcggcggacgtcgaataatgtgaaccaaaacatgcggtggctcaatcgcggtcggggatgactgcggttcgggccggccgcacgatatacaaggagaaagtatgtcttttgtatacgaccagaaggtcgtcgactcgatgtacggctcgcacgtggtctccatggcagttgactacggtgtcgatctggtcaagatgtggccgttgcaaacgaaccaggaactggaaaacgatgtcaaatatgcggagaacctgcaggtgatgttctccggcatgatgacgcaggtgctgctgaaacgctccgaagaagtcgaccagtcggttgcggaagccgtatacgaaggcatggatgtgcttcccggcgtcgatccggaaatcatccgcacgctgatggatgccaaccgcgcctatgacgtgatggcctcctaccacggggtcgacggcatcgaactgttcatggaaaccgccagaatactcggcatcgacgtggagacccgaatcgaaaaggaaatccaagacctcatggagaacctctcacgcactatgcgcagcgcctccggattcgaagtcgacgatgacgtggcggaaaacgtcggcatctgccagtcggccacggtggaccgcaacgaattcgcaagacgctacctcgcctcgatgacggttctcgacgcgctgataaacctcatgtgctatggcaccgacgattcgcaggagcaggccatccgcgtgctgccggtgctgctgttcgtcaacgccatgcgcaaccagctgtcgattccgcccactttcatcaacgccgaacagctcatcaacctgtttggtctgcgtgacaccgcccgccagttcggacggccccagtcggtgttcgacagctcgttcaacccgctgacgttctccaccaccgtcaagtacctcgctttcttcgcggggcaggaatggctgcggcatatgaggttcctggagtgggacccgaagcaggccgaacaggacgccaaagacgaggacgagcgcaaaagcagggaagcgctcgcaaagaaatacaatttgacgagcgatggcgataacgcggcttccgacgcggatttggattcgtctgcagactcgaatttgtctgaggattcggactcgtcggaagaggccggttcggagccgaccgaggaataagtgttgcgggcggtcgtgtgacgtctgacggtgaaggctttgcgtgtacttgcgttgcgtgcgcttgtgcttgcgctcgaattgcgcgtggccgtcgcctatcccacgcgttacatccgcaacgacgtcactacccgtaacgaatgatctgaaacgaataatcccggtatcctgcgattgcacaggataccgggattattcgttattcgttatggtgtgccacgttttgtgtggcgataaggcggggatcagagcgaaatcagagctgctgatcggtgccgttcgccggatcattcggtactgccggagcgtccgaatccgccggagcgtcggtattcggctgctcgtgcggatgctggaactgggccggcacttccggcatcggcggaatggacggtgtcggaggcatggtcggaacagccggcatcggaggcatagacggtacggacggagcctccgccagcggattctgctgaggtgcggcgtattgcggcgcggcgtgctgctgcgcggcgtcatactgcggtgccggagctgtgtacgaatcggccggagtcgctggtgccgtgtacggcgcggccggtgccgcatccgccggattggtcggcagcgggacgttgccgtacgaggtggcctgcgccgcatacgggtctgccggagcctcgcccgtggcgggagcccatgcgttggaagccgtaggagcgtcgaaacgcgcgccttccggattggaatcgcgggccatcagcacaaagtagaacacaccgctggcaatgaaggccagcacgccgaggatcagcaggacaacgccgccgatgctgacgctgttgcccgcctccaacgacctgaacgaaagactgctgccgatgatgaggatcagaccgatggcgaagaagattccggcggccgcctgtaccgcgtagatgatggccagcacggtgccacgcatgttgatgtcatgcagacgacgtacgccaagcgcgatggtcggcacaagcacgacgagtcccaaaatggaggagaacgagtctccgacggtggcgatcacgccggaatcggtgaggttcctcaacgtgcggaacacgagtctcaacacgaaagtgacgacggtataggtgaggaaccaccaccagaactcgctacgcgaggcgcggcccttgaacaccgcgtacttcttgaagaaacggacgatcgcctcgcccaggttgcagccatatgcgggcatgtcaagcggcgcggtcaatgcgaagaagctattgcccgactgcggttgcggtgccggctgcccgtaattcgcggctggagcctggccgtactgaggggcctgtccatattgaggggcctgagcgtactgcggagcctggttgtattgcggttgcggtgcttggccgtactgcggagcctgaccatactgaggtgcctggttgtagttcggggcggcgtactggggcgcctgcgcctgcccgtaatccggcgtgccgtactgcggtgccgtctggccgtagtcaggggcaggagtctgaccatactgcgctgccggctgtggcacctgcggattgtattggttggggtccgtcattagagtgccctttcacaaaacggtgactaaagaataaagaaagtcgcttcatacattactcctttgccgatgtgaagatagggaaaaatattgcagtatggaacgctgcggaagaaaaacggcgattgggtcgtggcacgtccggtttgcgcggcacaatggagcctatgactgaagttgaaaataccaaaccggaacttcctgaaaacgttcgtgtgcgtttctgcccgtccccgaccggcattccgcacgtcggcatggtccgcaccgcactgttcaactgggctgaggcccgccacaccaagggcacgttcgtgttccgtatcgaggatacggacgcccagcgcgactccgaggaaagctacaaccagatcatcgaggccctgaattggctgggcatcgactgggatgaaggcatcaacgtgggtggcccggacggcccgtaccgccagtccgagcgtggcgacatctataaggacgtcgcagccaagctgctcgaagccggctacgcctacgaatccttctccactcctgaggagatcgaggcccgcaacgtggccgccggccgtccgaaggctttcggctatgacggctacgatcgcaacctcaccgaagagcagaaggccgcgttccgcgcggaaggccgcaagccggccctgcgtatccgcatgcccgacgaggacgtcgctttcgacgaccttatccgcggtcgcatcgaattcaaggccggttccgtgccggattacgtgatcgtgcgtccgaacggcgacccgctgtacacgctgaccaacccggtcgacgacgccatgatgcgcatcaacgtggtgctgcgcggcgaggatctgctgagctccaccccgcgtcagatcgtgctgtaccgttacctgatcgagctgggcgtggccaaggaaatgccgctgttcggccacatgccgtacgtcatgggccagggcaacaagaagctgtccaagcgcgatccggaatccaacctgttcctgcaccgtgacaacggcttcatccgtgagggcctgctgaactacctggcgctgctgggctggtccatcgcccccgaccgcgacgtgttctccatggacgagatgatcgagaagttcgacgtgcgtgacgtcaaggccaacccggcccgcttcgacatcgacaaggccatctccatcaacgccgagcacatccgcatgctcgaaccgcaggacttcctgaaccgttccgtgccttacctgcaccgcgacggcgtggtctccgccgattcctgggatgcgctgaccgaccgcgagcgtgaggtgctcaccgccgccgctccgctggtccagccgcgcgtgcgcctgcttggcgaagtggccggcatggtcggctccctgctgtccaccgaaggctacatcgagccggacgccgacgccaagaagcagctgaaggattccgctccggccgtgctcgacgctgcgatcgcggcgctggacgccgttgctgagggtgattggaagaccgacttcctgcacgagacgctgaacaaggcgctggtcgaagacggcggctacaagccgcgtctggctttcggcccggtgcgcgtggccatgagcggccgccgcgtgtccccgccgctgttcgaatccatggaaatcgtcggcaaggacgttgccatggctcgactcaagggcctgcgcgagcacctgtgagccgttgagctgctgactgttagctgaatgatggaaacccgccggagtgattcggcgggttttcgtttatgcggaaggctggtgcggaatggcggaaaatagcgcgacacgccgtaagttgcgcgactgtgctgtttcgcgtatatttatcactcgttgcggttcacagcctggctgagaatcacagcgataactcaagcccccgtcgtctagcggtctaggactacgccctctcacggcgccaacaccggttcaaatccggtcgggggtacgacggacaacttttcgaagttgccacgcctgccaaattgggatgtggtgtaattggcaacacagctgattctggttcagccattcttggttcgagtccaggcatcccagccaatgagccctcgcagatgcgagggttttttgttttttcgcacctgtctgttcacgtcgctttgggcggtgggttgatggattttgccggatgcgatgtggcagcgcaatctgctgacgccctgcgtgaatcgcacatgtaatcgcccaatgttgcattaccctagaagtatgaccgaattgcagcatgccgccaaagccacgcgcccgcgcatccaaccagcggaagagggggaccgtcgaccgctttccgtatccgcacggcttggccgcctgcaattccaccagtccggcaaattccgcgtattgcaattcgccgacatccaagacgggccgaaagtcagcaaagacaccatcagcctcatcgaggcctcgcttgacgccacacgccccgatcttgttattttcaacggcaaccagatcgccggatatgattccgcatacgcgctgacctcccgcaagcgtcgctgggacgcgcgtccggcatccgcatcgtccgaagcgtccggggaacgctatgcggccgcattggaacacacccgcgaattggtgcgagccaccatcgaacaactggtccacccgcttgccgaccgcggcgtgccgtgggctgtgacgttcggcaaccatgacttccagtgcgggctcgacaatgacgaaatcgaaagcatctgccgcgaattcccggggtgtatcaatccggaacgcgctgccgacggcgcgacgggcatcgccgtgaaacatggtgtgaaacatgatgtcggcgatatggaacaggacttcggattgccggaacagcccgtgatcgcgtgcgcgcccggcacattcgcgttgtcggtgacggacgtcgatcgcacatatgacgtgttgggcttggtcttgctggattcgggcgattacgcgcgttccggcggctacggaagcccgtcggaagccgcgctgcgcttcctggcgaatgcgccggggctgatggcggcgcaatcgcagcagctgcaacaagaccggcaggatgaacaggactcgccgcgcgaaccgcgcaagacgccgtccacgctgccgtgcatggtgttccagcatttcccgatcgaacagtattatcgcctgctcaagccggtcgcggccaccgctgcgcgcgcgattgaaggataccgcaacttcgcggggcggcatttcgtgctcaacgaagacaaaacgcagcccggaagctatctgggggagggcgtcagctgcccggatgccgacagcggcgaattcgcaatccttgacaaggcgggatattttgcgatttccgccgggcacgaccaccgcaacgccttcgtcggttccgtgccggtcggaaccgacggtgaccggcagatgatgatggtcgcctcgccgaccagcggttttggctcatacggcccggtgccggccaagcgtgccgctcgactgttcgaattcgacatccgccacccgtacgagccgcgcacgcagctgttggaatacgacgagctggtgggcaaacccagcgcgggcaaggcctacgcctacggcatgaccagcgaatcgaagcccgattcggaaggcatggacctgctccacaggccgacgtggtggagcaagacgtggaacaagctggtctcgctgtttcgccggtagctgtttgttgactagtcgttccgccggtagcctttccggcggtgactattccttttcccgacttttagctttgaaatgaatacaaaaaagctgacgatgggaactttccatcgtcagcttttacgttacgtatgcgactggtcgcggacctgtcagcggccggaagaggccttgatcagcgcgtcggtgaggtacttgccggcggccatgaccagcggcgcgtaacggcggccggggttggcgcccatacggccattcgggccggaaattgaaatggcggcgatcacctggccggacgcgttgcgaatcggcgcggaaatcgaacacacgccctcatcgcgttcattgatcgactcggcccaaccgcgcttgcggacggcggtgagcttggccgcagtgaacttggcgtggcgaagaccctgatgcaggcgttcggaatcctcccaagccagcagaatctgggctgcggaaccggcttccatggacagcatcgcaccaaccggaatggaatctcgcaggccggacgcgcgctccacggctgcgatgcagacgcgctgatcgccctgacggcggtagatctgcgcggattcgccggtgcggtcgagcagggtctgcagaatcggcgcggcggcggtcaacaggcggtcctcgccggctgcggccgcaagttccgcgaatcgcgatccgagcacgaaacgaccgtgctggtcgcgcaaaacgaaacggtgacgttccagcgcgatcgcaagacgatgcgcggtcggacgagccagaccggtcgcggaaaccagctgtccgagtgtggctgggccggattcaagagcgtcgagaatcttgactgtcttgtcgagcacgccgaccccggaatgaatttcgttgctttgcggggtggctgcgtaattgccgtttgcctcgttcgtggcgttcatggcctgcgttttgggcatggcgttgctcgtattcgaagaagaagtcatacgctgaattatgccatctcacatattgaaatgcaaaatgtatgtggttcgcgactggggtaaagcagattatttaccttgcttccaccggctggcgaagctgggaaaatgctgaaatttcaacgattgcgcatatgccgtaagaagacgggaagtaacttttccgcgtttgccgcgctcgtccctcgttcatatctcatataccggcatgaaggacctcgaacccgtttcaagcccataggcttatagcacgaagaatgcggcaaggcaatagccgcgaggaaattagtgaggaaaaatctgaggaggtcccacaatgggaactacattggccgagaaggtctgggccgatcatttggtacgcaagggtagcgatggggctcccgacctgctgtacatcgacctgatgctcatgcacgaagtgaccagcccgcaggcgttcgaaggtctgcgtctggcaggacgcaagccgcgtcacgtcgaccagctgattgccacggaagaccacaacacgccgaccgtcgacatcgaccgtccgaatccggacgagacttcggcgctgcagctgagcacgctggaaaagaactgcaaggatttcggcgtgcgtctgtgcccgctcggcgacgctgaccagggcgtggtccacgcgttcgctccggtgctgggcctgacccagccgggcatgaccatcgtgtgcggcgattcgcatacctccacccacggcgcgttcggtgctatggccatcggcatcggcacctccgaagtggagcacgtcatggccacgcagaccctgagcctgaagccgttcaagaccatggccgtgaacatcgagggcgacctgccgaagggcgtcaccgccaaggatattattctggccatcatcgcgaagatcggcaccggcggcggccagggccacgtcatcgaataccgtggcgaagccatcaagaagctgtcgatggatgcccgcatgaccatctgcaacatgtccatcgaagccggcgcccgcgcaggcatgatcgccccggacgaggtgactttcgaatacctgaagggccgtccgcacgcgccggaaggtgagatgtgggacaaggccgtcgaatattggaagacgctgaagaccgatgacgatgccgtgttcgacaaggaagtgaccatcaacgccgaagacctcgagccgtacgtcacgtggggcaccaacccgggccagggcgtgaagatctccggcgtggtgccggatccggcctccttcaacgacgagaccgagcgttccgccgccgagcgtgccatcgcctacatgggactgaagccgggcatgcgcatcaaggacatcgccgtggacaccgtgttcatcggctcctgcaccaacggccgtcttgaggacctgcgcgtggccgcctccatcatgaagggccaccacaaggccgacaacatccaccgtgtgctcgtggtgccggcatcctcccgcgtgcgtctgcaggcggaaaaggaaggcctcgacaagatcttcaaggacttcggcgccgaatggcgtaacgccggctgctccatgtgcctgggcatgaacccggacaagatggtggcccgcgaacgttccatctccacctcgaaccgcaacttcgaaggccgtcagggcaagggttcgcgcacgcatctggcgtcgccggccgttgccgccgcgaccgccatccgcggcaccatctgctcgccggccgacctgtgagcctgctgcgagcggaagctgcgaacgcaatcgtaagtaatcgaaatatcgaaatcgaatatcgataggcaatcgaaggatttgttgacatggaaaaactgactacccttaccggcgtggccgtgccgcttcgccgttccaacgttgataccgaccagatcattccggccgtgttcctgaagcgcgtgaagaaaagcggcttcgacgacgccctgttctacgcgtggcgccgcgacccggaattcgtgctgaacaagccggaatacaagcagggcaagatccttgtggccggcccggatttcggcattggttcctcccgcgagcacgccgtgtgggcgctgcacgattacggtttccgcgtggtgatttcctcccgtttcgccgacattttctacggcaacaccgccaagaacggcgtgctggccgcaattatgccgcaggaatccattgagctgctgtggaagctgctggacgaggagccgggccgcgaaatgaccgtcagcctggaagaccgtaccgtcacctgcggcgatgtgacgttgccgttcgaagtgaacgactacacccgctggcgtctgatgaacggctacgacgacatcgacctgacgctgcagcacgaagacgacatcatcgcatacgagaagatgcgcgccgaaaagttcccgttcaagccgaagaccctgccggtcaagcgcgagccggaacagccgatcgaatccgcccgtgagggtgaataccctgattggcaaggcccgttggccgatcgcggcatcatctgacgcgatggctggtcggcagtgcagtgcactgccgacagggccttgcccgagtccgaaacgagggcagcaatgagcctgcgcgcagcgcagtccgtaattgcagataggcccgttggctgatcgcgacggtagcccatttcatcattggctgaccgcaaccacatctaacttttcccaagcccggcacccaagccgggctttttgtttaccttccatcacctttccgccaacagcaaattccacaaagcggtggcaaagcgcgcgcaaagcggtggtaaaatcataatacgacggcaaagtggcggcaaatcgagcgtaaaacgcgtggtaggtaaggcggtgatggccaatggacggtagcgagcacgatgatgcctggtggtcccgggaggttcctcggatgcgtgaaggcaaccgtttggaagcgaaacgtgccaagggcggcctgccccacagtttatgggagacgtacagctccttcgccaataccgaaggtgggctgattctgctgggcgtgtccgaacatgaagaccattctttgtatatcaccggagtagatgatgcgcggaacatggcgcaggatttttggaacatggtgcatgatccatcgaaggtcagcgccgttgtgctgagcgacaacgacgtggtgattcgccatacctcgcagggagatgttatttccatcgacattcctcgtgcggcgagggactgtattcccgtgtacgtgggccagaatccgatgacgggctcataccggcgtaatggcgatggcgattatctgtgcgatgaggaaacggttcgtgccatgcttcgggacagtgacctgcttcccctggacagaacgattgttgaaggcatgggtgctgacgcgctcaacgcggatagcgtcgcatcatatcgtcggcagttcaagaacagacggcccggccatccatgggtcggattgtctgatgaggatttcctgcttcgcatcgaagcgttgcggcttgatggttctcaggtgcgtcccacacgagccggattgctgatgttcggtgaggcgtggcgaatcacgtccgaattcccctactatttcctggactatcgcgaggtcatggacgaccaggagcggtggaatgaccgattcacgtcggatgatggcacttggtcgggcaacttgtacgatttttggggcaaggtggtcaatcgtctgcggtcggctgttgcccatccgttccagcttgatgccgatttgcataggattgatgacaatccgatggataaggccgttcgtgaggctgtcaccaacacgctcgttcatgccgattacttcattcgccggggcacggtgatcatccagtattacgacagaatcgtattgtcgaatcccggcagcctgcgtctttcctccgaagaggtgatgcaaggcggcatttcggatacgcggaatcccacgttgatgaaaatgttcaatctgattggcatcggagaaaaggcgggcagtggttttgacgtgatgcgtgaaggctgtctgttcgcgggaaccgccgcgccggaattggaagtgttcgacgatccggggcgtgtgcagcttacgttgtatccgcgcaagatcgccggagattccatgatcgccggagcttctgctgttcccggagtctctgcagatggcgggggccctgttggtgcggagtcgccgacaatgcggaattcggagcatggcactggtacgatccataggattggcgctcgcggggctgaccgtttgaacgacatggtcggcacattcggcaagaacgtggccctacctgctgatttcggcaatgcgatcaggccgcaaagccagttggagaaaatcacctatgcgttgacggtcggcggaccgcaacccacctcgtatctggctgtggtgctggggcttggcctcacccgtacccgggagatattggcctcactggtgaaagacggtgttattgaaccaataggcgtcggacgcggacgcaagtaccgtcttgccgagcataccggctcatgacggcgttccggttctctggacttgacctggatcgagagcccaaactcgtctggggaagtcctagccaaggaggtttccaaggtgagacggggcgtgcaggcggggcgtgtgtcgcgttacagtggacatgacatttcgtgtgttcgcatcgcatatccaaaacatgacatgagaacaatttcggggagcagtatgagccagggtttcgcgccgttttacgacgtcaatcgcacgtatgaagacaactatctgcaggggccgttcggcgcgttcgccgaagtgatgaagggcgattccgctgccggcgcctccgcgcagtctgcacagaccacccagtcgcagtcgtccgaccaggccgaggaattcctcggcttccgcgtgaacctgccgtttggcattcccgcggggccgctgctcaacgaacgattcaccaccgccgccttccgcatgggtttcgatttggcggtgtacaagacggtccgctcccgcgcgtggggttgcaacgccttcccgaacgtgctcgccgtgcatccgaagaacgcagacgggtcgctggttcccggcagcgccgaactggatgaaggcgtgcttgccgacacccgatatgagcttccgatttcgatctccaacagtttcggcgtgccgtcgcgtgaccccgacgaatggcagccggacatgaagaaggcgatcgccgccgccggcgacgggcagctgctcgtgcccagcttccaaggctcccgcgtggacggcatggaccgcaaggcgtacatcgccgaccatgtcaccaccgcgcatctggttacggaaaccggagccggactgatggaaatgaacaccagctgccccaacgaaggtcacaatcgcctgctgtgccacgacccgcatctggtgggagagatcacggaagccgtgaaaaacgaaatcggcgatcgcccgctcatcgtgaaactcgcctacattcccaacgacaccgacctggaaaccatggtcagggaaaccgtcggacatggcaccgtgcaaggcttctccaccatcaacacgatttccgcgcgcctggtggacgtgaacggcaaccaggcgctgccgggagtcggacgtgaccgttccggcgtgtgcggcaacgccattcgtggcgccggtctcgacatggtcggcaggctcgccgccatccgtgaaaaactcggcttcgacttcgccatcgtgggcgtgggcggcgtgatccgtcctgacgactacaaggcgtaccgtgaggctggcgcgaacgccgtgatgagcgccaccggagccatgtgggatgcgaatctcgcgcgcgaaattaaggagacactgcgctgaattccgtttttcgcgaacatgctacatgccttatggcaaactaagcagcagtgtttttttgagcttgatccaaaagggaatcgaaagaggttgagcgtgtctgacaataagaacgacattctgcacgtcgaaggcggcaagccgttgaacggcaccatcaaggtgcgtggcgcgaagaacttcgtaagcaaggccatggtcgccgcattgctggccccgggcacatccgtgctgaagaacgttccggaaatccgcgacgtgcacgtggtgtccgacctgctgcgcctgcacggcgtggacgtgaccgtggacggcgcgaacggcgtggtgacgatcgacgccaccaacgtgcaactcgccgacgtggccgacgtggacacgctgtccggctcgtcccgcattccgattctgttctccggcccgctgctgcaccgtctgggcgaggcgttcattccggcgctcggcggctgcaacatcggcggtcgtccgattgacttccatctggaaaccctgcgcaagctcggcgcgaacgtcgacaaggaacacaaggacggcattcacatcaccgctccgaacggtctgcatggcgcgaagatccacctgccgtacccgtccgtgggcgccaccgagcagacactgctcgccgccgtgctcgccgaaggcaagaccgagctttccggcgccgccatcgaacctgagatcatggatctggtgagcgtgctgcagaagatgggcgccatcatctccgtggacgtggaccgcacgttccgcatcgaaggcgtcaaggagctcaagggctacacgcacacgtctctgaccgaccgcatcgaggccgcctcctgggcgtccgccgcgctcgccacccatggcgacatcttcgtcaagggcgccacccagccggaaatgatgaccttcctgaacgtgttccgcaagatcggcggcgaattcgacatcaccgacaagggcatccgattctggcatccgggcggagatctgaagccggtggccatcgaaaccgacgtgcacccgggcttcatgaccgactggcagcagccgctcgtcgtggcgctgacccaggccaacggcctttccatcgtgcatgagaccgtgtatgagaaccgtttcggcttcaccaagccgctggtgcagatgggcgccacgattcagctgtaccgcgaatgcctcggctccctgccatgccgcttccaacagcgcaattacaagcattccgcggtcatcttcggaccgaccccgctgaccggccgtgacatcgacgtgccggatctgcgcggcggcttcagccacctgatcgcggcgctcgccgccaaggggccgtccaatgtgcagggcatttccctgatcgaccgtggttacgccgacttccgtggcaaattggaggctctcggcgcagatttcgactgattcgctgcgattggttcgatgaatcggctgcggctgatttattgcgattggccaatcgtgattgatgattcgcaattgaacagttgcgattgacagtcgcgtcgaacgcccatgttgctttcaccggtactcgccttgcgcgggtgccggttttgttttatccgcgattgccaccgccgcaatcgcaaacatgctttccgtgccttccgcatcttccgcacattcccttttctgccttatcgcccgtcttttctgcatcatttgacggccaaatgatgcagaaaacgatggcatgaggcagtaaaaagcaagataacgcggaaaacatcgatgacgaacgtatcggcggccggtggcacaatggaagccatggcatccaaaggaaaaccgtcgccgcgctccgcagtgaagccgctgagcgacgagcaagtcgcaaaactcgcgcagaagcatcatcttgtagacccgacccacgatttcccgaccggtccgcgcaaagccaacaccgcggaaatcgaagcgcagaaccccaaagccacgcatcgcctgctgaccggctgcgacgtggtgctgcgcaatcacagcaaagtgaaggcctggggcttggaacacgtgccggaaaccggcccgttcatcaccgccgccacacacgtgaccatgtacgacgtgttcgtgccgatggtctcgctgttccatcagggccgccgcccgcgctacatggccaaagcggaaatggccaaatggccgctaatcggcaaatggttccagctggtcggcatgcagccggtgcaacgacgttccggcaaagccaaagccatcgaggaaacatccatcgaaatcctcacttccggccgcccgctgaccgtatggccggaaggcaccgtgacgcgcgacccgcaaaaatggccgatgagcatgaaaaacggcgtgggcgtgatcgccctcgaatcctcacgccgactcggctaccaggtgccgctgtactgtgccgtgacctggggcgcggccagcatcaaccactggtggccgtggccgcgcaagaacgtggtgatgtgctacgacgaagcgctcgactacgcggacctgcttgacggctgcgattcctggggagacgaagtgccgacggaccgcgccgacgaactgacccgccgcatccgcgtgcgcatgaccgaaatcatggccgaaatccgcggcgaacaggcacctgacggctactgggactaccgcaccatgagtcgcgtgaaagactgattttcccccacacacccgttccggcggcgaacaaaatacgcgtgcgaccggaacacgcggccggtgtgcgtagccggcggtagcataagacaacgtcgattgaaagcggcggccgatgtggcatacgctcggccgcaaaaagcaatccaaataatccaaggagcaaaattcatggcgaatgtgacggtactgggcgctggcgcttggggaacggccttcggtcaagtgcttgccgacgcgggcaacaacgtgaccatgtgggccatcgaaccggaaatcgtggaaggtattcgtgaccatcaccacaacggtgtgcgcctgcccagcgtggaaacgctgcccagcaacatgaccgccaccggagaccgcgccgaagccgtggccaacgccgacatcgtcatcgtggccatcgccgcgcagttcgcacgcgtggcactgaccgaattcaagggactcatccccgagaccgcgctcgtggcctccctgatgaaaggcatcgaacgcaccaccggcaagcgcatggacgaagtcgtcatggaaacgctcgacctgccggcggaacgcttcgccgccatttccggaccgaacctgagcaagcagatcgccgaccgcgagccggccgcgaccgtggtcgcctgcgcggacatcgacaacgcgcgtaccatcgccaccgcctgcaccaccgactacttccgtgcgttcgtgacgcgcgacgtgatcggcttggaaatgtgcggatcgctgaagaatgtggtggcgctcgccgtgggcatggcccgtggcgcaggctacggcgagaacaccgcggccatgatcgaaacccgtggccttgccgaactgaccgcgctgggcgaggcggccggagccgatccgaagaccttcgccggacttgccggcgtgggcgacctcatcgccacctgcggttccccgctgagccgcaactacacgttcggttccaaccttggcaagggcctgagcgtggaagaggccaccaaggtgagcaacggcgtggccgaaggcgtgccgaccaccgacgcggtggtggcgttgggcaagcagtacggtgtgccgaccccgctcgccacggccatgagccacgtgctggacgacggcatctcctgcgcgcagatgctgtccgaactgttcggcgaaggcatcaccgaggagtagcagccggcttgtatgctggatgcttggcaaaaatcctgaaaagtcataaaagttaaggaataaaggctatagatatggcaaaaaagcgcattgtggtgatgtacggcggcaaggccgacgagcattcgatctcctgcatctctgctgcgagtgcgctgcgcgcgctggacacggacaaattcgaagccattccggtgggcatcaccaaggacggcaagtggatcgtcaacggtgagaatccgctcggatggagcctggacgaaggcctgccgaccgtggagaaaaccccaggcgccaaggacgtggtgcttgaagtggctctcggacaggacggcttcttcgcccgcgaggatgacggtacgctgaccccgttcggccatgtggacgcggtgttccccgtgctgcacgggccgtacggcgaggacggcaccatccagggtctgttcgaaatgatgggcgtgccgtacgtggggtgcggcgtgctcgcctccgcggcctgcatggacaagcattacacgaaggtgctgcttgcggccgccggcattcccgtcgcgcccggcatcacgctcgacgcgcgttccttcgacaaggcttccgaattcaagaccgacgccaatgcgatcatggcgcaggttagcgaagccggcttgcagtatccgctgttcgtcaagccgtcccgcgccggctccagcttcggcgtgaccaaggtggagcatgagggcgatgcggccgaactcgcggccgccgtgtacgaggcgtcccgccacgattggcgcatcctcgtggaacagggcatcgacgcgcgcgaaatcgaatgcgcggtattgtgcccgaaggccggcgaagcgccgcaggccagctggccgggcgaaatcgtgctcgacaagcgcgccgaaggcgacgaccagttctacgacttcgacagcaagtacatggacgccgccgcaagccacgtggaagtgcccgccaacctgccggaagagacgctgaacctcgtgcgcgaaaccgccaagaaggcgttcgtcgccgtggacggtgccggtctgagccgcgtggacaccttcgtgaccaaggacggcaaggtgatggtcaacgaaatcaacaccatgccgggcttcacgtccatctccatgtaccccaaggcatgggaggccaccggcgtgcgctacaccgacctgatcaccatgctcatcgaaggcgtgctgcgctgatcgacgcccacctacggtgagatctcaagctgatattcagcgaactggtagtacagtgctgaatatcagcttttttgttttccggagtttcgtaaggtgactatgacgtttccgcagcagcctcaatatccgcagcaaccgcaagggcaaccacaggggccggctccgcaatatcagccgaatggtccgcaatcgcagtatccgatgcagcccatgcctcaatatccgcagccgccgatcgccaatcgcaatccattcttcgaatggttgaagcagacgcgacgcgacttctcgcgtatcggcgcgagcctgtgtctgatggtggtcatctggtacgcgctcgccacggtgctggaaggcgcgctgtacgcggccgtgggcggcaagggcgaaacgccgaattgggttacgtatgtgggttcgggggtgccgctgtacctgatcgccatgccgattgcggtgatgctcatgggcaaatcgactgtcattgaaacccgtaaattcgacatgaaaccgggattgttcttcaaactactgcttatgtgcctgccgatgatgtgggccggcagtgtgttcggcagcatgctgtcgatggtgctttccaacggcgaggcgacggaccgcgtggccgacctcgccatgcagacgaacatctggaacgttgtttttctggtaatcgtaggaccgattttcgaggaatggctgttccgtaagcagctgatcgaccacacccgcaaatacggcgagaaaacggcgattctgctgtccggactggcgtttggtctgttccatatgaacctgttccagttcttctacgcgttcctactggggctcatgttcggctacgtctacacgcgcaccagcaagctgcgctattcgacggcgatgcacatgatcatcaacttcaacggcggcgtgctcgcgccatgggtgttgacacgcgtcgatctggaccagctggagaaggtgtccgaggccgcggaaaacggcaatgcggcggcgatggaacagtgggcatcgcagaatgtcgaaggattggcgatcatgcttgtctatttcgtgttgtacggcgctgtgatccttgctggatttgtgctacttatccgcaatttcaaaaaatttgaattctataccgcgccggaggagctgcctcgcggcacccgtgccaaaaccgtgtgcggcaacgttggcatgattatgttcatcatggtcacttgcatgctgacggcggtcaatctgcttatgtagacgactgcttgccggacaacgacggcgacgcaggcgacgtgaacgatgcggacatctgcatggagatgatgaaggccggtcaaggatacgttcctctgaccggccttcaatcgtttaatgccgttttctatgctgtcttattccgcgctgccgctgaccgcgcgatgttcaagatagtcggcatgcgcgatcgcctgcgccaccgcatccgccatggtggatagaatcaggtcgtttttcgcgaacgcgtaaatcgtgccatcaatgccgtacggggtaaatccgttgagcttcaccaccggcttgtacagcggattggcaaggctttctgtggcctgttgcacggtttcgatgatgtcggccttcatatgttccacgtcgacgccggctttggcggtgaacggtactgacaccaagcattcgttcgatggatcgagcttttccagtgatgcagtgttgaggatggagttcgggatgaccatttcgttgccgttacgttcgcggacgatggtctgacgccagttgatgtctttgacggtgccggtgatacctgcgactttgacgtagtcgcccggttgaatgacgcggccgagcataaggccgaagcctccgatcacattggcgattgtgtctttcagaccaagcgacaccgcaagacctccgatgccgagtgcggtgaacagggtggtcgggttgactccaaacaccggttgcagcagcgtgccgatggcgaatgcccataccaccacacgcaggatgttgacgaagatggaggcattcggcacctgcgatttgtcaaggatgcggcgcactactttggtgagtgctttgtcgatgagcgctgcgacgacaagcactacggcgagcagaatgagcttgccgtagtttcgggcaagccattgtgtgaaaaattcaactggatccatggctgcctagtctacacatgggatattgcccgaaacttgtgattgtctgattgccgcgtccgtggattgtgccgcataatggaatccgaaatcgctatggttgatcaaagggttgcgcgatgggcaatgtgttggattatgtgcgccgtgaattccgtgggttcgccgagttgccgttcggcgacgtcgattctctggtgctgtccgaattgtcctacatgcgattgacggatctggtgcccacgttcgatgaggcgaagtcggtggcgacggtgccgattcgtgaattgctgcgcgccgaaagctatgacgagatgttcgtttcgaattcctccgatatgaacgattaccggctcgcgttgctgcacgccgtctgcgaatcgccgcgattccgcgcgttacgcgttggcgaatacgcggaacgattgagcgagcgcgaccagcagcaattcgccgcgatgacgttcgacgtgggctgcggttcacccgacttgctgtatatcgccttccgaggcaccgacggcacgcttgtcggatggaaggaggatttcaatatggcagtgcgctgtccggtaccgtcacaggaatccgcgtatcggtatgtggattcgattctggacaggtcggaaggtttcctgtcatcggaaggatcgcctgcgattatgcttggcggccattcgaaaggtggcaacatggccgtatatgcggccatgcaggtggctcatgacgatattgaggccgccggcgaacgtgcgcggcggcttgggctgctgccagccttgggcgggccggtgccgggacgcaacgtgcggatcgcccgtatcttctcccatgatgggccgggcctgccggaatcgatggtgcgcggtcaggcgtatcggacggtggaatcgcgtatccgcaaaaccgtgcccgaatcgtctgtcgtgggcatgctgctgcaatcgaatgcgagagtaatcgttgtcaaggcggacgccgtcggcattatgcaacatatgggcaatagctggcaagtggcggaaaacggcgatttcgagcgcgagaacgagttgacgatgactgcgcagctcatcaagaggacgctcgacgattggctcgacactgtggggcagaagcagcgtgagcgggccattgaccagatctacgagatcttcgcggctgcgggctatggcaatatcgctgatctgatggcgaattggacggattcgctgccgaagatcgtggcggccgcgcgcggtaccgaccgggagacgcgggagcttatcaaagccgtggtcaaggcgattccggcgagcgcggcgagggcggtgcgtgaaggctgaccagcccgaaggccttccgaagcgtcgcgattcgcaaatgttcgtagaaaatgtgaaatcgtggcacgtggaaaaggcggatggacgcgtttcggagtcgttggtttgaggattatcccgtttgctggcgtaggatagcggaaaatgggcgcataatggaatgcgggaatggcaccggctgtgaaagaggtgtgcgatgggtagcatcatcgactatgcgcgcacggaaacgcgcggtttcggcattcaccccttccgtgaggccgatgcgctcgtgctcgcgcagctttcgtacgatgatgtgcctgactgcatgccgcgattggagggggtcgaatcgcaatatggcacgttgcgtaatcgtgtgaaacactttgacttccgccatccgttccgttccattcgtatgttgcgacagcctccgttcgatggtatttcgatcgcgcgcgccgacgacgagcttcaccacgaccgtgcggtgcccgaccatgacgtcgagaacgtgggattggtcgatccgcaggtgacgcacgacttctaccatgccgtcgcctcgaatccgcggttctccgacattgaaatgggggcgtttctcgagcagttcgacggcgaagagcagacgcagttcgccgcggtgacctaccgtctgccgtccggcacgctggttgtggcgttccgtggtacggacgattcgctggtcggctggaaggaagacttcaacatggccttccaatacccggtaccggcgcaagcgaccgccgccgactatctggccagagtcgccgcgctgtggaaggacgtgccaatcgtgctcaccggccactccaagggcggcaatctggccgtgtacgcggcaatgaacgcatcggacgaggtgaaggaccgcgtcgaacgcatctactcgctggacgggccgggattccccgaatctgtggtgaacagcttcgaatatgcaagcgtgagcgaccgcatcgtcaaaatcgttccggactcatcggtggtgggcatggtgctggaaacccccgaacggtgcatggtggtcaaatccgacgtggaaggcatcatgcagcatttcgcgttctcctggcagatgcacggcggcgaattcgacaaagtcgaggacgtggccaacagttcggtgactttcaacaaagcgttgaacgggtggctgtccaacctgtccaaggaacagcgcgaacgtgctgtggacgcgctgttcgcggtgctggaggcgtccggagccggcagcatctccgccatgatggcggccggaccgaaggtcatccccgaaatgctcggcacatatgttggattgagcgttgaagatcgacgcaacctgaaccaggcgctgggcatcatgctgcaggccgcgctcgcccgtaatccgaaggtgcggcgcaggtagacgcagattgcgcgggtggcgtatgccgatgctggccgggggtggctggtcggcgaacggaggcttggtttgcgtctgacgggccggcaatcgccataaatacgacacgttgtgtagtttgttctagacagactgtatagtaaagcgcgttgcgtattggaaatgactttgcgaacgactgttaaaatagggggagccatgccacgtccacgccgggattcggagattctgccagccaaagaacggctcgaaaacgcattctgggaactgctttccgaacgtgagtatcgtaaaatcaccgtcaccgacatcgtgcgcacggcggacgtaaatcgcaattccttctactaccatttcacgggactgccggaacttgccgattccgccattctgcacgccgtggaaaacacaccgcttcccagcgcgcccaacgcgaatttcaatcccgacaacgaatggcgcaagcatgtcaccgcgctgctacgcgagcccgaacagcgtcggcgtcttgaccggctcgcgctgctcgccggaccgcacagctcgccggaactcgtagaatccctgcaggacttcggcaggctcacgttgatctccgtgctggggcttgacgccgaccacctcgaccttaaaaccgatctcatgctcgacttcaccgtagggggtatgctggcggtattgcgccgttggccgaaactccacgagcagctgccgatggacgccgtgttcaacgaggacttggcggtgttggccacgggcatgttcatgtccatgtccaaaaccgacatgctgggctattggaagcgcatcttcagcagtggtttcgtgcccgggcaggcgtctcacgacgaccaagccccgcaatccgccgcacagtgagccatacgccacactgcgtgacttttcggtggtagaaacgtctgtagcggcgctctttcagggtgcgtcagacgtatgcaacagcacgacagggaggttgttccatgatcaacgaagcctacaaggccatgctcggcggaaaatccgtaatccgcgagctgagcgaatacgcgaccgcgcgtggcgccgaaatcggctacgagaacgtgttcgactattcgctgggcaacccgagcgtgccgtgcccgcaggactataccgacgccgtgatcgacatgtataaaacggccgaaccggtggcgttgcacggctattctccgtccttgggcattccgtcggtgcgcaaggcgatcgccgaaagcctcaaccgccgcttcgacatggactacaccgccgactacatcttcccgaccacgggtgcggccggcgcgttggcgcatgcgctgcgcgtggtgaccaagccgggcgacgaagtgatcaccttcgccccgtacttcccggaataccagccgtatgtgaacggcaccggcgcgcacctgaccgtcgttccggccgacaccgagaacttccagatcaacttcgacgcgttcgagaaggcgctcaaccccggaaccgcggccgtgctcatcaacaccccgaacaatccgtccggcgcggtctattccgctgaaacgctgacccgcctggccgaggtgctcaacgccaagcagactgaatacggccacgacatcttcctgatcgccgacgagccgtaccgcgagatcgtgttcgacggcggcgagcagccgtatccgagcaaattctacgacaacacgctttcgtgctactcgtactccaagtcgctgtcactgccgggcgagcgcatcggctatgtggcggtgaatccgcgtgccaccgacgccaagctcatcgtgccgatgtgcggccagatcagccgtggcaccggccacaactgcccgtcctccaccgcgcagctggccgtggccaaggtggtggacgagacaagcgacctgtccgtctacgaaaccaacatgaacctgctgtatgacgcgctgacccgtctgggcttcgacgtggtgcgccccggcggcacgttctacatcttcccgaaggcgcttgaggaggatgcgaacgcgttctgcatgaaggccaaggattacgacctgattctcgtgccgtccgacagcttcggcgtgcccggctacttccgcatggcctactgcatcgacacggagaaggtggagcgttccatcgcggcgcttgagaaattcgtgcacgaggtgtacggccgctgagccgctcgcgtatttcgcctatattccgcttatagatggcggattcgctctcgtgcctgatgccatctcgcttatggatggcggatgatgcgggggaaaagccggttggagggtattgatattgccccctaaccggctttttgctgtaggaccccgccatctataagcgagataccgtggggcgatttggaaaatccgccatctataagcgagatagtgcaggattgtggggcggcaagccgactgtctgacgggaccgtgtgcgttgatacaggttcgcccggagctggtggggtccagctccgggcgaagtctgttatggggaaggaaggaatctgaatcggttaatgcgtgaatccgtcagtgggtggcgatctcgtcgatcttggtgacgtggccgccgaactgggcgcgcatggtggacacgacgcgcaggatgtcgtcggcgccgccgcgcgaggtctgacgtgcgtacagtgcggccgcggtggccggggtcggcacgccgagttcgagagccgcctcgatcatccacttcgcctcgccggactcgttggcgaccggcggcatggacttgagcgtcgggtcggacttgaaggcgatggccagcaggtcgagcagccaggactgcaccacggaaccgtccctccaggagctcatcacggccgccggatcctcaacgagatcggacttcaccatggtggcgaagccttcgccgaaggcctgcatcatgccgtattcgatgccgttgtgcaccatcttggcgaagtggccgccgcccaccgggccggccagcaccagtccggaatcgccttccggcttaagtgcctcgaaaatcgggcgcgcgctctcgaagtccccctggctgccgccaaccataagcgcgtagccgcggtcgatgccccacacgccgccggagacgccgcaatccatgaaatggatgcccttcggctccagttcggccgcgtggcgtgcgtcgtcggtgtaacgggagttgccgccgtcgatgatcatatcgcccggctgaagaagctcgacaagctcgttgatggtgctgtcggtcgcttcaccggccggcaccatgacccacaccagacgcggggccttcagcgcggccaccagttccttcaggcttgccacggtgcggtccgactcgggggagtggtcgtagccgaccacctcatgccctgccgccgcgatgcgcttcgccatgttgccgcccatacgtcccaggccgatcattcccaactgcatgatgtgcttctttctctaaaaatggttgaaaagtttttgcgattttgaataaggattgatgccgcccgttggcttcccgcgccttccgcaacgcagaaaagaaggttgcggcaagctttgcgggcggcaagttttggttatgttttgggttatgtgagtgtggttgcgattgctgcgttcagtgcgtcaaagcaccagcgagagcagcatcacgcagcccagaccgaccaccgacagaatggtttccatcagcgaccaggtcttcagcgtctggcccacgctcatgccgaagtattccttgaccagccagaagccggcgtcgttgaggtgggagaagaacacggagcctgcgccgatggccagcaccagcagtgccagatgggtcgggctcatgccggcggcgagcggcaccatgatgccggaggcggtgacggtcgccacggttgccgaaccggtggcgagacggatgagcacggccaccagccagcctgcgatcagcgggttcatggcggattcggtgatggagttggcgatcacgtcgccgatgccggagtcgaccagcgtctgcttgaagccgccgcctgcggcgacgatcaggatgatgccggccacggagccgaaggactgtccgaccatgccgttgacggcgtcacgggagaacttctgcatgtagccaagggcgaccatggcgaagacggtggtgatgagcagtgccacgagcggggtgccgaggaacgcgatcacacggccccaggcggtggtgttctgaccggtcagatccacgatggacgcggcgagcatcagcacgaccggcagcaggatcacggacagggcggtgccgaaggacgggcggtttttcgcggacttcggagcttcggcctcagcctcgttctccggagctgcgatcggaacccacttggcggcgagcctgccgaacagcgggccggagatgatgacggtcgggatggccacgatcaggccgagggccagggtgatgccgaggttcgcgttcagcgcgccgatggcggtcagcggaccggggtgcggcggcacgaaggcgtgcagcgtggacaggccggcgagggccgggatgccgagcagcaccacaggggacttggaacgacgagcggcgaacagcaccaccgggatgaggatgaccacgccgacctcgaagaacatcgggatgcccacgatgaacgcgatcagtgccatggcccacggcagacgctgcaacggtgtcttggccatgatggtgtcgacgatggtgtccgcaccgcccgacttgaacaggatggtgccgatgatcgagccgaacgcgataagcaggcccacgttggaaatcgtgccgccgacgccggaagtgaagctatcgaacgccttgtcgaacggcacgcccgcgcacacggccatgacgaatgagccggcgagcagggacaggaacggatgcaccttgcatgccgcgatgagaagaacgatgacggcgatgccgatgatcgccgctgcgatgagattcatgaatcctccttgactcgttgaatttctctttcgatttttagttatgtgcgattattttgcgctgtgttgcggcttgcgccgttcactcggcttgctgcgattgcgcggccaccttcgccgcgtactcgttcactgcggcgacggcacgttcgaccatttcctcgacgctgccttcgatggagacttccacgccgttctcgtctggctggagcggctcaagaatggcgaactggctcggcagcagtgccggcggcatgaagtggcccttgcgctcgttgagacgctgctggatgagttcctgcgagccggtcagatgcacgaagaaggtgggaacgttctgggcgagcacctcacggtagctgcgcttcagggcggagctggagaccacggtgttctcgtccagcgcctcgcgagccaccatccaggtgttgatgaccttgagccacggccaacggtcctcgtctgtcagcggaatgcctgcgctcatcttgtcgatgttggcctgcggatggaagtcgtcgccctccgcgtacacgtatccgagacgttcgtgaatggcttctgccacggtggatttgccgcatcctgcaacacccatcaccactacgtgaatgctcatgttgtcctccttgaactctgctgtattgccagtgccacttcgcatcggcgatgacatcaatatagctatgaaaggtagtactagtcaagttaaaagtactacgaataaaaataatcatgcgacttgctatgctgtaggtagtacaaatcggcggcaaatcgcgcgaatcgtgcgggggtaattattcggacgtcacgcgaacggcaatcgtatacggcgtgtcgcaaaaacctgaaaaaagatttgcacgcacaacgagaggaattgtggatggcaggaaacgaaaacggcggcgaactgctgcaggatgcagtgtgccgcacgctggccatcgaaatgctggacggcaaatggccggccggtgaaagcttgacgttggaagacgtgcagaaccgtttcggcatctcccgtaccgtggcgcgcgaagtcgccaaaacgttggaatccatgggtgcggtgacggtgcgccgacgcgtcggattggtggcgcggccgttctccgactggcaggcgctcaaccatcaggtcatcgaatggcgactccactccacgcagcgcgagcggcagctgtcgtcattgaccgaattgcgattgtcggtcgaaccggctgcggcggcctcggcggcacgcctcgcctccatcgacgtcaaggcgaaattccccgtctacgcggcgcagatgcgccaaatcgccgaatcaaacgaagagggggctgtcggcctgaccaaattccacgatctggacgtggaattccatactttgatactgcgcgaaagcggcaacgaactgttcgccgcacttgccgacaccatcgccaccgtgctgcgcggccgtgtggaactcggcaaatacccgatgaagccgaagccggccgcgctcgacgcgcacgatgcggtcgccgacgcgatagcgaagggcgatccggaacgtgcgcgcaaggccatgttcgacatcgtcgacgaagtggcccgcgcgctcaacttcttctaaaaccagtcgctaccggcgtcgaaccgccggattcgcggctcaaatcacaggttcgcgtcgaccgtctgacgcaggtcgtcaacgatttcgcccaaagtctcgctgaacaccgcttgatcggcgtacatcgaatcgaacagcgtatcgatgtttttgcggaaatccttcggcagaatggcgcagtcgcgttcggcgagcttgtcgagacgcttctcgccggggtgtgtgcggcggttcagcgcgaacagcacatcgaaatacgattccatgaacgcggccatgcgatggttgaccgcgattttgtcgcctcggctcgcggccttgcggatctgtgcgtcgtacgacggcaggttgccggtaagcaggcgcatgttgcgattgatgatgttgcggcgcagttcctcggggaacggcacgtcgaaccgctgtcgggtcgcggcgtactggccgtcgcggtcgaacagcaccttgctggtgagcatgttgtgccacatgcacgtcgtatagccgttgctggcctggaaccgttccaccacgtcggcgacattggctgcgaactggtccagatcgcggtacagcacgtcgatattggtgccgtcgttcagcgtgcagtcgtcttcggtctcccaaaaatcgttgtcgatttccatatggctgcaatagttgcgcagcagcctgcggcggcgttcggcagacacgggtgcggtgacgtacacgtagacgtcgtaatcggatttttcatcgttatcgccggtggcgcgtgacccacccaacgtgatggcctcgacttccggccatgcggacactgcttcgactagttcatttgccaatgacatcgtttacctctctctgcgtcattgctggagcggcgctacgttgcgccacggtgtgcaaacgatgccagtataacataccaaatggtaactgtcgaagttgtgccggcctacgcggttcctcataggccggtacagcgcattccgccgaacgacgattgtcaggcggaatgctatcgagcgattgctgtcgagcggaacgctgtcggacggcagctgtcagtcgacggttgcggcttccgtcgaacccttggtcggatccttctgcagaagcaggaagacgagcgcgacggccagcagaatggctatcgacagcacgccgatcgacgcgttgccagtcagcgacgtcgtggtggcgacgaggaacgtgccgataatcgacgccgtcttgccgaaaatatcgtagaagccgtagtactcgttggcatggtccttcggaatgatcttgccgtaatacgagcgggacagcgcctggatgccaccctggaacatgccgaccagaatcgccagaatccagaattcaagtgcggcgcgcaggaagaacgcggcgaagaagacgatgcacatgtacgccaccacggccgcggtgatcatggttttcgagccgaaccggcctgccagcttgccgtagatgatggagcaggggaacgccacgaactgcgtgacgagcagcgccacgaccagctgcgtggagtcgatgcccagctgcgtgccatacgacgtgctcatggaaatgacggtgttgacggcgtcgatgtagaagaagaacgcgatcatgaacatccacagcggcttgttcttgcggatggcgcggaacgtggagccgagctcggcgaacgtgccgcggatggcctcgcctgcctgccccgcggtggcgcggtaatgcacctgcttatagctggtgagcagcggaatggtgaacgccacccaccacagcgcggtgatgacgaacgaggcgcgcgtgcaggctgtggtcgaccagccgaacagcgcggggcctccgaaaatcagcgcgatgcagacgatgaacggcacggtcgaaccgatatagccccatgcgtagccgtgtgaggaaatgcggtccatccgttcgttcgaagtcgtgtccaccagcatggagtcgtagaacgtaagcgaaccattaaggccgatggtggccagcacgtacacgatgatgaacgcgagccaaccaagcggcatcgccatcgcgcagcacatgaccacgcccgtcaggaagaagccggtgaagaagcggatcttcatgccctgcacgtcggcgatggagccgagcagcggcataagcacggcgatgacgagcgatgcgatggtctgcgcgtagccccacgtcgacacgatgttcgtctcgccggccgccttgagcagcgaattcgcgtagatcggcacgacggcggtggacagcagcacgaacgcggaattgccgacgtcgtagacgatccacttcttctcgcgtggcgtcatcatatgcttggattgctgcggctgctgggcctgcgcgttctgctgggacggctgggtctgcggctcggctgtgtcggtcaatgttgactcttttcggctaaatgtcaatcttatggctcatcttattccattacttcatcgtacgggcgtggcgggtggtaacagaccattcgacatgaacagcgcatgaacaagcatgttctgcccgtacgggccgcatacgcgtgctgtcgagacatggcaaaaacggcggaatatggggaatgcaagccgattttcgtccacaagtttgcgattggccggggctggttgtatagttgagaagttgtgtgttctgccatgcacttcgttgtgtggtgtcgaacgcgcagacttgcaagtcaatagtaattatagggagtccattatggcagctcgttgcgcagtgtgcggcaagggaccgcagaccggtttcaccgtttcgcactcacatattcgcaataagcgcaccttccgcccgaacctgcagccggttcgcaccaccatcgacggcgagaacgttcgcgttcgcgtttgcgtgaagtgcatcaaggctggcaaggtccagcgcgttgaagcgtgaatcgcgaaataacagcttgaaaccccggtaagccgaatggccgccggggttttgctttatctggccgtccacaagccgtgttgcggcgaatggcgccgccacgaataatggggaattcagcccgccgcacaatcatccggtcgtgacacaatggagtgttatgagcaccacatggcaaaccccgatttcctcgttcgaaacgaaccgccgcagagtcggcgcgctgaaatcgctgggcgtggtgtccgtgggcgacgcgctgacctactatccgttccgcgtcaccgacccggttccggcacgcgccctgcgcgaagcgaaaataggggagaacatggccttcgccgcgcacgtgcgtggcgtgcgcgtctttccgatggcccgtcgcggattccggctgatcgccgacgttgatgacggcgatttcgcacgcagccggcacatggacgcttccatggcgtctctcgtgttcttctcctatcgcaagtcgtacgtcgattggatccaacgcaaactgcacgaaggcgcgttgctggtggtcgcgggcgagccaagcgtatacaacgaccgtctgcaattcacccatcccgacatactgacggtcgatccagccggcgagcaattgcgcagccgctcatctgaggaagccgccgaatgggatgatggcttcggcacggaacaaccggcggtcgtcccgcaatcgccgaccatgccgaatctcaaatacgatgcggcttccgtaccggaggcgatgcgccacgtatgccgcccacgtcccgtctaccacgcgaactcgcgcatctccagcggacacatccacgagtcgatcgaaaaatgcatggaccggctgtgcggtgacgaatacgctgcggcacaggcagcccgtgcattgcatggcgccgatgccagcgacgcgcaacatggggaattcgacgcgccgcaagccgaccggcaggcacggacggaagcgcttgccgccgccattcccgacatcatgccggaagcgtttcgtatggaacatgggctgatgcaccgagccgaagcgttcatggcgattcacgatccgcaaaaccgcgacggtttcaacaaggcgttgcgtacactgcgctacgaggaagcgctcatctgccaaaccgcgctggtgcagtctcgtgattcgtcgcgtaaggccacggccacagcctgcgccgacacgcggctgaaagacgatttcgtcgagtcgctgccgttctcgctgacggacgggcaacagcaggtgatcgccgatatttccgacgatatggcacgtgattaccccatgcaacgcctgctgcagggcgaggtcggctccggcaaaaccgtggtcgcggtggcggctatgatgcaggccgtcggctccggcaaacaagcggtgctcgtcgcgccgacgcaagtgttggcggaacaacattacagcagcatccgcggcatggtggatcggatgtgtggtaccggcgaagaggctgacgaaaacgcgaaatcaggggaatcgcagacaaaatcaacgcaccatgcggttgtggatgaaagtggacaagtcacgtcgggaaacgcgccggaaccgcaaaacggtggacaatcggatggcggccaggtggagaaactgctggacggccaatcgaacagcctgccggacattcccgtgctgctgctcaccagcggcatgaaactcgccgcccgccgacgcgtcctcgcgcaagcggcctccggcaaaccatgcatcgtggtggccacgcacgccgcgttctccaaaaccttccaagcgcccaacctcgcgctggcggtcatcgacgaacagcaccgtttcggcgtggaacagcgcgaatcgttgaatgccaaaggctccacggcaccgcatctgctggtcatgacggccacgccgatcccgcgcaccgcggccatgacctggttcggcgacctcgacatctcctggctcaccgaactgcccggcggccgcaagccgatccgcacattcgtcgtgcccgaagcgaacggcccgctgatggcggaaatgttcggtctgattcgcaagcgtatcgacgcgggggaacgtgcctacgtggtctgcccgcgcatcgacgccgacgcgaaggatgccgacgatgcgggcggttcaggcgatgcggaagtcggttccgcattcgacgccacatacgatttgggcgaggatgacgaacagcgcgaacagcggccgccgttgcattccgtcgcggaaatggcggaacgcttgcgatcgctgccgcaattcgccggcatccgtatcgccacgctgaccggtcgcgacgatgacgaaacgaaatcgcagattatggccgatttcgaagcgggcgtgacgccgattctggtggccaccaccgtcatcgaagtgggcgtggacgtggcgcaggccagctgcatggtgattttcgatgccgaccggtacggcctgtcccagttgcaccagctgcgtggacgcgtgggccgtggcggcaccgaatcgggcgcgttccttatttcacgtgcgccggaaggcagcgatgctgccaaacgccttgacgtgattgccggcacgttggacggtgccgaaatcgcgcaggccgaccttgaattccgcggcgcgggcgacgtgctgggcgacgcgcaatccggcggcaaatccggactgaaactgctgcgcgtggtcaaagacgtgaagatcatcgaggaagccagagcggaagccgcgaaactggtggccgaagaccccacgttgcaagggtacgcgcagcttgccggcgcggtgctcgacttcacgcgcggcaacgagacgttcctgaccagcaactaggctcgatggttatgcgcgtaatttcaggacgattcaaaggcatggcattgaccacgccgaaaccgggcaccaggccaaccaccgaccgtaccaaggaagcgatattctcgcacctcgattcgtggggcgtgctggatgacgcacgtgtgctcgacctgttcgccggaaccggcgcgttgggcatcgaagcgctgagccgtggcgcgcgcgaactggtggcggtggaatcggccgcaccggccgccgcgctgatcgcaaagacgttgacggcgttgaagcacaaccgttcctgggagccgggcatgagcgcccgcgtggtcaaggcgcgtgcggaaaagtacgcggcggccgcatcggcggtcgcgccgttcgacgtgatcttcattgacccgccgtacgcgttcgaaaccgaggcgtgcaaccagctgctggccgatttggcgggccgtgagtccggcgaactgactggcgagggcacggtgatcgtgctggaacgctccactcgttccgacgagccgaccgcgcccgaaggctgggatatcaccgaccggcgtgattacggcgaaaccgccgtgtattacatcgaacctgccgaatccgccgagccggcagagccggttgaatccgcggactgacgtccgggctttccaactaaaaacgtcgacggtggacctgcatgccctccgtcggcgtgaacaatcgtgcgtaatcagcgctgccgtgggtgcgcgccggaaacctcccagcccaacgccatcagcgttttgcgatcggccttgtcaagcttggaacaatccaacgcctcgatgagatccggacgcagctcgttggtcttcgccagcgcctcatcgcggcggaaacggtcgaccttcgcgtggtcgccggacagcaggacgtccggaaccttgataccgcgccaatcggccggcttcgtatactggcggtgctccagcagggcgttctctcccgtatacgattcctccacgatcgaggccgcattgcccatgaaaccgggcagcagacgggtgatggcctccaacatgaccgacacggccacctcgccgccgttcagcacataatcgccgatcgaatattcacgcacgtcgacgccctgcgcacggtaatactgcggaatacgcgcgtcgtagccttcgtaacggccgcagctgaacagcagatggttggtgtggctcagctccgtcgcgtcctgctgggtgaacaggggggcggacggattcgggaaaatcagcaccggacggtcggtcgccggaacggtatcggcatttgcggcgatttctgtcgccgattccgccggttcggccgcgtccgcggaagccgtgtcgtctgcgtctgccgtggaatcgcaagtaaccgtggtcggctcaagatgcagcagctcgtcgaggcattcgctccacacttccggcttcatcaccatgcccgcgccgccgccgacgggagtatcatccacggaatggtgcacgtcgtgcgtccagtcgcgcaggttgtgcgcggtgacttcgaccaggcccttctcctgcgccttgccgagcaggctcaggttgagcacttcgaaatattccgggaatacggacacgatatcgatcttcataatgttccacaataccggtacgcctgccaagcgcggcgcgtacgaaaaaggcgccggcataatcgccagcgccttgttggaaaagcagcggatcagagccccggaatgagtccgcccggcgggtcgagggtcagatatccgccctcgaggtcgatgtccggcacgagctcgtccacgaacggcacgagcgcgctgttctcgaccaccacgccatcggcgtccttgacgggattggccagacggatcttgagcagccactgggccacttcaatcacatccaccaccttgcctaccacagtgccgggcgcaagccccagcgtattgccctcggcaaggcgcgcctcaagactgatcaggtccttcgggtaccactcgtccgcttcaagcatctcctccggatcgtccgcttcgccatacagcaccacgccattggcggcttcggacgcatcacggtcgtcgatgccctcgaatttgatgatccaacggtttttgaaggtacgggagctttccaccacgtactcttcctcgccgtccttcgtatacaacacagcaccgggagcgaaccggtattccggttcgtccgtaaagatctgcacggtgacctcgcccttgagcccctgcgcacgcccgatacgacagaccctcagcagctcaagctgttgagggtcgtcggaatgcatatcacgcaccacgctaggatctcacctgcgcacgtccatgatgtcgacgcgcaccttgtggtcggacagtgcctgcaccacggtgcgaatcgcatttgccgtgcgtccgctgcgtccaatgacgcgaccgatatcctcagggttcacgcgcacgcgaatgagttcaccgcgcggattctcatgggacttcaccgagacatcatcgggaaaatcgacgatgttcttgatcagatgttccacagcctgggcgagcatgatcactcggcttccgcagccggctcttcagccggagcttcctcggtggcggcggcttcggcctcagccttggccttggcgtcagcttcggacttggcggccttcagcttctgggcctgggcttcgacagcctcgacgcgagcggcggcatccgggccagcctcaacggtcttcagggtgccttcagcaccgtcaagacccttgaacttctgccagtcaccggtgatcttcagcaggttcagcacctgctcggtcggctgagcgccaacgccgagccagtactgagcgcgctcagagttgatgttgatggtcgaaggctgggtgttcgggttgtaggtaccgatctcttcgatggcgcggccatcacgcttggtacgggaatccatgatcaccacgcggtagaacgcgtagaacttcttacccatgcgcttcagacgaatcttggttgccaaaatggctctccttgtaactaggggtgtgtgtttcgtgttctgtgtggggcacggaatccgaaacccacgtgttcctcacgtcacgcgattggtagagggcctcgcgcgcgcgaataactgagcaattataaccgtggggtatggacgcgttcccgtatgcgttcccgagcgtccgtttctgttgactcggacgcttggcttgcgttttgcgcattctgaatggccgtttctccagaatcggacattggtgaggtgttgtggcggtctcgggcgtccgaatcacccgaatcggacgaactcgctatgctggatatgttcattggcggttttcgtgcgcctgattatggccatttcaaggggatttgcatgagtgttgcgttgtggatcgtactgctggtatgcgtgttgtggatcgctctgagcgaaatgccggccggttgggacggccacttgccgttgccgtatctgattgcgctgacaccgctgttgtggattccaacattggtgattgcgattgccggtgccgtacggcatgacaccgccctcgccatcgtcgcggcgatcgcgtgcatcgcttcgctgctgcgcaaaatcgcgtattggaacaacaatctcacgtccatcaacacggcgcagatggtggccgacaacatcgcaaaaaagcgtgaaacatcccgtggaacacatacgtcgattgctgcggaagccgcgaaacacggccgtttccgcgtgatgacgctcaactgccggtacggtcgtgccaatgcggccgcaatcgtcggcgccgtcaaggaacacgacgtcgccgtgctcgcgctgcaggaattgacggacgatctggtcgcggccttggacgaggccggcctgtccgatttgctgccgtaccgccagttaggggagaacaaagatacggacaacggcggcttcaacggtatttggattcgcatcgagccaagcgacacgtcgccgatcaccgccgtgattcccgccgccgacgtgcctggcgtatgcttcccgattgatgcgatgcgcggcatcactttcgtttccgcccatccgaaatcgccgatgcgcggctgccgcgactggtccgccggcatcatcggcttgggtgagctggccacatcgcagaagcagggcgatatcaccgtcgtattgggcgacctcaactccggtaccgaccatccgagcttccgcaagctgcttgacgccggcttccaggacgccgcgttgaccgaggcgaagggccgccgcgccacgttcccatcgtggctgccgtggccgcgtctcatcctcgaccacatcctgttcaccgccggtctgaccgcatccgacgtgcgctccttcacggtcaacggtaccgatcatcttgctctggccgccacgctgacgttgaaataaaccgaaaataagctggcataacgaaactgccgacgctggaaaacgttccaacgtcggcagtttcgttatatatgccgtattgcgattgccggttgtcgtaatcgccggcaatcgcacatatcgcggcttagtgcagcagacgcttagtgcagcagaccggacagaccgccacccaagttcggcggcagctcgccggaatcgcccagcatatcctgcaatccggcaggaagcgccggattctgcggcttcttggcgaacgcggagccacctgacgaagcgccgtcggaagccttgccggcgagcttgtcgcgcaatgccttctcctcggcctcacgcttcatcggattgccggacttgcccgacttcttcttgttcttcttgcctttgcccttgcctttgccgccgcccatcgcggggcctccgaagccgggcacgccggcgccgaccttgttgctcatgcggcgcatcatcttcgcggcctggtcgaagcgctgcagcagcgcgttgacctgcgaaaccgtcacgccggaaccgtaggcgatgcgggcgcggcgggaaccgtcgatgatcgagggatcgcgacgctcggccggagtcatcgaacggatgatggcctcggtgcggtcgatttccctctcgtcgaactgctcaagttccttacgatgcgcggccatgcccggaatcatgccaagcaggttcttcatcgggccgagtttgcgcacctgctgaagttggtcgaggaaatcgtcaaggccgaaggagccgtcggagatcttgacggcggccttgcgggcctcttcctcgtcgaactgcttctgcgcctgctcgatcagggtgagaatatcgcccatgtcgaggatgcgggacgccatacgatccgggtggaagacctcgaaatccttcaatccctcgccggtggaggcgaacaggatcggcttgccggtcacggatgccacggacagcgcggcgccaccacgggcgtcgccatcgagcttggacagcaccacgccggtgaaatccacgccctcgtcgaacgccttggccgtctgcacggcatcctggccgatcatcgcgtcgatgacgaacagaatctcgttcggctgcacggcatcgcggatgtcgcgagcttgcttcatcagctcctcatccacgccgagacggcctgcggtatcgatgatcaccgtgtcgtaaagcttctgcttggcgagctccacggcgtcacgggccaccttcaccgggtcgccggtggtctggccgggggagacgaccgcttcgccgccatcggactgcacgcccttctccggcgcgtacaccggcacgccggcgcgttcgccgaccacctgcagctgcgtcaccgcgttcggacgctgcagatcggccgccacgagcagcggggtgtggccggaatccttcagccagtagcccagcttgccggcgagcgtcgtcttaccggcgccctgaaggccggcgagcatgatgatcgtcggcggattctttgcgaagttcagcgggcggtccacaccggcgccaagcaccgcggtgagttcctcgttgacgatcttcaccacttgctgcgccgggttgagcgcttcggaaacctcggtgccgagcgcgcgttcgcggatgcggccggtgaaggaacgcaccacgtcgagcgccacatcggcgtcgagcagcgcgcggcggatctcgcggatggtaccgtcgatatcagcctcggaaagcttgcccttgctcttcagatgcttgaacgcattcgagagccggtctgtcaaagaactaaatgctgccataatgtttctcagtctagcgtttcacgcggatagcggatgaaatgggtgcgattgcctacttcagcgaccaagtggagccttgcggaccgtcctcgatggcgatgccggccgcgcccagcgcgtcacggatcgcgtcggcacgtgcgaaatccttggccttgcgggcttcggcacgttccgcaagctgttcggaaaccagcttgtcgagcgcgtcatgctcggcggaatcggctccggcaccagccgcaccacctgcggcaccgtcggaaacccacggctccgccagcggatccaagcccaacgtgtcgagcatcgcacgcacgttcaccagcgcctcgcgaacctcggccttcgccacgtccgaatcggcgcggtcggccagcttcgacagcaacgtgttgccggaacggatcgccgtgaaaatcgcggcggaagcgcccgaaacgttgatgtcgtcgttcatcgcggcaacgaaatcggcgggaagcgcgtcggcggaaatcgccataatctcttctcgtgacggctgttcgccgacggcagcgcccgcgcgctcgatgaagttcgccacgcggtcgtacgcggactgcgcctcggcaagcgtctggtcggaccattccagcatggaacggtactgcacggaaccgagggcgtaacgcaccacccaagcggaatgctcggccagcaccgccggcacggacaggccgttgccgagcgacttcgacatcttctcgcccttcgcggtgacccaggcggaatgcatccagcgcgcggccgaatcgtaaccggcggcgcgcgtctgcgccatctcgttctcgtggtgcgggaatcgcagatcaagaccgccgccgtgaatgtcgaacatgtccttcaggtaacggtggctcatcgcggagcattcgatatgccagcccggacggcccgtgccaaacggggtgttccaacgcgcatcgagcggatcggaatccttcggagccttccacagcgcgaaatcgcgcggatcgtgcttgtcgggggacatatcggccggatcgaccgggttgtacttgtcgttgcccgcgttgtccacggacggccccatcgcgtcggtcacttcggaagccgcgtcggaaaccgcggtctgcttctggtgcgtcagctcgccgtaatgcggccagctcgccacgtcgaagtagacgttgccggtcgggttgccgtccgcgtcacgcaccacataagcgtggccgttgtcgatgatcttcttgatgaggtcaatcatgtcgatcatgtggccggtggcgcgcggctcgtacgtcggcggctccacgccaagcttgctgtacgcctcggtgaactcgcgttcgtagatatacgcgcgctcccaccactgctggcccgcggcggcggccttgtcgaggatcttgtcgtcgatgtcggtgacattgcgcacgaacgtcacattgtagcccagtcgctcgaaccagcggcgcaccacgtcgaacgcgacggcggcgcggatgtggccgatatgcggtgagctttgcacggtggcgccacacacgtagataccgacctgacctggtttgatcggcgtgaaggacgacacggcgtgcgatgcggtgtcgtacagcttcagtcccgcggtggccttcgccaccgcaagagcgccggaagtgttggtattctgcggttcctgcgtgtttgtcatagtcatgagaatattgccagaatcggacatggccggcgttgcgtccgtaagttgttggcaagcacaatccgcatgtttgttcgcaggttcgccggtgcttccacacgcgggtttacgaacatattcgcgccgatcgaatcgaaatttgtggacgaaatgtgtttgccgtttacgtaggtgatgtaacaatggttgtatgacgcaatcgaaagtgctgattcttcaacatgtcccgtgggagaagccggggcgcattttggatagcttggacgacttgggtatgtcgtacgaaatcgcgaacgtcgcgaaggaaaagaagccggatctgcctgatttcaaagagatttccggcgtggtgatcatgggcgggccgatgggcgcgctcgacttcgacaaatatccgggactcaaagcggaaggcaagctcgcacgggcggcagtcagcgtcggcaagccggtactgggcgtgtgcctgggccatcagatcatcgccaccgcgctgggcgcgaagctcaaaagcggcgatgcgccggaaatcgggttcgcgccgatcaagcgcatcgacaagcacgacttcttctccatgtggaacaagacgcttgacgtgctgcattggcataacgacgtggtgacgctgccggaaggtgcgacgccgctggcgcgcagcgagaagaccaagaaccaggcgttccgtttcggttcggcattgggattgcagttccacttggaggtcacccccacgttgttggacgagtggctggacgagccgtgcatggtgaaggatttgaaggccgccggcggttcgaaatcgcagctacgtgacgccttcgccgaatacaatccgcagctgcagccgatggccgatcaggttttctccggattcgcggcccggtgcagcacctatgccgcaacgctggagcgctgataagcgttctgcccgctacacgccccactgaatcgccagctgagtgccttccgtaggtggttcctgagttccgtaggtggttgggtgatggaccagtgtttcggaaaggctgaatttaaggcttttcttcgtgcggtatccgaagacaaccacctacggaagcggaaaaccacctacggaatcttctagggcgttttcgttgcctacattccaaggtctcctgtctacgtttcgcatcatgcagctggtgagcaagccccaaatacgtgtgcgggaggcggtgttccgccgacgcgctacattggtgagttatgccgacttatgatttgggacttgaacacgtttcgctcgctttcgcgaccaagaatattttcaccgatgtgacgcagggcgttttcgagggcgaccgcatcggcatcgtcggcaagaacggcgacggcaaatccacgctgctgcacctgttcaaaggcacgcaggaaccggattccgggcgcgtgaccatgcgcaacggactgacattcggcatgcttgaccagcgtgacccgcttgatgacaatgccaccgtgcgtgaggccgcgctcgaagggcgcgaggactacgagtgggcggccgagaccagatcgcgcgaaatcgtggaggcgctgctcggcggcatcagtctggacgcgaagattggttccctgtccggcggacagcgccgccgcgccgacttggcacgcctgctgctcaaggattgggacattctcgcgctcgacgagcccaccaaccatttggacgtggtgacgatccactggctcgccgaacatttgaagaaccgttggccgtccggtcagggcgcgctgctgctcgtcacccacgaccgctggttcctcgatgaggtctgcgagtcgatgtgggaggttcacgacggtgtgatcgatccgttcgagggtggttactccgcctacatgttgcagcgcgtggaacgcgaccgtcaggccgatgtgcgcgaaaccaagcgccgcaacctggcgcgcaaggagcttgcctggctgacccgtggcgcccgcgcccgttccaccaagcagaagttccacgtcaaggcggcgcgtgagctcatcgccgacgtgccgccggtgcgcaacacgctggaactgaagcagatggccacgtcccgcctgggcaagcaggtggtcgacctcatcgacgtgacgcagattttcgaacatacgcaaggcgaggcggacatcgacgcgattgatccggacgtcgccgaaatggaagcgtcggcctcccgcgtggacgtggtgccggcgatgtacgccgaaccgcaggcgcacggcagcgtcgaagtcgcagtcgacgatttgaccgatccgcgattggtggacgccggtgtgccggaagcgcggcaggcggcggcgcaggcggaacaggacgcgcaacagcaggcgcaatcgcaagcatcacaagaaaattccgacgaaacggaagcggcggaagtgacatccgcggcgcggaaggtcaccgtgaccggccgtaagatcctcgacgacgtgacgtggctgatcggcccgggcgaccgcttcggcatcgtcggcgcgaacggtgccggcaaatcgaccctgctgaagatcctcgacggcacgatcaccccgaccgccggccatgtgaacatcggcaagaccgtgaagttcgcggtgctttcgcagcgcctcgacgagctggagaagctcggcaaatacaagattaaggaagtgctgagccgctacaagccgagctacatcgtggacggcaaggagaccacgccggggcagatgatggaacgcctcggcttcgaatccgcacagctcatgacaccgatcaaggacctgtcaggcgggcagaagcgccgcatgcagctgctgctcatcctgctcgacgagccgaacgtgctcatcatggacgagccgggcaacgacctcgacaccgacatgctcgccgtgatggaggatctgctcgacacttggccgggcacgctgatcgtcgtctcccacgaccgctacctgctcgaacgcgtcaccgaccagcagttcgcgctgatcggcggcaagatccgccatctgcccggcggcgtgcaggattacctcgacatgaccgaggccatcaagaacggcaaggatccgttcgcggatgagaagaccggaaaggccggcaaggctagcaagggcggtaatgacgccgcgtccgcgagcgttgtcggtgattcctcatccgtgtctgccgatggcgactcggctgcggccgcgccgaagctcaccggcaaggcgttccacgaggcatccaagcgcgttgctgcgattgaacgcaagctggccaagctggaggaacagaaggccgatctggaagcgcagatggccgcgcacgacccaagcgattacgagggtctgggcaagctcaacgagcagctgcaggccgtcacggacgagtctgaatccctcgaaatggaatggatggagctctccgaacagctcgagtagtcccagtcggacaaactgacggtgagaggcttgtaggcgtcggtttggcggtacggaatgtgcaaaaccgacgctggcgattcgctcagcgtcggtttaccggaataattcgtcgtggctgccagtacgctcgaagaacgcgactgaatcgttcgatgaccagatcactagccagtccccggcattggcgacatggcattcgtatcgcccgcgccaattgccggacagggtgtgcatgttgtggcggcggcgcagctcctccagcgtttccggggtgttctccactaccagatcgatgactttttcaagctcggtcaggttccagttacgccgtttggcgttctttttcagatcgcggctgaaggccttcgcgaagtcggcggtcaaccggcccatcagcgcatcgccgcttcgagcaggtcgtgtccgttggtaaaacgccccgtcttgcccgatgccatgaagctgtccgcttcggcagcggcgttcaggctttcgccattaggctcctcgggggcgaacgtcaatgggatgcgcccggtattcaccatttgcttgaatacggcgcgcaccactgacgagagatccaagccataatattcggccacgtcggcggccgaacgcttgagttcgtcatccatccgtatggtcaacgttgatgcactcatcagaaacctcatccacttgtatgtacaaaagttagatattgtacatacattttagcagaagaatgattccatccaaggctgacagttggttagcggcattgcgagccagtttcctagcgaaggcaatcgtcgaatagtgtttgcgctatttccaatatgccggcaatgctgaatcctgaggattcgtgcgaagtctcaatagcgccgttcatcgggtcgatggcataacctccacgtggcatacgttgaaatgtgccgaacgtacaaggtgccacgcagcaggagaccgcgaatataacaacgcagcagacagtcccgatgccatatgcaagcagaggcatgccatcttccagcatgagtgccgatgcgccattgacggccagcatgggacggatcacgaaccataataaggcaggttgtgcaatcgcaaatgagaaaccggaaagcagttccttgaagatggacggcgttccacggcggaataccatcgggcgtgcgggcgagtagctttgttcccctcgtagtccggaaccaaggaacgcataccagcaggcgacagttggaacgagcaaaagaacaaacgcgattttgatgtgttgattaatgccataagccgttggcagaccggcattgacgatgatgtttttgatgatcagacaaggtaatgcgcattgcgccacgcagatgaggaattcgccgactgcaagcagaagctgaatatgcatgcctcgtgtgcgcgtagtgaggatgtatgcatattgcggcgcgctggatgcggtggaatcgggcgtaaggcatgcggggcagatatggctgcatgcctgatggtatttgaggcattgcgtgcaccgtacatattcccctgaatcccgtggaagcagccaaggcagtgcaataagcacgatgccgacgcatagcgccgcaatcgcatggatggaatcaatcgtcatctcgtcacattccccaactccgcatagagtctcttccactagcccatgcattagtctaatgcgtgcaatgaacgatagccattcgtgcgacaacgatgcgtggcgttttatgcatcagtgccatattctgttcgcatagaagttcttagctgttttcgctggagaaaccaatggaggtgtctcatgaatgaagtgatgcgaagaagtgcctgttgtttgttgtcggctttgttgctgtgctcatgcgtcggttgtgcaaattccgtacacgaaatctctgaaggagacgctgcccagagcagcagtaagaacgatgatgcagcggagcaagcgtataaagcgtttactgtggacgctttggaccgtattgccgccgacgatctcaataactcagacaaactggttctagtaaacaagctgggcgcgaaatccgtgcacggcgatgatgctattccatttgccaaaaaggtcgacgaaaacaatatgtattatgtcgtttccatgtgcaaacagaaggagcaggctccttactcacttgtcctctacaaagatggacagccgcacactgtaaccactagggaatcctgtacttctaatggagtggaaacagtctctcttccggcgaagaatttccctagcgccacctcattgtccattatcaatatcggcaatacggatcttgttgtttccgtatatgaagtaaaggaaaaccatcatgaataagcgaaataaagtagttgcagtaattactagtattttgttggctgcctctatggcatctctctcgattcctgcgcaggctgagcaaaatactgacgttgcgcctatgtcttgtcccgaaattggacatcatcagtctgtctctaacaaaggccgcatattcatggcaggttctctacctaaaaattggctttcgcctggtgggacatacactgtaacaaaagccaaaactacaacggtcactgggagtgttacaggcggagtggatgctgaattttcctcatatgttaaggcacatgtgcaatcgagtctatcaacctcacagactgtctctgaaagtcagggatggagttggacaaacacatcaaataccacaaaatgggttcaacttggtgcagctggatacgaattcgattacacacggtatgacgtcgtttctccgtgtaatgtcgtcaatcaaaaatataagcatgcaaagatgccgacaaaccagccatggttatatcacaattgatgtttccagaaaacatcgcggcaacaccagagaacaaattgtgccttgccctccatttctagagtttttctgtgggggaaaacattagcttaacttgatgggctagtggaattgtcagggacaatgaccattcttcattttctgaatttatggtcattgtcccattatgttgttgcgcaaaatcttgtatgagggctgtcccgtagtgattttctggagcactatttattgcggcgttatatagatttgatgcgaagatgcgaaccgcatctggtcctacagagaggataaaagcaaaagccccgggtttcccgtgtttggcaatgttattgagaatttcggtacaaaccgtttgcaacgatggtagtagtgacttgtccattgcgtttagattcccgcggattattggtgtcccggtaaaacccagtattctcagtcttttgcattgagcttctatatgttgttgaaagagctcgtccgcgtcttcctctttgtctgttttaagctcatcggtcatcgggctgataatttgagtgcgaagctcatgtaatgcctgcatgaggacttgttcaatctgtggcaaagtgtcgctgctctctgagggctctttcttgcgacacagcagaatcgcatatgtcatagctcctgcgatggaatcgtgcagtatgtgaatttctttgagtcttttctgctggcgtcgaacttgttcttgtgcaatcgccaggtcggttttccgttgctctgtctgtatcttccaccgtatggcaaagccaacgaagaatgctccaatgtaggagcacgcaagcacggggatgcttggattgtagtcgacgccgcctgtccaatagcccacaggaagtgccagtgcgcaaagcagcggccccacgatggcaaatccaaatcgtttgatttcaaaagcaactattccacatacaagccatgtgccatataacgtcgaagggccatcgcatattgccgggattattgcacatgctatgtgtgttacaagaatcgccatgcttgccggtacggggaaccaagtcagtagcaacagagcgatgcagtacggagccaaatatagccatgaccaaggtgacatatttggccaagcggtcagctcgagcaggaaaaagcagatacagataatggatcccgctaagtaaggcttgcgcacggcctttgccaatgacattatttgttggggcagcctcatcgttatatccaaccgtttcttacgcacatcgcaacagcttcggcacgactatgagcatggagcttctcgaaagctcgtcgtgcatatgtctttaccgatgcttcgctgatattcagttggtgcgcaatagtggaagtggtgaatcctctcgcatagttggcaatgatctgtaattccttgccggaaagccgcatggagtttatgctcttccccgcccacgacgcaacctcgtcatttccagtggcttttccgatgattcgaaccagttgaatcgtgggaatttcttttggaataatcgcataaaacgcatcggaccattgtgctccgtatcttttttcgttttcgtcatccaaaaaggcgctgataccaatgacggcaatatctggatgttgttccttgatatgatgcgctaattccgagccgttcatcccaggcattgcgatatcggtaagcacggcttgtggcctttgtgcagagtccctcatggcctcaagtgcttgttctgcagaggtgacagtccacagaatctgtattggtgcgcatgtctcgaccaataagctttgaattgcgctcgcgaccagtggatcattatccacaatccctagagtcgaatcattgacaatcgtgcgcatataaattcccccgtggtttgtttctcgttccagaatagacatttttcgcagctgcaatagatcgcggcgttaccggtgagacacatgttgcgaacccattcaaaagcaaatattttgtacaaaaaatttgtatataatgggaggcgacggaaaaggagtcttctacgatgaacgatacgaactccagcgaggggcagctgcccgaagatgccgcagtgaccgtgaccagtgccgacactcttcgggccatggcgagtcctattcgcatgaggatccttggaacgttgcgggtgaacggcgaacagaccgtgggaagcatcagcgagcagcttggcgaggctcccggagccatcagctaccacttggggcagcttgcgcatgcgggactagtgaaaaaggtggagtctcctgacggagatcgaagaaagagctggtggaaggcctgtcaaagcgccattcgtctggggaggcccgaagaaaagagcagtgcagacaaggcaaaggccatggatctgtttcggcgttcggcggcactttcctacgagatggcctacgagcgttttctggacaggctgccggaattgcctcgggaatgggctgattcatgcaccagcgatgatcatgttctgaacctgaccgccgaggagacgagcttgatgatcgaggaactcaatgaggtcgtgcgccgctggcagatcagggccggcatgcacggcgacgatgagctgggcgtcgaacccgtggcgctgattctgcaggccttcaggtgggtctcataagacgccggcggggttgacgcatgaatccacgagcaaaccggaaagcgtgggcggaacagtcggaacaagtgggttaattggagcaaagcatgagtgaaacggcgaaatcattctggcattccgcagggtatatcccgtggttcaccgccgatacggcgtcggcggtcggagcggcgctgcgcgcactggcgatcagtttgcttggatatgcggtgtccggttccaccgtcgccgccgggtggctcggaacgtcgtcgatgatcgcgcaacaggttgcgagcgtattcggaggtaccttcgtcgacaggcatgaccgcaaacggcttatcgtggcgaacgccgtcgtcggcgttctggcttggggcgcagttgcggtgctgctgctgtgcggcgcattgtcgttccccgtgttgctgttgatcgcggtgctcgcatccggcatcaacggatttcttgggagcgctacggatgcgatgcttcgctcgatcatcgatatccgctattatcccaaggcgcggagcctcaacgaggggcgtgacgcaaccatcgccatggcgggaagccccatcggaggttttctgtacagcattgctccatggctgccgttccttgcgtcggcatgcatgtatgccgtgggcggcgtcgccgccaccggcatccgcgaatatggttcggatggcgggcacatcggggaaacggatggcgatgcagcgaagggcggtttctgccacgatttcctggaaggctggtcatggtcgttgcacaggaaaacgctggtgatcgtgctcatcgtggcggcattggtcaatttcggtgtcaacggcatccaatatgccatccagctgcatctggtgtcgtgcggaaccaatgcgaccctcatcggattcatcagtggcggcatatcgctgacgatgcttgtgggatcgttgctggccggcaaactcagcgataaggttccggtcggaccaaccgtgtgcctcgcctacctgttcatctgcctgtgcgcattgccgatggcgttgaccgacaactattgggtcatgctggttgccaattcgtttgttggcctgccgttcccgttgatcaacgcgatgctcctcggtttcatcttcgccaagtcgcctacgagcatgcaggggcgtattactgttacattgacggttccggcccaggtgctttcgatgttctgtagtgctgtggctggcaccttgctcccggtttttggattccatggcgcggtgctggtgttcctcgcggttcttgtggcaagtgccgtgctggtgatatgttcccgttccattcgtagcattcccaaggcggcgcaatgggaacatacgatgttgcggtgaatcgaaataaaaagcgccgctccacgaaacgaatcgtggggcggcgctttgccgtaggcaatgccgctcagcccgttcagcggccggtgatctcggagccgagcaccttctcgctcagggctttcgggccgcgggtcacggccaccgcgccagagcggaccagctcgatgatgccgtaatgctccagcaggccgagcagcgcgtcgatcttgccttcggcgccggtggcctcgatggtcagcgattccggattcacgtccaccacgcgcacgcggaacagacgcacgatctccagcacgtcggaacggacggactcgtcggccgccaccttgatgagcaccaactcgcgctccacggtggtttccggatcgaggtccacgatcttcagcacgtgcagcagcttgttgagctgcttgatgatctgctcaagcggcacttcctccacttccgcggtgacggtgacgcgggagatgtccggacgctcggtgggggagacggacagcgagttgatgttgaacgcgcggcgggcgaacaggccggcgatacgcgccagcacgcccggacggttctcgacgagcacggacagcgtatgacgcttggaacccggctgggatgcaggataatttgccatgatcgaaatgtccttccttacgctctactcgttcactcgttctcgccggcgcgctgcaagggcttgacgccgggcatgtacgtgacgttgtcgttggagtcgccggctgcgaccatcggccacaccatggcgtccttccacacgcggaagtcgatcagcaccggacggtcgttgatctcgttggccttcttgatgcattcgatggcctcgtccttggtgaacgcgcgcatacccacgcagccgtacgcttcggcgagcttcacgaagtccggcacgtccacgatgtcagacgtgttctcgccgtccagcaggttcgtcgcggaatagtggtgatcgtagaacagggtctgccactggcggaccatgccgtacacggagttgttgagcagggcgatcttcaccggcgcgtggtcgaggaacgcggccgccagctcttcggaagtcatctggaaggagccgtcgccgtcgatgagccacaccggcttcttgttgtcgaattcgcgggcggagccgacgcgggcgccgatggccgccggcaggccgaagcccatcgtgcccaggccgccggaggacagccaggagtggggcttgttgaattcgatgatttgggtggcccacatctgatgctggcccacgccggaaacccagatggtgtccggatcggccatgtcggacagctgcttgacgacccactgcggggcgaggctgccgtcggtcggttcgtcccatgtaatcggataatcctcgacccacttgttgatgacgtcccaccagtggctggtgtcgggcttgccatgcaccgcctgctcgcgcttgatctccggaatgaggtccgtcagcacggtggccacatcgccgacgatcggcacgtccggctgacggttcttgccgatttccgcagggtcgatgtcgatatggatcacgcgtgcgcccggagcgaacgcgtcaagcttgccggtgacgcggtcgtcgaaacgtgcgccgatcgcgaccagcaggtcgcagcgctgcacggcgccggtcgccgcgatcgtgccatgcatgccgagcatgccgagcaccttcggatcggaatccggcacgatgccgcgcgccggcagggtggtgacgatcggagcgccggtcacatcggccagctccttgacgagctcgcccgcgtcagagcgcaccgcgccgccgccgacgtacagcaccggacgatacgactgctcgaacagcttcgccgcgtcggacagcacacgaccgtgcgccttggtagtcggattgtatcccggcaggatcatgcgctgcggccaggaatagtacatctcgccggtctgcgcggtcttggtgacgtccaccaccaccggtcccggacggccggagcgtgcgatgtagtgcgcctcggtcagcacgcgcggaatgtcctgcgcgcgggtgacgaggtacgaatgcttgaccaccggataggtggcgccgacgatatcggcttcctggaaggcgtccgtgccgatggcgttcacgccgacctgaccggtgatgacgaccatcggaatggaatccatgttcgcatcggcgatcggggtgatcatgttggtggcgcccggaccggaggtgacgatgcacacgccgacctgtccggtggacagcgcatagccttcggccgcatggcccgcggcctgctcgtgacgcatcagcacgaaacggaacttcgtatcgtccttgatggaatcgtagacgggcagaatcgcgccgcccggaacgccgaagacgtccttgacgcccagatcctccagcgaacggaccagcgcttcggcgccagtcatcttctcgccgtcgacgatggtctgcttttcagtggtggcggatgcctttggcatgccgctgaatgcctgcagaggcgtaggtaacaccatgttccctctcatgctcgttcgtggaaaatttcctcgtaaggggccgcggtcgcgtcgttcatgcgccgttttaccccttaaacggaatgctatgcaaccgcttgtgacggattgcagccgcattcctctctgataatgagtctatgctaacggctgacagcttggttcgccggaaaggcccatattctggcgcgttacgcgccatggtgatatggaccatattttttgcgattgcgacgctgccttgtaatgctgtttcgtgacgccggccgtgccgccgcttgcgttaccgtttgcgcggttacttgccctgcgctgcatcctgcgtgccaccgttggacttgcggtgtgacctgtggtgcgacttatgcgtcttcccgttctgcttgccgcccatttcgcccttgcgactgtcaagcgccttccagcccatttccgcggccgccagctgcgccttgcgtttgctgctgccggtaccgacgccgatgacttcgccgccatcgccgagaatcgcgcgcgcggtgaactccagtgcgtattccggtccggcgaccgacgtctggtagtgcgggtcgggcagacccatctcatgcgccttgacggtcagcgacgtcttccaatcgagcgccggaccttcggtggcgacctccgccagcgtatcgtcgacgagatgatgcaccacgcggcgcgcctcgtcgatgccgtgctggatgaacgtcgcgccgatcagcgattcgacgatgtcgcacagaatcgagcttttgtccgcgccgccctgttccgcttcgccgtggccgagcagaatgtacgggccgacgtgcagcttttcgcgggcgattttgctcagcgattcctcggaaacggctttcgcgcgcattttggccagctggccttcgttcatgtcgggatgcaccttgtacagcgtttccgtggagaccagttcgagcaccgcatcaccgaggaattcgaggcgttcgtagttcttggccccctcatgctcgtgtgagaacgagcggtgggtgagcgcttcgacgagcaggtccggttcgattgtggtgccgagcgcctcgagcaacacattggcggtcatctcgccttcgggggtgatggaggtgccgatgcggccggcgttggtattgttgccgttttcggtttgggtgttgtcctgcgcgttgtcctgattggtctctttggccatggatgttccttaccgttcatgcggcgggccgagcctgccgcggtctgtggttgtggccgttgcgcacatggcaagacgccagctgatctggcggttttgctacgcaagcaacgtgtgctgtacgccgattgcatgaggaaataaatcgcaatgcaatcgccgtatcacttgataataataaaagaaaccctgccacccgtcgatggcagggtttcgatgctttataccgttatccggcaaccactcacttggtgtggatggagcggacagcctcgcggtacacgcggccgcggaaggaaccgcagctcgggcatgccatgtgcggcagcgtcggagcgccgcagttcgggcaggtaacggtctgggcggccttggccttccagtttgcgcggcgggaatgggtattcgcgcgcgaggtcttgtacttaggcagtgccattgtgtttcctctatttcgttcgaacgattgagcttaagcgttcagtatcttaacgtgagctccgtacaaacgatggaccatcccatccgaacggcttattccttgccttccagcttggctttcagcccttccagcgcggcgaaacgaatgtcggtcatgtcatgctgatggtcggggttctcgttgaggtcgatgccgcactgcgagcacaggcccttgcaatccggcttgcacaacggctgcagcggcagttcctcgaccagcgtgtcgcgcagcagcgcctcgaggtcggcccatgcgccgccgtcgagcagcgggtacgtgtcttccgcctcgtcctcgccggcgatgatgtccacttcctcttccttgccgttcttgccggtctttccgcccttgccggcggcggacttgtcttcatacgggaagaaggaggtgacgttcaccgtccaatcgcgctggatcggcttcaggcagcgcgtgcattcggcatgcacgggggcgctgatacgcgcgttcagaatcaggccgtcgacgatcgaatcgaacgagccgaccacggcgacgtccgcgccttcgtccacgcccacgatttcatcgccgatgccgctcggcgcggggaaagtggcgtcgatctccttgctttgccccggacgcgaggccacctgcgccacggaaacggcccatggggaatcttcagtacgtgccatagttcagtctttcatcgctttcttgctatgcgttccacgcgtgttacgcgtcttgttcagttttccggataatcgtccgcatcgagatggtccagatgcgcgccggcttcgcgttggcgatcgtacagcacgttcaggcccgcctgcacgccggtgccgatcttgtcgacctgctgttgcaacgattccatcatggtgatgcagtatttgtcggcgttctgcgtgagcttgtcggccttggcttgcgcctggtcgagaatgccgcgcgccttctgcctggcgagttccgtcacgttctcctgcccggcaaggaactgcgcctgctcgttggcttcgcgtacggtgtcggcggcacgcgactgcgcggatgcgatgatcgcgttggcttgcgtttgcgcgctttccagacggcgttccgattcgcgcatcagcgcggaggcgcgttccagctgcactggcagcatcttcttgagtttgtcgagcttgccggtgaacgattcgcggtccacgcgcaccgagctcggcgcgaacagaatcggcttggcctcgtccaattcctcttcgatgctgtcgatgatgtcgtagacggtggtgaattcgtcgcggctgcgatccgaactgtcgtcgagtggtgcgttggggtcgaacgtggcgcgaaggtcgggcaggtccgacatggaaatcgacggtttcgacgatttcgcgggctttgccggctcatccgtagcacggtcggcggcattgccggttgcggagttgttggtcgctgcggtaccggcaacagcgccggtggccggataatcggccgccgccgtgaccggctgctgcgacgtggcgtcatcggcgtcagcaagcggcttgaaatcgttggtctcttcactcatcatgctctcttttcgttcttgagcgcctcgccgagcagcggaatcacgcaatcgggcaccatgcccgtcacatcgcctccgtgccgtgccacgtccttgacgatggagctggagatgtgctccaggtccggggccgcaggcagaaacagcgtttccactccggcgagtttgcggttgaccaatgccatgcccagctcagcctcgtaatcgccgttctgccgaagtcctttgacgatgaccgtcgcaccgattttcgtgcaatagtcggtgatcaggccggtggtcgacgccaccttcacattggtgcaaccgcgcttggcgagcgcctggcgaatgatctcaacacgggtttcttcggaaaacatcggcgtcttcgccgcgttcacggccaccaccacatgcacttcgtcgaaaaagcgcgcgcaacgctcgatgacgtccaggtggccggcggtcactgggtcgtacgacccggggcaaactgcaattgtcatagccttaagcgtaccgcgattggttgagaacgtgcgcaacatcggcgtatgcccgtgttggcgcggttcgtgcatacgggtggcggcgcaatgcggctcggctatgatggaaggcagtggggccgcgatcgcggcttgtgtgaggagtcttgattatggcatttgcgattttcgatggcctgttcggatccgacgatccggtttcgccgctgtccaacccggatgcgggtaccggtaccgccgttctggaacgtcctgaagaggaaacgaagcttgatgacggtggcaatggcgatgccgaccgtttcgcgcattatgtgtcgcgtgaccgtatcgccgaatcgaagatgacgggtcgtccggttgtggcgttgtgcggcaaggtgtgggtgccgaagcgtgaccccacgcattacccggtgtgcccggattgcaagcgcatctatgacgagatgatgaacagctcgttctgattgccgttcgaccatgttgccgattcatgccgccggttgcggtggctgaacgtggcgattgaatatggcggctgggtgcggcgaccgagtgcggcgcaacgtcgtatgttatgcaaaaaccgacgccggtgattcaccgggcgtcggttttttgttatgtcttttgcgctgtacagggcggttcacgccatgacggacgtcacagcacggtgacttcggtcgggatgaccggatcgcccttcatcaggctctgcgcgccgatcggcagttcggcgagcgcctgcgcgcggtagttgtgcgcgttgacgatcgcgtcgtggccctggtattcgctgtggttctcgccattggtgacgtagtcgacgagcaggtccttccagccgtcttccggctggtatgcggcgagcttgtcttcggagccggagatgacgtgttcgcagtcggccagcgagtattcgtaggagcggaaggcgagcttgcggcccggaacggtggccttgtccttcgacttcttggcgaccggctgcatttcgccggcggagttctcgcgttcggtgagcttgtagaccatcgcgcaggtcggtgcgccagagccggtgacgagcatggtgcccacgccgtaggagtcgaccggtgcggtctgcagtgcggccagcgcgtattcgtcgaggtcgttggtgacggtgatcttcgtgttggtggcgccgagtgcgtccagctggttgcgtacgcgctgcgcgagggacgcgaggtcgcccgaatcgatgcgcacgccgcccagttccggtccggccacgtcgacggcggttttcacggcttcttcgatgttgtaggtgtcgaccagcagcgtggtgtttttgccgagcgccgcgatctgcgattcgaaggcgcttttctcgtcgtcatgcaccagggtgaagcagtgcgcggcggtgccgatggccttcaggccgtacatttgcgcggccagcaggttggcggtgcccttgaatccgcccaccacggcggcgcgtgcggcggcgaccgcggcccattcgttcgtgcgtcgtccgcccatatccatgcacggacggtccttcgcggcggtggccatacgggacgcggcggaggcgacggcggaatcgtaattcagaatgctcagcagcagcgtttccagcagcgtgcattcgccgaacgtgccttcgacctgcaggatcggcgagttcgggaagaacatctcgccttcgcggtagcccttgatggagccggagaagtggaagttctccagccatttgatggtttccgggcttaccaccttgcggtcggcgaggaatttcaggtcgttgtcgtcgaggtggaacttctcgagcgcgtcgaggatgcgtccctgtccggcggccacgccgtagtggcggcccaacggcagatgccgggtgaagatctcgaatacgcacttgcggttggcggtgccgtccctcaggcatgcgtcaagcatggtgtattcatacatatcagtcatcattgcgggtgagtaatccagcatttccaaagcctttcttgacttttggtgaaactgaccataagtgtaggacccacggtggccaatctttggttgcatcccatcatacgtgcaggaggggtctcgaggcgcggcgtgcttggctggtgatagggtcgaatgctgaaaagacgagtaatcggacggcggcaaaagccgaaatcagcggaaagcgaagtgcagaacagcaatggtagcgattaaggatatgttgggcgaccagaccgtggtgcgtgcggacggacgcaaggtggacgaactgcgcccggtgcgcatcacccggcatttcacggacgttccggaaggctccgtgctcatcgaatgcggcaacacgcgcgtgatgtgtaccgccacgttcacggccggcgtgccgcgctggcgcaaggactccggcctgggctgggtcaccgcggaatacgcgatgctgccgcgcgccaccgccgaccgcaccgaccgcgagtccgtgcgcggcaagatcggcggccgtacgcacgagatcagccgtctgatcggccgctgcctgcgtggcgtcgtcgatatgaaggcgctcggcgaaaaccaggtgcagatcgactgcgacgtgctgcaggccgacggcggcacccgcaccgcttcgatcaccggcgcgtacgtggcgctcgtcgacgcgatgcattgggccgaggaacacaagcacgtcaagtccgccgaccgtgtgctcaaggactgggtctccgccgtctccgtcggcgtgatcaacggcaagccgatgctggacctgccgtacatcgaagacagccaggccatgaccgacatgaacgtggccatgaccggttccggcgatttcatcgagatccagggcaccgccgagcatcgtccgttcaaccgcgccgaactcaacaccctgctcgacctcgccgaaaaaggcaacagggagctgcaggccgcccaacgcgccgcgctcgcgctcgactgagccgatcgacggcacggcatgcgctgaatgtaggacgttgacggtccgatgccggcgacttggcgcatagaacaacgcaaaacagatataagtcggaaaacgacggaaggaaccgtaaggcatgaagatcatcgtcgccacgcataacgaaggcaaactggcggaaatccgccgcattctcgaggaacgtctcggcgcggacgccgccgacatcgagctcgtctccgcaggctccctgggattgcccgatccggtcgaggacggcgtgaccttccaggagaacgcgctcatcaaggcgcgcgacgtggccgaacgcaccggctgcccggcagtcgcggacgattccggcctgatcgtggacgtcatgggcaacgcgccgggcattctgtccgcacgctgggccggcgagcacggcaacgacaaggccaacaacgcgctgctgctcaagcagctggccgacatccccgacagcaagcgcaccgcacggttccgctgcgccgccgcgctggtcgtgccaggagagcgcaagacggacggtgcggatgatgataagccgtacacgatcgccagcgaaaccgtcgaagtcggcgaaatgccgggcgtgctgctgcgtgccccgcgcggcgccaacggtttcggctacgatccgctgtttgtgccgaacgatcagccgcagcgtgcggtcgacgccggcgaaaagctcacgtccgccgaaatggagccggccgagaagaacgtggtctcccatcgtggcaaggcgctgcgcgcgctggtcgcatcgatcgaagcgctggtcaaataacatcggatgacggccgcgacgggcgcttgccgtggcgcgcgacactggatggcgtgcgtgcgatttgtgctcgtccggtttttccgctatgctttgtttcttgtgcgcggctagcgtatgcttaccgggcattgcgccactttagctcagtcggtagagcggctcactcgtaatgagcaggtcgacagttcgattctgtcaagtggctccactgccctagatgttcggaggttttccgagcatctagggttttgcatatgtgcattcgtgcgtatcggttttcgccgtgcgcggatggtgattgcgcgagtggcggaattggtagacgcgcaggatttaggttcctgtgtctttgacgtgtgggttcaagtcccatctcgcgcacatgtccacgttaattcagccaatcgcgctgctggccatcatcctcaccggctacctgttcaaacgcgccggcaaattcaaaaaccgcgactaccgcatcatgcaggtcgccctgttcaacctggttctgccctgcgccatcatctactcgttcgccacgaacccgcatgattccagcatgctgtggatctccgtcttcggcttcgtggtcgcgttcatcccgcccgtgctcatcttcctcaccacacgttacacgcctgtgcaggatcgcgcgttcaccatgctcaacggttccggcttcaacatcggctgcttctgcttccctgtggtacaggcgtttctcggcaccgcggcgatcgtgccagcggccatgttcgacatcggcaactgcgtgatggtggcggccggcacgaacgtcatgacgcagaccctcctgcacatccagcccggcaagaccttggacgagcagtaccaggggcatgcgccggtgctgccgtatacgaaacccaaggatcgcgatgcccgccggctggcacgccacgcgctgctacgcaacgtggcgaaaggcttcttcggctccatcccgttcgacacctacctggtcatgatcgtgctcatgcttgccaatgtgaagatccccgccgtcgtggccacgttcgttgagccgctcgccaacgccaactcgttcgtcgccatgctgatggtcggcatgctgatggacctgcccgccggccgtgacgatgtgatgaagctgctgaagatcatcggcctgcgactgccattcggcctgctgtccgccgtctgcgcatggttcgtgctgccgttcggcgccaatgtgcgcgaagccgtggtgatgtgctgcctcgcgccaatcgccgtgttctccaccctgttcaccgacgaagtgctcggcaatgcgaaactcgccggcttctcgctgtccgtgtccgcgatcatcggcctggtcatgatgaccggcgcgcacttcctgctcgccgccatcgcctgacttgcgtaagccgcgtgcgtggtcgtgcgtaagttgcgtacgtaatcgtaatgcgatcgttgcatacgacagccgttttcacgtgcgttgaagctttcccgctgaacgttgcatacgatttcagtaatcgtcgtttatctggcatgtcgccgctgaaaagtggtcggaaccgcggtatatcgcgcttccgaccgaatgtgttaactcgggaaacatttttgtgttgttctgtcggcttttgtgagtatcttgtgaggtgaagaaaacggctcgtgccgtggaaaatcgaacgagattccaccgtcacgttccgcttcacagtgatgatgaaaggacctatcaacatggccatcaatcctcccgttgacgccaccaagaccccggagtgggccgcgctgcagaagcactacgacgagctgcagtccgagggcatcagcctcaagcagtggttcgccgatgacgccgagcgcgtcgagaagctgagcttcgatgcaggcgacctgcacttcgatctgtccaagaacctgatcaagccggagaccctgcagctgttcgccgacctggccaaggccgtcaagctcgacgagcgcaccaaggccatgtacaccggcgtgcacatcaacaacaccgaggaccgcgccgtgctgcacaccgcgctgcgccgcccggtcgaggacgagggcaagtacatcgtcgacggccaggacaccgtcaaggacgtgcgtgaggtgctcgaccgcatctacgcgttcgccgacaaggtccgctccggcgagtggaccggcgtgaccggcaagaagatcgagaccgtggtcaacatcggcatcggtggttccgacctgggtcccgtcatggtgtacgaggctctgaagccgtacgccgacgccggcatctccgcccgctacatctccaacatcgacccgaacgacctggccgagaagaccaagggcctcgatccggagaccaccctgttcatcatcgtttccaagaccttcaccaccctggaaaccctgaccaacgcccgtgaggcccgcacctggctgctcgaagagctcaaggccaagggcgccatcgacggttccgacgccaagaacgccgaagccatcaagaagcacttcgtcgccgtctccaccaacctggagaaggtcgccgagttcggcatcgacccgaacaacgcgttcggcttctggaactgggtcggcggccgttactccgtcgattccgccgtcggcacctccctcgccgtggtcttcggcccggcccgcttcgaggagttcctgcacggcttccacgagatcgacgaatacttcgccaacaccccgttcgagaagaacgtcgtcgtgctgctcggcatgctgaacgtgtggtaccgcaacttcttcaaggtcgcctcccacgccgtgctgccgtacgaccagtacctgcaccgcttcccggcctacctgcagcagctgaccatggagtccaacggcaagtccgtgcgttgggacggcaccccggtcacctccgagaccggcgagatcttctggggcgagccgggcaccaacggccagcacgccttctaccagctgatccaccagggcacccagctcatcccggccgacttcatcgcgttcgtgaacaccccgaacccgaccaaggacggcgaccaggacgtgcacgagctgttcctgggcaactacttcgcccagaccaaggccctggccttcggcaagaccgccgacgaagtgcgcgctgagggcaccccggaagagatcgtcccggcccgcgtgttcaccggcaaccgtccgaccacctccatcttcggcgtggctctgaccccgttcgcgctcggcgagctcatcgccctgtacgagcacatcaccttcgtcgagggcaccgtgtggggtctggactcctacgaccagtggggcgtcgagctcggcaagcagcttgccaagcaaatcaccccggccatctccaaggatgacgacgccctggccgcccaggatccgtccacccagtccctgatcaagttctaccgcgccaaccgtgagttctgattccgctgcgttgcatcagaactcacggttgcgcgcgccgcacggtgttgtctggtgaacggtctggcgaccgttcatgccgcgagttctgatcttccatcgaaacgtggcgtctagcgcgtacgtggcataccccatccgtgtcttacggatggggtatttttgattattgctgtgccgaaaggcgggacgccgcataatcccgcttttcttcaggtccagccggaacgtccgcaggtagctgcggacgtgcgcaatcgcaatatttccggcggatcggcaacccttcgcaggcagacctgcggagtggaagaacaggctgagccggcaatcgcaagaacgccgtacgaggcccttacctgtgcgctgatatgcggcggcgactcgaggaaacacaatggttaacgctattgaggcatttgacgccaagcacctgaagccggctgaggaaatcccggcattccgtcctggtgacaccgttgaagtcaacgtgaagatcaaggaaggcaacaactcccgtctgcaggctttcaccggcgtggtgatcgctcgtcagggcggcggcgttcgtgagaccttcgtggtccgcaagatcagcttcggcaccggtgtcgagcgccgcttcccgctgcactccccggccatcgattccatcaaggtggtccgcaagggccgcgtgcgtcgcgccaagctgtactacctgcgcaacctgcgcggtaaggccgctcgtatcgtcgagcgccgcgacaactccgagaagtgagttcgaatcgcaaataaagcgtgaaatcggctcttcggcaacccgtcgaggagccgattttctatattgggccgctatgataggggccagtgcgtgaaaccggacggtaaggaatcccatgaagcatgccagaagaagagtcgaaagcgaggaaagcttcggcttacgagacaccctgatctggtgcggcatacccatcgtcatcgtgctgctggtgcgcatgttcctgttcggcttctacgtgattccgtccggctccatgctgaacaccatcgaaccgggcgaccgggtcatcaccagcaaactcacccccaaagtcttcaagcttcagcgcggcgacgtggtggtcttcaaggaccctgaccattggctgcagcaggagaacagcggccgattcggcggcgactacctcatcaaacgacttatcggcctgcccggtgacaccgtggcctgcgaggggcccggcaagccggtcacggtcaacggcgtggccatcgacgaaacttcgtacatccgctccggcgtggaccccagctccttcgcgttcagtgaaaaagtgactgcgggacatgtgttcgtcatgggcgacaatcgcgccaattccgctgattcccgctaccatcaggacgattcctcgcacggcctcgtgccggtttccgacgtggtcggcgtcggtctggtcaagtattggccgctgaaccacatcagcacgctggacgcgcatcacgacgtgttcagggacgtgccggaaggatctgccgactgatgtccgtttccatagtgcccacgctggatatggaacgggcgatcgcggcctccggctacgacgtgatcgtcggcttcgacgaggtcggccgcggctcgctcgccggtcccgtcatggtcggcgccgccgcaatccgcacgtgcgacctggccggttcgtcgccgctgcaagtgcccgacggcgtggccgattccaaaatgctgacggaacaccgccgcgaagccatattcgaagagcttaaatcgtggtgcgcgtcctgggcggtcggctcggccagcaacacggaaatcgacgattggggcatctcctatgcgcttggcatcgccgcattgcgcgcactcggccaagcggaagagaaactcggcatcgacggcgatggcatgcttgacggcaagccggtgaaggttggtgcgatcctcgacggaccgaacgactacatcaccaaagcgctgaacaccttcgacgcgcctgacgtgccggttcctgcggaagtctctaccaaagtgaagggcgacaggtactgcgccaccgtggccaccgcagccgtcatcgccaaagtcacgcgagaccggctcatggtcgaactgggagcgcaaccccaatatgaaccctatgaatgggcccacaacaagggttacggttcggccgcacaccgtgacgccatcgctgaattcgggcccagcgacctgcaccgcctctcctggcatctcgtctgacatacggcatctcatccgcagtccgcgattacgctaatccttgcggatgatgcatgccggaaggaaacctgtaagttcatcccgccgtctgatggccgggaccaatccgtttccgtaccgtaggaaacatggaacacatacttcacgcgaccgatctggtcatggattattcgacccaacaggctacaccgaacgccacacacatgctggcgctcaatcacgtggatttcggcatccaggcaggcgaaagcatcgcggtcatgggaccgtccggttccggcaaatcgacgttactgcacgcactcgccggcatcatcaccccgacagccggcaatgtgatgtttcgcggtgccaacctggcgcggttgagcgacgctgaccgcaccaaactgcgccgcagcgccttcggtttcgtcttccaatccggacaactgctgccggaactgccggccatcgaaaacatcgccctgcccatgatgctgggtggcgcggattaccgacaggccaccgacgccgccatgttgtggttggaacgattgggattgcggcagctcgcccagcagcgccccggcgaaatgagcggcggacagatgcaacgcgtcgccatcgcccgcgcacttgccgtacgccctgccgtcatcttcgccgatgaaccgacaggagcgctcgaccaacagaccggccacgagatcatgggtatccttatgcaggccgcgcgttcgaccggtgctgccgtcatcgtcgtcacacatgatccgaacgtcgccgcgttctgcaaccacacggttaccatgcgcgatggcagactctatttaccgaagccagcgcaacccgggccatccacacaatccgcacagcctgcacgtacgccgtcaaccaacggaggcgcgcgatgaacaccttccaattatggcgattgttccaccgccccggcacacgcggttcaaccagccacacttccgtgctggcaatcacggccttcgcctccgccaccgccgtcttcctaaccgtgctcggaggcctgcatggcttcatctggcgggcctccgccgaccacacgttcggttgcatgatcaattccaacaggtgcgcgcccggtacatacgaaacatggtccaaaaccctggcgcacgccgacaagctcgtcgccacggtcggcgacggccattggacggccgaccaggccacagccgtcatgaacacctattccgacggctatgtgctgctcgccgcattcgccagtctgctactcatcgtgccgttcgtggcgctcgccggctcggcggcccgtctcgcggcctcccgcagggacgcacgtctcgccgcactgcgacttgcgggcgccaccaccgcgcaggtcacgaaactcaccgcgctcgatgcgggtggccaggctctgcttggcgcgctggtcggcatggccggctacttcgcgctgataccggcgatcatgctgctcgacttccaaaaccagcatttcaccttcgaacagttgtgggtgggactgcctgctctggcggccgtgaccgtcggagtcacgctgcttgccttggtctccgcgctggtcgccctacgccgcgtggccatcaccccgcttggcgtgatgcaacgtaccggacaacccatgccgtccgcatggcgcgcactgattttccttgccgtgttggccgtaggctacctgctgctcaacagcatctccgcattcgcgcacttgggtcagatggtggtctacgccatcatcttcggcgtcttcttccttggtttcgccatggtgaacgtcgtcggtacctgggtggtggcgatgcgcgccagatcgcgtgcgaaacacccgaaggacgcggccactatgattgccatgcgccgtatccttgacaatcccaagcgtgcttggcgtaacgtgtccggtgtggcgctcgctgtgttcattgcggggatgacgtcggtgtgcggattgctcgccaccggaatcggaggcaaccacgacccgttcgacccatctatgctgtacatgcgcgatatagcgatgggtggtttcctgacgctcgcctttgccgcggtgctcgccgccgtcagttccggcgtgatgcagacgggcaacgtctacgaccaggccgacgagtaccgcatgcttgcgttggaaggcacggatgaggcgacgctcgacaaggcacgcatgatggaagtgatcaccccgctcaacacggtgatggccgtttcattggggtgctcggtgttgttgctgtttccgattctggcaacgtcgttgctcaatccggcttcgttgcttacgttggccgcgggaatcggcttgtgttatgcgctgatggtactcggagggtgtgccgcgaatcatgcggcgcacgggctcggtcatgccggctaccgtatggacgattgatggcctcgccgcggcggtcgtggataccgcggcgaggactggcgaggtcagccgagcagcaccgcgatgatcgcgatgaaaatcggcgacgacaacgtcgagaacagaatgccgtcgcgtgcgaacgacagacccacgttgtaccgcgccgcgtagttgtagacgttctggccagtcggcagagcggcgagcaccacgcacgcgtacagcgtggcgccacggaagcccatcacgaaatacgacagcaggaacgcgatgatcggcatcacaatgttcttcaaagcggccaccgtgaacaccgccggaatattcgacttgtcctgcaacggcttcgtgccgtgcaacgacatgccgaacgccatcagaatcatcggcaccgcggaatcgccgatcatatcgatcgggtcgtagatgaagctcggaatcacgaaatagccgaccttcgcggaaatcgcggacacggcgatgcccagcagcgagccgatgagcagcggctgatgcaacggttgtttcaggatctccttcgcggagaccttgcctttggtggtcacgtcgagcacggtcaggccgatcggcgtgaacaccgcctgctgcatgaccagaatcggcgcgacaagcgccggattgcccagaatgtacgtggctatcggcaggccgatgttgttcgagttcagatacagcgaattcagtgcgccgatggtggcgtccgcggctttcatatggaagaacagccggttgaggatcaggaagaccacgcccaccagcagcgccgaaaaaaacgccacgacgatggaggaatggaagatctcgaagattttctccttggacaggatggcgaacatcaggcacggactcgacacgaagaagctgaaccgattaagcaccatctgcgcgctcggcccgccgatacgcatacgcgcggccacatagccggtcgcgatgacgatgccgatgacgcagaaaccttccatcgcgcttaacagacccggcattgcactctccttttcgttgcggccgttgcctttcgaccgctatctagtgtggcaccaagcgcgcgtcggtcgtatgcacgtctcaaaagcgagcccgatacacgattgacggcacgttttgccggataatggacggcatgagcgaacttacgattggattttccgcttccgccagcaaacaggagcagttgaacgagctgatggggcagatcatgggctgctattccgtcagcgacgacgagggcccgttgacggacgccgtcgaggtgtttttgaaaaaacagccgcatctgacggtgcgcaggcacggcgacacattggtggcatccaccgatttcggccgcgagcgccgcgtgattcttgccggccatctcgacacggtgccggtgatcgacaatttcccgccgaaatggcttcagccgggcgatccgctgattcgcgaggacgtggcggccggtcatgagcatgagcgtgtgatctggggtcgtggcgccaccgatatgaagggttccgacgcggtcatgctgtatctggcggccacgctgacggacgcgaaatatgatctgacgtacgtgttttacgaccatgaggaagtcgcggccgagaagaacggcctgcgcaaggtggtcgagtcgcatccggattggatcaccggcgatttcgcgatcatcggcgagccgaccgattgcggcatcgagggcggctgcaacggcacgatgcgattcgacgtgatcacgcacggcgttgccgcgcattcggcccgcgcctggatgggcaagaacgcgatccacgcggcggccgagattctgaaccgtttgaacgcacatgagaaccgcgccatcgaagtggatggcctgacctatcaggagggcctgaacgccacgctgatttccggcggcaagggcaccaatgtgattcccgacgagtgccgtgtgcacgtcaactaccggttcgcgccggacaagtcgctcgccgaggcgaaggcgctgatgatcggcgcggatgcgggcgcgaaacttggcaacggcgagcatcaggccactggtggcgtgttcgaaggcttcggcatcgagatgaaggacgaatcgcccagcgcgcgtccgggcctcaattcgccgcttgcccaatcgctggtatcgcttgtcaaggaacgtatcggtcgtgacccgcttgccaagctgggttggacggatgtggcgcgttttgcgattctgggcattccggccgtgaatctcggcgcgggaagcccgctgctggctcacaagcaggacgagcagttgccggagaccgatctgctgctcatggccgacctgctggaggactggctgcgttgaatcgccgttaattcgctgccgcgggcttgccgcagaaccactattggtccaccgttgaaccgctgctgaaccactatgccggcgcacgttcattcacggcgtgtcaacgcgaatcattggaaaacggagcgtgtagggggaataaatttcccgtcctgtcacgctccgttgttttttgtgtcatacttatagacggtggttctgcaaaaccgccgacgcatccgatggcgttgatcccctcgcgtgaatgttctgtgagtcgcgagcgcaggtgtccgccgtcgcatgatgaagacttttgacggaagttgcttcctacgggcgccatgacgcgcggccacggtgagagcgtggtgtgagaaccgttggggcttgagtgaaggcgatgcgattgcagcgcgttgccgaggagcgttgtgcctactaccaatgagggcctcgatcaggtcgaggctgttgtgtcatccgataattcaaccaataatgcggcaagcagtgcgggttctgtgtctgccgatccggctccgcgtcgtcgtcgtgggggtcgccgcgtggtgcgtggcgtaggtgccgcgggcgcgtctttggagctgaaggtcgaggagcatgccaaagcccccttgtttgaggagccgaagcttgagcatgcccagcctgcgcgtgattccgctgatttcaatgatgccgatgacaccgagccgtcgcgtccgcgtcgtcgtcgcgtgacccgttacgatgacgacgatgagatgcgtgacgagcgtccgcgccgtcgccgtcgttcctccgtggacgtgcaggacgaggatgatcgcccgtcgcgtcgccgtcgccgtatcatcgacgagccgcgtgatgaccgtgacgatcgtgacgattacggcaatcgcggcaatcgtgacgaatcatccgaagaccgtgcgctcgacgccgtcagcgcgctgccggaaggccatgagacgcgtcacaacccgcgtccgatgacgtcgctgctgttccaggagccgattctgccggccgcccccgcgggccgcggatcgtccgacgatgacgatgccgacgatacgggccgcagaggttcggacgatgcccgtgacagccgtgatggccgcgacgatgaccgtccgacccgtcgccgccgccgtcgcagccacgacacggccgatgcggaccgcacggacgtttcgaatgacggtcgcggccgtgatgacggcaatgaccgcaacaacgacgccgaagacgatgagcatggcgattcccgccgctcccgtcgttcccgtcgtctgaacgcgcaggaacgtcgcgccgctgccgaagtggagcagatcgaggaggacctggtcctcgatggcatcacgtatgcgccgatcgatgacgagtcccgcaatggaaacgatgatgacgacgagcagccgacgcgcacccgtcgccgccgtcgcggacgcggcaaccatgaggaagccgacgagcagcagacctccgaacgcgaatcccgtcgccgtcatgaggatgacgatgaggaagagggcacggtgacccgtcgtcgccgtcgtcgccgtggaggttcgaaggccgaggaatcggacgagacgatgtcccgtcgctcccgcaagcagcagtacatcgacgagatcaccgacgtcgaaggatccacccgtctggaagccaagaagcagcgccgccgcgacaaccgtcgtgaacgcagccgtcagaaccagctcatggagcaggacttcctggcccgtcgcgaacacgtcgagcgtctgatggtggtgcgcgaacgtgagcgccacacccagatctccgtgatcgaagacaatgtgctcgtcgagcattacgtgtccgacatccaggaagtggccaccgtcggcaacatctatcttggccgcgtgcagaacgtgctgccgagcatggaggccgcgttcgtggacatcggccaggcccgcaacggcgtgctgtacgccggcgaggtgaactgggattccgcgcgtctggaaggccagccgcgtcgtatcgaactggcgttcaagtcgggcgatccggtgctggtgcaggtaaccaaggatccgatcggccacaagggcgcaaggcttacctcgcaggtcaccttggccggccgtttcctcgtgctggtgccgtccggcggcatgaccggcgtgagccgcaagctgagcgagcgtgagcgcgcccgcctgaagaacatcgtgtcgaagatcgcgccgaaggatatgggcgtgatcatccgaaccgcggccgaaggcgcttccgaagaggccatcaccaaggatctcgagaacctggtgcgccagtgggaacgcatcaccgccaagcgcgacgagttcctgcacggcaagcgtccgaagctgctgcaaggcgagccggacgtggccatccgcgtggtgcgcgacatcttcaacgacgatttctccaagatgatcgttgaaggcgaccgcgtgtacgagcgtatcgaagaatacctcgacacgatggcccccgacctgaaagacaagctcgagaagtgggatccggccgaacatgacggcaaggacgtgttcgacaagtggcagatcgactcccagttgcgtaagggcatggaacgtcaggtctacctgccgtccggcggttcgatcgtcatcgaccgcaccgaggccatgaccaccatcgacgtgaacacgggccgtttcatcggccgcggcaagagcctcgaggaaacggtgacccgttgcaacctcgaagcggccgaagagattgcgcgacagcttcgtctgcgcgacatcggcggcatggtgatgatcgacttcgtcgacatggtcatgccggccaacagggatttggtgctccgccgactggtggagtgcctggcgcgcgaccgcaccaagcatcaggtggccgaagtcacctcgctgggactggtgcagatgacgcgcaagcgcatcggccagggtctggtggaggcgttctccgaggaatgcccgacctgcaagggccgcggcttcatcctccatgacgaaccgaccgtttcggcggattacgacgatccgtacgccttgaagggcggcgatccgttcgtcaagaccaacaagcatggccatggcacggacgtgcaggtgccgaagggctcctcgccggacgtgaaggccaaactcgcgcagatcgcggcggcagccgtggccgccaacaatgcggacctgggcgaggaagaacaagaagaataaaggaaaatcccggtatgtcaacttgacacgccgggagcagacttgcggttgtacgcgggtatgtgtagattagattgctggtgtctggccgcgaggctcgaacgtgccgggcagtaagctttccaagttaataaaggaacggatatgtacgctattgtgaaggccggcggccatcaggaaaaggtcgaggtcggtgacgtcatcctcgtcaaccgtctcgacgccaagaagggcgacaccgtggaattcccggtcgctctcgttgtggatggtgacaaggtcaccgtcaacgccaaggatctcgccaacatcagtgtcaaggctgaggttgtcaacgatgaggccaagggcccgaagatcagcatcatgaagtacaagaacaagaccggcgttgctcgtcgcaagggccatcgccagcagctgactctcgtcaagatcacggctatcgcctgattcgcgtagggttagagtcaaggaccgaaaggaacagacatggcacataagaagggcgcgtccagctcgcgcaacggtcgcgattcaaacgcgcaatacctcggtgtgaagaagttcggcggcgaagccgtcgtggccggcaacatcatcgttcgtcagcgtggcaccaagttccacccgggcgagaacgtcggcatgggcaaggaccacaccctgttcgccctcaaggacggcagtgtgaagttcggcgtgcgtcgtgaccgcaaggtcgtcgacgtgattgccgcctgagacacgcgcaaataacgctttttgatgaaagaccgcgcccgttatggacgcggtctttctgctatgtaaggtagatacatgagtgattttgtggatcgagtgaccgtccatgtcaagggcggcgacggcggcaatggttccgccggcatccgtagggagaaatacaagccgttggccggtccgaacggcggcaatggcggcgacggcggttccgtgatcttcatggccgattcgaacgccaacagcctgctcgactaccgtttcatgccccatcgcgaggcggaaagcggcaccatgggcctgggcgacacgaaggacggttcgaagggcgctgacctgatcctgcccgtcccggtgggcacggtcgtgttcgaagccaagggaccgcagggcaagccgaagcatccgggcgagcagcttgccgacctgcgtcacgcgggagacaagttcgtcgtggccgcgggcggcaacggtggtctcggcaatgcggcgctggccaatcgcacccgtcgtgcgccgggcttcgcactgctgggcgagccgggcgaggaacgcgacgtcatcctcgaactcaagtccatcgccgacgtggcgctggtgggctttccgtccgcaggcaagtcgagcctgatcgcggcgatgagctccgccaaaccgaagatcgccgattatccgttcaccacgctcgtgccgaacctcggcgtagtggtggccggcgacatgcgctacaccatcgccgacgtgccgggcctgattccgggcgcatcccagggcaagggcctcggcctcgaattcctgcgtcatatcgaacgtactgaaatcatcgcccacgtcatcgattgcgccaccctcgaacccggccgtgacccgatgagcgactaccaggcgctcgaacacgagctcgccgaatacgccggcaagctcgaactgccgctcggcgcgattccgatccccgaacgtccgcgcatcatcatcctcaacaaggtggatgtgccggaagccaaggagctcgccgaattcgtcaagcccgaattcgaaaagctcggcctcaaggtccacatcatctccaccgcctcccacgagggcctgaaggaactcaactgggcgctggccgacctcgtgaccaacatgcgcgcggaagtcgccaaacgcgagcaggccgaggaagaggcccgtgtggtcatcaagccgctcgaggagccgcgcaatcgccgtcgccgtaacgacgaaggcggcaacgcgctcgatttcaccgtggaacgcaaggagaacggcaacggcgaagtctggtacgaggtgctcggcaccaagccggaacgttgggtcatgcagaccaacttcgataatgacgaggccgtcggctaccttgccgaccgtctggccaagctgggcgtcgaagacgagctgcgacacaagggcgccaagccaggcgacgaagtgcgcatcggccgtggcgaccgtgccgtggaattcgattgggatccgaccatcgcggccggcgcggaaatgctcgacggcacccagttgggcgcacgcggcgtcgacctgcgactgcaggaatcggatggtcgtgcgcagcgtcgttccaacacggaacgccgtcgccagtaccacgagatgatggacgctcgtcaggccgtgcgcgaagccatgatggccgaacgcaaggcaggacactgggccgatccttccgtggacgacgaccgtcacgacgaaaccagtctttttggacgtggcgagaccgccgacgacgaggatgtggaacaatagaaccatccaacgaagcccgctgatgtgccgatggcatgtcggcgggctttttcaatagccggtaacggtaccgggaggaactatgaacacgccatcgcaagcgcaagtgcgcagggccatcgccgaagcgcagaccatcgtggtgaaggtgggctccagctcgctgaccgagccgagcggccacttggatccgcaacggttgaacgcgcttgtggcggccatcgcccgcgtgcgattgatgggcggccgcgtggtgctggtctcctccggcgcgatcgcggccggtttcggcacgctcggtttcgacaagcgtccgaccgacgtggccgaccagcaggcgtgcgccgccgtcggccaaggcctgctgatggcccagtacgaggccgctttcgcacggtacgggctgcgtgtcggacagatcctcatcaccgtttccgacacgatcgccccacagcagtaccgcaacgtgcgccgtacgctcgaccgcctgctcgacttgggcgcggtgccgatcatcaacgaaaacgattccctcgcgtccaacgagatccggttcggcgacaacgaccgtctgtccgcgctgatcgccaacatcgtcgtcgccgacgcgctcgtcctgctcaccgacgtggacgcgctgtacaccgcgccgccaagcgagcccggctcgaagcgcatctcctatgtgccgaacgtcgaggatgcgctggcgaaggttcaggtcggcggaaccggctcgaacgtcggcaccggcggcatggtcaccaaaatggaggccgcgcgcgtcgccgcggtgtccggcattcccgcggtgttgacatgcgcgtcgaacgcaggtcccgcgatgatgggcgatccggtcggcaccgcgttcgcgccgatcaacgaccgcggttcgtcacgtaggctgtggatcggcttcgcctcccacccgcagggcgcgctggtggccgattccggcgcggccaaggcggtgcgcgggggagcggccagcctgcttgcggccggcgtggtggaagtgaagggcgatttcgccgccggcgacgccgtctgggttgacgacgagcagggcaaccatttggccaagggcctggtcggcttcgactccgaggagatcccgcagatgctaggacgcaatacggcccagctcaagcgtttccttggcgaggaatacgcgcatccgctggtgcaccgcgacaatctcgtactggtctgagccagtgcaaaaggtgtggttaggccatcgatttcgcttcaagcgaagcgttcgcggcgaaatagacgtgtgtcgtggggctgtcgtttttcgcgtggcaggtctagcattacaggcatgactatggctgactggcagactctatccgaccgtatcaatcacgtgactccgagcgctactctggccgtcgattccaaggcgaaggcaatgaaggccgccggaatcgacgtcatcgggttcggcgcgggagaaccgaatttcccaactcccgcaccgatcgtcgcggccgcggccgcggccgtgcaggacccgaaaaactaccgttacacgccgaccgccggcctaccggaactgcgccaggccatcgcggacaagacgttgcgcgactccggctacgaagtcgatccaagccaggtcatcgtgaccaacggcggcaagcaggccgtctacgaatcgttccagattctgctcaacgagggcgacgaggtcatcatccccaccccgtactggaccagctatccggaagccgtgaagctcgccggcggcgtgcccgtgaccgtgttcgccggcgccgaccgcaacttcgagccgagcatcgaggacatcgaggccgcgcgcaccgaacacacgaaggccatcatcgtgaacacgccgaacaacccgacgggcgcggtgtggaagccggaaaccgtcaaggccatcgcgcagtgggccatcgaacaccacgtgtgggtcatttccgacgaaatctacgaacacttgaactatgacggcgccaaaaccacgtacatcggcgccgcggtgcccgaagtgcgctcccagctgctcgtgctcaacggcgtggccaagacctacgccatgccgggctggcgcgtcggctggatgatcgcccccgtggacgtggccaaggccgcatccaaactgcagggtcacatgacctccaacgtgaacaacatctcccagcgtgccgccatcgaagccgtctccggctccctggacgccgtctacgagatgcgcgccgcattcgacaagcgccgccagaccatcgtcgccgcgttgaacgacatcgaaggcgtgaactgcccgaccccgaccggcgcgttctacgcgttcgccgacgtgaccgcgctgctgaacaagccgctcggcaccaacaagaccacgttcgccaacacttccgaactggccgccgcgttgcttgacgaaggccatgtcgccgctgtcccgggcgaggcgttcggcgctcccggctatctgcgcttctcctacgcgcttgccgacgacgatctggtcgaaggcatgcgtcgcatgaagcgttgggtcgaggactgagccgaccggccccgcgctcaactgacggaaagttcagttgatagacgatatttttagcgattcgcgcttcggtgacatgccgggcgcgaatcttttttttcgttggaaaatagcggtttcttgcgattcgtcgtgaatcgggttggacgaagtcgcgaaaacccgctattatttcgacttggcggttttgccgtctgcttcttgcgtggttttgcatagaatcctcgccggcaagtggagacggcagagttcacctagggaagtggcgcaattggtagcgcaacggtctccaaaaccgtaggttgtgggttcgagtcccgccttccctgccaagcttcttacaacaagcccagcggaggattattatggcgaaggcgaagaacagcgagaaggccattaagccgaacatcttcatgcgcattggcttgttcatcaaacagattatcgacgaactccgcaaggtcgtcactccgaccagcaaggaactgttcttctggtccctcgccgtgtttatcttcgtgctgctgctgatggcactggtcaccggcatggactacggtctgggcaagctgaccctgtggatattcggctgataaacaacttgaaggtgaaagtgcatgactgacgaagtgttttccgacaacctcgacgaggcttccaaggctgataccgaggctgctgccgctgttgaggcgctgccggccgaaggcgaggccgtccaggccgtcgccgccgatcaggcgaccgatgagcaggcccagtccgagcaggacgctccggaagagcagaccgcggaaaccactgaggatgaagacactgagcaggatgccggtgccaaggccgtcgaggaattctccaagagcctgcgcacgcttgaaggcaagtggtatgtgctgcacacctattccggctatgagaagcgcgtgaagaccaacgtcgaatcccgcgtggccagcttcggtatggaagacaagatcttccaggtcgaagtgccgatggaggaagtcgaaaagcacaccgaaaagggcaagaaggtcatcacccgcgtgcgtgtccccggctatgtgctgatccgcatgctgccggatgagaacgcccgtcgtatcgtccgcgagaccgaaggcgtcaccggctttgtcggcccgaccaaggatccggcaccgctgacccgcaaggaagtcgtctccatgatggctccgatgatcgcttccgaagctctcaaggccgccggagacaagccggccgcagccaagaagcgcaagcttgaggtctcctacgctcctggcgatcaggtcaccgtcaccgatggaccgttcaccaccatggccgcggttgtctccgaagtggatccgtccacgcagaagctcaccgtgctcgtgtccatcttcggccgtgacacgccggtggagctaggtttcaaccaggttgaaaaattagcctgaacgtgcatgacggagcgttagctgcgttgctccaagcttgacgcaccttggtacgcctgcgcttgggcgccttgctaccgcacgcgtcacacccattcaggaacctgaaatcgtgattcttttggaccccgcttcggcggggtttctttgtatgcattgccatacgcgcaatgtcgtggcggaatcgcataatagaaaagttgtgtctggagggtctcgtgtgcctgaacaaggcggcggcacctgctagcacagcacagcaatatacgttgcggaaggaaccggacgcgggagacctactccggtgccgttaaccaccgcttcacagaaagaagaaccatacaatggctcctaagaagaaagtctcggcgcttctcaagctccagattcaggccggcaaggccaacccggctccgccgctgggcccggctctgggttcccatggcgtgaacatcatggacttctgcaagcagtacaacgctgccacgcaggacaagatgggccaggtcatccctgttgagatcaccgtttacgaagatcgttccttcaccttcatcctgaagaccccgccggcagcagctctgctgaagaaggccgctggcatccagaagggtaccgagaacccgctgacccacaaggtcggctccgtcaccaaggctcaggtccgtgagatcgctgaaatcaagatggctgatctgtccgcacgcgacgtcgaagccggcatgaagatcatcgcgggcaccgcccgttcgatgggtatcacggttaccgactgagaggagaaggactaatggtacagcgttccaagaagtatcgcgaagcggctgagaagatcgatcgcaacaacctttacaccgccaacgaagccatcgctctcctcaagagcatgccggagtacaagttcgaccagaccgttgaggccgtgctgcgcctgaacgtggatccgcgcaaggccgaccagctggtccgcggttccgtgaacctgccgaacggcaccggtaagaccgccaaggtcctcgtcttcgcccgtggcccgaaggccaccgaagctctcgaggctggcgccgacatcgtcggtgacgacgacctcgtgcagaaggtcgccgacggtttccttgacttcgattccgtcgtcgccaccccggacatgatgggcaaggtcggccgcctcggccgcgtgctcggtccgcgtggcctcatgccgaacccgaagaccggcaccgtgaccatggacgtcaccaaggccatcaaggacatcaagggcggcaaggttgacttccgtgtcgacaagaacggcaacctgagcttcctcatcggcaagatgtccttcaccgagcaggctctggacgagaacttcaaggctgtggccgacgaagtcaagcgtctgaagccgtccaccgtgaagggccgctacgtcaccaaggcgaccatcacctccacgatgaacccgggcgtcccggttgatccggcggtcgttgcctgagtgcacagaagctaagcttcaccaaaagacccgtatctgcaatcgcagcatgcgggtcttttcatatgttcggaaagattcatgactttatgaccggatgacaggcgcaacgggcgtacccagacgccacaccacccgggcagcagctcagcggtcgcgcatacggccaatcgccagcgcggtcgtcagcacatacgcgtcacgcggatcggtggcatcccagccggtcgtttcggcggcacgcttcaagcggtagcgcacggtgttcggatgcacattcagctccttcgccgtgttctccaacgaactgccatacttcaggaacgtggacaccgtcagataagtgggatcatcgggattctcgccgcgcagcacctgatatacgttccgatacagttcctcacgcgcgtaatcatcacccagcagcgcacgctccggcaacagctcgtcggcacgcagcggacgggaaggagtggacagcgccggagccgcctgcagcgagaacatcgtctcacgcaacgcatgcgaagcccccgccacaccggaacggaccgggctcaaatacagtggctcgtcctcgctgaacgccggcatgaccgcggtacaggtcacctccggcgtgaccgcgcccatctggcaagccaaagccagcaggaaagtgccgtacgtgccgatgaccacatgctcgccacccaaatcgcgcaccgccttgcggatggcgagggatgtcgaggcaagactggccgaaggcaccccgccgatcgcaaaacagttgaaatcgccttgccatccgagaatgttcatcaaggagaccacacgatcgtcggtcatgttcgtcaacaggcattcgaaagccaaccgctcgatggtcgtatcgtcggtatggcctgacaaaaggtcgaggatgtctgcctgctcggagttcataaccgtccattctaatcgtcgtatctgcgaattgccgcacgttcgtcgaccgttccggtccccattcgcgcagtggcggtaatatgccgactatgagcgaaaacaagaaagccggaaaagccgacacgttcctcagctggacgttgggcgtgctcgcatgcctgtgggtggcgtggtgctgcggcatcggcccgctgtactggtttggcaccggactcgccgacttcggctgggccaacgtgctgtacatggcgatcgccttcgttgtttcgtttgctatattgtggtcgctggtccgttacggccgtggcgagcgcgtgttgccgacgtatttctcacgtcgatacgtcaagctgtgtcaggaggtgtccggcatgccgacgacggtattgggcatcatgctgcgccatctgagcgacgccgcgcatagccgaccggggcgcgccatccatgcggtgatcgtctggattggtcgcaagctgacacgttgcaccgactgctggtggaagctcatgctgctgttcgtcatcggctggctgtggattccgaccaccctgcttgccgcgtacggcgccgacatccgctcccagatccgcgaattcagctgggcgttgaaccagtggaccggactgaaacagccatacatcggcttcttctcattcgtgccgatggacatctatccgaccgcgcactacatgtggccggccaatcccacgtatctgaccgaccagcacaacatcgtgctgaccgttttctacggtgcgttcgccgcggtctcccggtatttcaccgattccaacgacgccggcatcgtggcgttggccgcgctgcaatggctgttcgccgcgttctgctgcgccgctaccgccaatcgtttcttcaatctgccgtggcgtaggctgggcgtcggcacgttcgacttctcccatcccgaacggcacgactgctggaacatgcgcgatttcacccatcccgaggcgggtgtggtggcgcgtccgtccagactgcgcgccggcgcgaagacacgcttcgtgattctgctgttcttcatggtgtgcccgttggcggtgttcgccacgatctcactgaccaaatcgccgttgttcgcgttcgcgttcgtctggtggttcggcgtgtggtatgagctgcatatgacgcatatcaaggcgctgcccaccatcaacggcaagcccatgaaactgcgcaaacgttccttggcggcactgttcatgtcgagctgcgtcatgctgatcagcgccaaatacgcgtggtacatcattctgttcgccgcgctgctggccatcatcaacgaccgtaaacgttggaagacgtacgtggtcgcattgatgctgccgaccgtgctcatccatggcggcctcgtctatctggtgaacagcggtgccgtcatcggcggcgatccgatcgaaagccgtggcatccagctgcagcagatcgcccgcgtggcgaaatacaatccgcagggcattcccgaggacgcggccaagaaactcgctcccgtcttcaacctcgaccagatggccgaatcatacttccagcaggacgccgacccggtgaaatcgtcgggcatccagtccaagaaggtcagctacaagtggcgtaccgtcaccaaggacgacatgaaggatttcaacgacgcatggtggcagatcgtcaaggcgaatcctcagatcgcgctcgacgcgctcttcgccgaatgcttcggatacttcaacgtgaccgacctgccatacgtgtcgatggactactacgtgaacaacgattacgtgcagtccgacaacgaatggattcacctatacaaccaccagtggcgcaaccaggtggccggcttcgccaagaaatggggacagattcccgtgcttggctgggtgacgcacggcaacctgtatgtcacgctgacactgctgatcggcgccgccgaagtggtgctgcgccgatggcggtcgctgtcatggcatctgccgttgctgctgcttatgggtgtgatgatcaccgcaccggccaacaatttcgaacggcatatgcttccgatcgcattcgtgttcggattcctgtgcctggagttctggcgcgagtcgcgtgccgcgcggcttgccgcacgcgaggcgtcgtacgttgtcacgtcgacggcgggcaaacggcgtattggcgggcgtcgcatcgacagacagcagtccgacaagcaggacgccgacgaacgatatctcgatggacgacagctcgacggacaggagaaggaatcatgacgaccatattggattccgcattgaccatgccacgcacctgcgtcgcggccgaccaggtgatcgcgctggactcagtgggctccaccaacacgtacgccgccgaattggtgcgcaaaggcgcgctgttcggctcgaccagccgagatggcctcgatggctgcgatggacgcgattggaccggccgtgaaatcgtggcgatctgcgccgacgagcagactgccggccgtggccgtctcgaccatcaatggaccagcgcggtgggggagtcgttcatcgtctccctggtggtcagcgtgcctacggcgattgtgcgggacacgtccgtcaacggctggctgcagatgatcgccggctgcgaggcgcgcaacgcgattatcgcggccatccgcgattgcggcggcccgctcggcaaggacatcgtgctcaaatggccgaacgacattttcgtcgacggcaagaaactgggcggcgtgctcgccgaaatggttccgcttgccgcaactcccatcgtggacggtacaactggtaccactgatgtggctgccgcaacggcacgcgtcggcatcgtcttcggcatcggcctgaacctgaccgtccccgaagaccatctgccaaccgacaaggccacgtcgctgcagctggtcgcgcatggcctgcccgattccatgacattgcgcgacatgatcgcggcccatctggtggacggtttgcgatcaaggctcgccgatttcgaagccgacccgcagcgtgaggccacgcgtgcgatggaggagatgcgtccggtctgctggacgctcggcaagccatgcgaggcgcatttcgtggacggcaccaccctgcgcggcaccgcgctggaactcaaccccgacgcctccctcaccatcagagacgacaacggcaacctgcacaccgtgcgcaccgccgacgtaggcgtcctaccccaataattctctaaccctcatccctcataaagtcgtaaagcgcttttttcgaaaatcgtacgtttcaaaaaaacgcaatattcgagaaaagcggcatttcccaaaatcgcaatatccaaaaaccgcgccacccgcaaacgcaacattcccccaaaacgaggtggggccggcggataccaacgtaagaccgtaaagactcggcctgagcggcccggagcgtgtcgcacgttggtatccgccggccccaccggacacagcgaaaacgaaaatcacagcgaaaacggaagactgtatcaaaacccggaaatcacgaagaaacccggaaatcacagcggaaattctcagcggaaaaccctcagcagaaaattcccagcaaaaagtcgtagaaaactaccgcagaaaagtcgctgccgataaaagtcactgcagctttgccagtccgctcgcgaccagcgaagccacaaccgccttgatgcaatcgcccacaatgaagcccatcgaagcgatggccaccaccggcatcgccacgcccgtaatggcggactgcacgatgaagccgagcagatagtcaagcacgatgcagccggccacgcaggcgaacagataccgtgcggcggtcaacacaacatgcttcagggaatcgacacgcgccttgcccttgagcagcgaggtgacgacggcggccggcaggaaaccgatgaggaagccggcgctcgggccgaccaaagccatggtggacgcgccgccggcgaacaccggcagaccagccgcgcccgcggccagatacatgagcaccgcggcgcccgcctgcttccacggcagcatcagcgcggccagcatgaccacgaaggtctgcagggtgatcggaaccggagtgcccggaatcggcacggcgcccgccatggaggcggcggcgagcagcacggcgaacagcgtggacttcaaaacggcgccgaatttgccgctggtggccgttttggccgcggatgagatggtcaggattgcgttgcgcatggtggaatcctcccttttttgcggatgctacaggatgctacaaaaactggcgaaaatgagtttttcgtcaatcaatgctccccatcgtagggttgctaagtttcggtaacgtttgtggagccttacaaaaagatcgcgaatcttttgtgggaaacgagttcgtcgaatcacgcctcgaccgccaaacttgacattatgcctaagaatgtcaacaaactactggtggcgaatcgcggcgaaatcgcgcttcgagtcgtgcgcaccgcacgtgagatggggattcccacggtcgcggtctacgccgaacaggaccgtcacgcacagtacgtgcagatggccgatgatgcgtatctgctgtctggcgacacctacaaggacacgtatctcaacgaggatctgctcatcgacatcctgcagcgcagcggtgccgacgcggtgcaccccggctatggcttcctttccgaagtcgcaagcttcgcgcagaaggtcctcgacgccggcgccacgtgggtcggcccgaatccgaaggcgctcgtcgacctgggcgacaagatcacggcccgccgcgtggccactttcgcgaaggtgccgccggttcccggcatttcccagtcgatttccgacatgcgactgctgctcgacttcgcgcacacgcacggctatccgctgatgctcaagcgcaccgacggcggtggcggccgcggcatcacgctcgtgcacaacgacgatgagctgcgtggcttctacatgaaccacgatgcgctgcagggcggcgatttggacgagtatttcgtcgaacggttcatcgacaagggccgtcacgtcgaaacgcagtgcggacgcgattcgcacggcaatttcaccgtgtattccacccgcgactgctccgtgcagcgccgcaaccagaagcttgttgaggaagctccggcgccgttccttcccgacggcgtgctcgaacagctggaaacctattcccgccgcctgttcgacgcggtcgattacgtaggacttggcacctgcgaattcatggtgaccgagcagggcaaggtctacttcctggaagtcaatccgcgtctgcaggtggaacacaccgtcagcgaagaggtctgcggcctcgatttggtgcgagaacagctcaccatcgccaacggcggcgagctaaccgtcgaccacccgctgcgcggacacagcttcgagctccggctgacctgcgaggatccggcgaagaatctggcgccgagctccggcacgctcacctcgctcaagtggccttccggaccgggcatccgcgtggattccggtgtggtggagggcgacaccatctccccgaagttcgattccatgatgggcaagctcgtggtcaccgcctccgaccgtgctgccgccgtggcgcgcgtacgccgcgcgctcgcggaacttgaggtgcaaggcgtgccgaccccggcaagcctgttcgagctgatcttcaacgacgacgagttcaccgccgagcatggcgtggcctacgacgtgagcacgaaatggctggaacgcaagtacctgaacaaggaagcatcctccaccaagggcggccagccggcatccatggccggcgcttcgggtgcgaaggaagccgagcagaaggaatccagcgaaaccttcgtcatcgaagtcaacaaccatcgtgtgtcgctgaccgtgccgaacgacatcgtggccaatctgaccggcggcgccaaggcgcgtgacgccaagcgcgccatccagccgctgcgcggacagggcctgcaccacgtcgaaaagaagcagcagggcaacgacggccagtccggtgtgatcgccagcccgatgcaggcggtcgtcacacgcatcaacgtcgccgaaggccaggacgtggccaagggcgacctgctcgtcgtgctcgaatccatgaagatggagaactacgtgtacgcgccggtcaagggcaccgtcaccaagatcttcgtcggcccggcggcaggcatcgaagcgggcgagacgttgatgaccatcgacgtcaacggcgcttccaaggcggctgacggcaagccagcaacggacggtaatacggaaaccaagacggaaagtggcgtgaaatgaccgacatcatcgcaagcccggccgtcaaagaggccgtgaaggtcgtcatggaacagcaggagcgactgggtgacgaagcggctgccgaagcccgcgaatcgcagccgatccgtacgtccgtgctgcgtgccgcgcagctcgccgccgaagccgaagaccatgcccgcggtcgccagcacgtcaaaggcaagctgaccgcgcgcgaacgtctcgatctgctgcttgataccggttccttcgaggaaatcggccgtttccgcggcggcgacatcaacggtggccgcgcaggctccgccgtcatcaccggcttcggcgaggtgttcggccgcaaagtggccgtctacgcgcaggacttctccgtcaaaggcggcacgcttggcgtggccgaaggccgcaagatctgccatctgatggacaaggcgctcgacctcaaggtgccgatcatcgcgctcatcgactccggtggcgcgcgcatccaggagggtgtggccgcgctgaccgaatacggccacctgttccgcaaaacctgcgacgccagcggtttcgtgccgcagctatcgctgatcctcggcccctgcgccggcggtgccgtctactgcccggccctgaccgacctgatcatcatgacccgcgagaattccaacatgttcgtcaccggtcccgacgtggtcaaagcggccaccggcgaagtgatcagcatggacgatctgggcggcggctacgtgcacaacgccacgtccggcgtggcccactatctcggcgaggacgaggcggatgcgatcgactacgcgcgtaccgtgctcgcctatctgccgtccaactccgaccagcagccgccggtctacgcgtacgcggccacccgcgccgaccgtgacgtggccaaacgcctcgccaccctcgtgccggacaacgaccgccagccgtatgacgtgctcgacgtgatccgctgcatcgtggactacggtgaattcgtgcaggtgcacgaactgttcgccgcttcagcggtggtcggcttcgcctgcatcgacggccatcccgtcggcatcgtggccaaccagccgaacgtcaacgccggcattctcgacgtcgactcatccgaaaaagtggcgcgattcgtgcgcttgtgcgacgcgttcaacctgccggtcgtcaccttggtggacaccccgggctacaagccgggcgccgaacaggaacatgcgggcatcatccgccgtggcgcgaaggtcatctacgcctacgccaacgcgcaggtgccgctcgtcaccatcatcctgcgcaaggccttcggcggcgcatacatcgtgatgggttccaaatccattggcgcggacatgaacttcgcctggccatccagccagatcgcggtgctcggcgcggccggcgcggtgaacatcatccaccgcaaggatctgcagaaagccaaagacaacggcaaggacgtcgaagcgctgcgcgccaagtacatcgccgactacgaacgcaccaccgtcaacgcgaacctttcgctggaaatgggtgagatcgacgccatgatcgaccccgaacagacacgcgagaccatcatcgaatcgctccgcctgctcgccagcaagaaacgcgtgcgccgaaccagcaaacaccacggcaaccagccgctgtgacggacgcaacgcgacgcaaccaacgtaagcaaccacaacaatcgcaagaaattttggaacaagtaaggaagattatgaacaccttttttcttgatcgactgaacagcgagccccacgcgctcgccttcgccggccaatccaccccgtggccggtggcgctcgccgaccagagcgcgaatccggcgctcgacgaggccctgcacacccatgcggccgccgcgcaggcgctgctgtatccggtgtccgccgagctgctcgccaccaccggacgcccggtcgacctgttcggcttcgaaccgaacccggcacgtctgggcgccgcagccgcggcttccgccagcgttccaggcatcgcgctgacccagctgggcgcgctgctcgacgccgccgcactcggctacaatccggcccaggccaagccggtcgcggtgctcggccactcccagggcgtgcttgccgtgcatatggtgcaggcgatctgcgaagccggttccatcgacgcagccgcagccaagatcgacgagattcttgcgatcgcaacgctgatcggcgtcgccggcacccgtcaggcacgccagctcggtctcgccgcacgccacggcgaggcgaccccgatgctgtccgtcaaggacatcacccgcgcccaggtggacgcgctgatcgaacgcgtcgacggcgcacatggcccgatcgccgtggccgtcaccaattccgccacgcattacgtgttgtccggctatccggaggacctggccgcattcggcgtggaggtcgccaaggaacacaagcgtcaggccaagctgcgcgaggagaaggtgcgtggcggccgcgtgttcggcccgacgctcgaatatctcgacgtgaccctgccgttccacagcccgctgatggccgatgccgtctcccaggccgtcgcatgggccgaggcctgcggcatcaacgccgaccatgcccgtgagctcgccgccgaagtgctgctcaaccatgtggattgggccgcccgcgtgcgcgtcctgatgaagtccaccgatccgagcgccctgtgggtgctggacttcggtccgggcaacaccgtcggcaaactgttctccaccgtggcccagggcaccggcgtcggcgtggtggaagcctccaccgtggccgatcgcggcgcgctctccacgcttgagaccctgccggaacgcacccagaactggacgcgtttcgcgccgagcatcatccacacgtccgccggagacaaggtgcgcaccgcgttcaccgaacttaccggcaaggctccggtgctgctggccggcatgaccccgaccaccgtggagccggagatcgtggcggctgccgccaacgccggctactgggccgagctcgcaggcggcggccaggtcaccgccagcgtgttcgaccgtcacgtggccaagctcgaggaagaactcgaggaaggacgcaccgtcgaattcaacgccatgttcatggaccgctacctgtggaacctgcagttcggctcccagcgcatcgtgccgaagaagcgcgccagcggcacgccgatcgacggcgtcgtcgtctccgcaggcattccggaattcgacgaggccgtggaactcatccacaacctcaacgccgacggcttcccgtacgtgagcttcaagccgggcaccgtcgaccagatccgccaggtggtgcgcatcgccaaggccgtcgcgccaaccaaggtgctcatcgaggtcgaaggcggctccgcaggcggccaccactcttgggaatcgcttgacgatctgctgctgagcacctacgccgaagtgcgcgagcagtccaacctcgtgctcgtggtcggcggcggcatcggcacgccggaacgaggcgccgactacatcactggcgaatgggccgccgaatacggccgtccgctcatgcctgtggacggcgtgcttgtcggcaccgccgccatgaccgccaaggaagcccacaccagccccgaagtcaagcagatgctcgtcaacaccccgggcattccggtcaagggcgatggcaacgatccgttcgccccgctgggcgagcagtgggtgccgtccggccaggccaagggcggcgtcacctccggtctgagccacctgcacgccgacatctacgagctggagaactcctccgcccgctgcggccgcctgctggtgcgcgtcatgaagcacccggaggagctggaaagccgtcgcgacgagatcatcgcggcgctgaacgccaccgccaagccgtatttcggcgatctgaagaccatgacctaccttgagtgggcccagcgtttcgccgacctctccttcccgtgggtggacgaaacctacgccgatcgcttcctgcacctgctgcagcgcatcgaagcccgcgtcaccacgcaggaaagcggcgaattcgcatcgctgttcgcttcccgcgctgacgtcgaagccgatccgaacgccgcgatcgccaagcttgccgaaacctaccagcaggccggcaaactgaccgtcaccccgatggacgaggcatggttcccggtgctcgtacgcgagtatccgaagccgatgccgttcgtgccggtcatcgacaacgacctgctgcgttggtggggccaggaccagctgtggcagtccgaggactcccgctattccgccgattccgtgcgcatcatccccggcccgatctccgtggccggcatcaccaccgtggacgagccggtggccgacatcctcggccgcttcgaagccgccatggtcaagcgcgtgtccgccgaatcggcgagcgccgacaagaccgccttcgcccagttgggcgcggccgtctccgccgaggaattcatccgcaaatccccgaacatctcctgggtcggccacctcatggccaacccggcgtacggcaccgccaacggcgacgccaactacgagatccgcaaggtggccgttgaaggcagcgtcgaaaagtacgacctcgacatccatctcgacaccttctgggacaacgatccggacggcggcgcctccaagcacgccgtacgcgacatcgtcattccgctgaacgtcgacggcaacgaatccggcctgttcccggtcgtggaccgcgaccgtctgccggagcacgtctaccgcatgctcgccgacaccgcgggcatcggcaacaccgccatcaccggcgacaagctcaccgccatgccgcagattgaggaagtgtccgacaagaccgccttcccgttcggccaggcgcacaccggctacacgctgtccgccaacctcggtttcgaccatgaggccgccaccggcggcgcgctgccgagcgacctcgtgccgtcccgcatcgccccggacgcgcttgtcggaccggcttggcccgccatctacgcggccctcggctccgtgtacgtcaacggcttcccggtcatcgaaggcctgctcaacgccgtgcatctcgaccacctcatcgaactcgaggtgagcgaggacgagctgctgaagcacaccggcgagcgcatcgagctcaccagctgggccgacgactacttcgaatccgcttccggccgtgtggtgaccatccacgtcacgcacaccgctcaggacggtacgctgcttgccaacgaaaccgagcgtttcgccatccgcggccgcgcgtactccgacgcgctgccgccggaagcgcccgactatggtggaatcgaagccgaaatcgaaagcactccgcgccgtctgctgcgtcgtgtgaaggtcgtcgctccgcacgagatgaccgctttcgcccgtacttccggcgatttcaacccgattcacacctctcatcgcggtgccgccgtctccggtctcgccgcgccgctcgtgcacggcatgtggctgtccgccaccgcccagtacgcggtgcaggcgctcgacgagaagggcgcgcattacgagatcgcaggctggacgtacaacatgtacggcatggtgcagctcgacgacgaggtggagatctccatcgaacgcgtcggccgtgtggcccacgccggcatggtgctggaagtgaccagccgcatcgacggcaatatcgtgtcccgtggcaccgccatcgtgcgtgcgccgaagtccgccttcgtctacccgggccagggcatccagaagcagggcatggtgctcgacgagcgtgccaagtccccggccgcacgcgaggtgtgggagcgcgccgacaaggtgacccgcgagaagctcggcttctccatcctcgccgtcgtgcgtgataatccgaaggaactgaccgccaacggcgtgacctaccgtcatccggaaggcctgctcaacctgacccagttcacgcaggtggcgctcgccaccgtggcgttcgcccagaccgctcgtctgcgcgaagccggcgcggacatctggcccgcctacttcgccggccactcgctgggcgagtacaacgcgctgagctccttcgcaggcgtgattccgctggaaaccgtgctggagctggtgttccaccgtggctccaccatgcaccacctcattccgcgtgacgagaagggccgttccaactaccgtatgggcgcgctgcgtccgaaccagttcggtgtgggcgacgacggcgtgcgcgaatacgtcgaatccgtttcgaaggcttccggcgagttcctggagatcgtcaactacaaccttgccggacagcagtacgccgtggccggcaccatcgccggtctgaaggcgctgaaggccgattccgcccgtcgcgtcgccgaatacggcggcaagccggcgttcatgctggtgccgggcatcgacgtgccgttccattccacgctgctgcgcaagggtgtgccggagttccgcgacaagcttgacgcgctgctgccgaagcacatcgactaccgtggccgtctggctggccgttacattccgaatctggtggccgtgccgttcgagatgaccaaggaattcgccgcgaagatcctcgaggtcgtgccgtccgagcgcatcaaggccgcgttggacgatccgaaggtgtgggattcctacgccgaggacgaccagaagctcggccgtctgctgctcaccgaactgctgagctggcagttcgcctccccggtgcgttggatcgaaacccaggcgctgctgttcggttccgccgaacagggtggccttggcgtggaggagtacgtcgaggtgggtctcggcaacgctccgacgctcgccaacctcggcgccaagacgctgcgcctgccgcagttcgccggctgtgacgtgaccgtctacaacgtcggccgcgacgaaggccgcgtctacatgaccgattccgattccctcgttgccgacgacgatgctgacgattccgtcgcagcaccggcagcagcttcggctccggccgctgccgccgcagcgcctgccgcggtcgccgcagcacccgtcgccgcagccccggctgccgccgcaccggccgcacctgccggcgctccgtccggcgccgcagtcgcggatattccgttcaacgcttccgacgcgatcgccatgctgctggcatattcggcgaaggtgcgtccggaccagatcggcgaatccgacaccaccgacaccctgaccaacggcgtctcctctcgccgtaaccagctgcttatggacatcagctccgagctgggcgtggcttccgtggacggcgccgccgaagcgaccgtcaaggcgctgagcgcgctggtcgacaaggtggccccgaactacaaggcgttcggtccggtgctgtccgacatcgtccgcgaccgtgtgcgcggcctgttcggcgccgccggcgtgaagctcggccagatcaccaagcgcgtgaccgacacctggcagctcggcgaaggctgggcctcccacgtggtcgcagcccttgtgctggaaacccgcgaaggcgccagctcccgcggtggcgacctcgcctcgctgagcaccgaagccgcttccaatgcggccgccgccaacgcgctgatcgacgcggccgtgcagaaggtcgcttccgacaagggcgtggccgtcgccatgccgagcgcaggtggcgcagccggtggcgccgtggtcgattccgcagccctggacgcgttcgcggccaaggtgaccggtgccgacggcgtgctcgcctccaccgccaagttcgtgctgaaccagctgggcgtcaccgcttcggtcgccgacgattccgccgacgagaacgccgccgtggtggccgccgtcgaagccgagctcggctccgactggccgaagcaggtcgagccgcgcttcgacgagcgcaaggccatcctgttcgacgaccgttgggcatccgcacgtgaggacctgtcccgcgcctactacgacaacgacgcctccgcactggacggcagcttcatcggcctgggcaaggccgtcgccgatgaagccgcatggtatgcgggcaagaccgctgacgccgagcttgccgccgcgttcaagcgcgtggccgacgaggcgctcgagcagacgaacgattccgccgaagcaagccgcttcgcaggcgatatcgccgtcgtgaccggcgttgccccgaactccatcgccgcacaggtcgtcaacggcctgctcgccggaggcgcaaccgtcgtggccacttcgcacagcttcaggcagagcgtgaaggcctgggccaagcagacctaccgcgagcatgcggcaggcgacgccaagctgtggctcgttccggcgaacctgtccagctaccgtgacgtggacgctctcgtggcgtgggtcggcaacgtgcagaagaagacctccggcgcgaccaccacgatcctgaagcccgcctacgagccgagcctgttcttcccgttcgccgctccgccggtgcacggcacgttggccgattccggcgagctgttcgaatcgcaggcgcgcctcatgctgtggggtgtggaacgcgcgatcaccggcttcgcgaagatcggcgccgacaccgacgtgcagcacaagctgcatgtgatcctgccgggctccccgaaccgtggcgtcttcggcggcgacggcgcgtacggcgaggtcaagagcgccttcgacgcgatcgtcaaccgcgcccgcgccgaaaaggtgtggtccagccgcgtcaccttcgcccatccgaagatcggctgggtgcgtggcaccggcctgatgggcggcaacgatccgctggtcgaagtcgtggaacgtcacggcctgaagacctactccaccgccgaaatcgcggtcaagctgcttgagctgtccaccaaggaatcccgcgagcaggccgtcaagtccccgctcgacgtggacctgaccggcggcctcggcagcgagccgatcgacatcaaggcactgcgcgccgaagccatggaggacgcggccaaggccgctgccgccgaagccggcgatgaggacaagcagggcgattgtgccgctgcggcaacgctgatcaaggcgctgccgagcccgcgcgccccgcgtcaggcgaaggtcgatctgaaggattggcagcacgtcaccgcccgtccggaagacgagatcgtcatcgtctccatcggcgagctgggtccgtggggctccggccgcacccgtttcgaagccgaactcggcatccactccgacggcaaggtcgacctgtccgccggcgcggtgctcgaactggcttggaacatgggcctgctgacctggaacgacagtccgaagccgggctggtacgacaccgacggcaacctggtgcccgaagaggacatcgccgaacgctaccacgatgaggtcgtggcccgctccggcgtgcgtccgttcgaagagggcatgggcaacgattacaaggacggtgccgacgaggaggaggccgaggtgttcctcgaccacgatgtgaccttctccgttccgacctgtgagatcgccgaggaatacgtcaagctcgacgaagcccacaccagctacgcggccgacgccgaatccggcgagtggaacgtcacccgccacgccggctccatgatccgcgtgcctcgccgcgcggccatgacccgcaccgtcggcggccagttcccgaagggcttcgacccggtcaagtggggcattccggcctccatggtcggcgacgtggacaagatcgccctgtggaacatcgtcaccacggtcgacgcctacctgtccgcgggcttcaccccggccgagatcctcgaagccgtgcacccgtccatggtggcctccacgcagggcaccggcttcggcggtatggcctccatgaggaagctgtacctcgaccggttcctcaaccacgagattccgaccgacatcctgcaggaagccctgccgaacgtcgtcgcggcacacgtgatgcagtcctacatcggcggctacggcaacatgatccagccggtctccgcctgcgccaccgccgccgtctcccttgaggaaggcgccgacaagattgccctcggcaaggccgacttcgtggtcaccggcgcgatcgacgacatcggcgtggaatccgtgatcggcttcggcaacatgaacgccaccgccaactccgaggagatgtacgccaagggcatcgacgcgcgcttcttctcccgtgccaacgaccgtcgtcgcggcggcttcgtcgaatcgcagggcggcggcaccatcctgctgacgcgcggtgacatcgcgctgaagctcggcctgccggtcgccggcgtggtcggattcgtccactcctacgccgacggcgcgcacacctccatcccggctccgggactgggcgcgctcgcagcgggcatgggaggcaaggactccaagctcgtgcatgacctcgccaagctcggcgtcacgccggacgacatcgccgtggtctccaagcacgacacgtccaccaacgccaacgacccgaacgagtccgaactgcacaacacgctggcccacgccatcggccgcaccgacggcaacccgctgttcgtgatctcccagaagtcgctcaccggccacgccaagggcggtgcctgcatcttccaggtcaacggcctgacccagctgttcaagtccggcgtcgttccggcgaacgcggccctcgactgcgtcgacccgaagctcaagcgcgacgaccacatggtctggctgcgcgagccgctgaaggtcggttccgtcaaggccggcctggccacgtcgctcggtttcggccacgtctccggcttcgccgcgatcgtcaacccgggcgccttcgaggcttccgtggccaacaccgcgggcgaggacgcgctgaacgaatggcgcgaccgtgccaacgcacgtctcgccgccggccagcgtcgccttgaagagggcatgatggggcgcgccgcgctctacgagccgattgacaaccgccgcttccacgaggacggccgcggctacgacgcgcacgaggtggagaaggccatgctgctcgatccgaacgcgcgtctcgcgtccaccggctatttcgaagcgtgagacggctacgtcgaaatctgtcctaaatatgggcaaatgatgacggcctgataagaaaagggcgatacttctgcacagatgtatcgcccttttccatatgacatggtcggggcattcccggggtaaccccgattaataattcctaggaaggcggaggaatgctgggtctagggcatgacgtcgttgacgtgcctgcgttcgccaagcagctgaatgagccggggacgcgtatgcgcagtctgttctccatgcgcgagatatggcagacggcgcaacggtcgcagctcaagcatgatgacgaggcggtgcacctcgccgcccgctgggcaggcaaggaggcgttcctgaaagcgtggtgcgcggccatttcgcggcatgcgaaagacggcgtcgaagtcgcatatccgtacacgctcgacaacttcccatgggtgcgcatcgaaattctcgacgattcccacggcgtgccgcgcgtcatactgtcctccgaagtgcaacgcaaggtgcagcagtcgttgggcctgccgttggatccggtgcgccagtcgtacgatatctccatctccataagccatgacgggccgatcgcctccgccgtggtcatgctcgaaatctgaaatgccattcccgcttgcaaaagttggtgggatgtgtataatagctcgagtcgtttcgtgtcggcttcggacgtagcggcaacacgcggatgtagctcaatggtagagcctcagtcttccaaactgattacgcgggttcgattcccgtcatccgctccacaacagcatcagagaagaagaaggcgtgcctcaaggcacgcctttcgtatatccgtatgcccgggcatgcgattgcccgggtatgctggaacgggccgcggcgtgcggcggcgcaatcgcaagatatcgcaatatatacggagcggaacatgggtcagaaggaacgcaacaaggcaacggaagtcgtggatggcgtggtcgagaccgtcgacgtctccaagcacccgacggcgtccatcgaaccgtcggacctgtccttggccgacatcgaacgccgcaaatcgcatccggtccgctggattctgttcatggcattggtgctgctggccatgatcgcgccgtactggtggggacgcgacatcgcggtgcgggacgcctcatggatggtggcgaacctgaatttcctcgatcccaaaggcgtggcgctgatttcatggacggtgaccatcgtggcgctcaccggactcggactgatggtcgcggacgcgaagaaatggctgtgggggaccattttcgtgatcggccttgccgcggagcaattcgtcgccggcatgtgcctgctgagcttcaacttctggaacgccacctacgtgatgtacggtgaggcggccggactggcgaacgccgcgaatctcggcatcatcgccgccggtttcggtgtcgcggtctacgcggtgctctgggtgggcctgctggtgtgcatcaagaaggaatcgaagctcaacgtcctcacacgcagctgggcctcgttcctattgttcttcgcaatcgagctcgtcgcgcttgccgtggtgttgttcggaggcctgctcgcgtccatggcgtgacgtgaagaacggccgtcggcgggggaccggaaatatcggccggcgattttggtccggacgtcgtgtaagatgttcccttggcgtgtttcgcccgcggatagagagcgcgtcggtattgggccggcagcaccgcgcagcaatataaggaggatgccgtggcacttacggctgaggaaaagcaggaaatcatcaagacctacgcaacccacgagggtgacaccggctccccggaggtccaggttgctctgctcaccaagcgcatcgctgatctgaccgagcacctcaaggagcacaagcacgatcaccactcccgtcgtggtctgctgctgatggtcggcgaccgtcgtcgtatgcttgattacctcaagcgcgttgacatcaaccgttaccgctccctgatcgagcgtctgggtctgcgccgataacattcttccgcccgagcgtcacatggcgcccgggcgttttttgcatgacagccgagttcaaggaacagacagtttgaaggcccgaggtttggggcgcacgaggtctagaatctagagatgaggaagcggcggaggtaacgccgcgtcacgcatgtaggaatcggttggagtccgctgaagaggactgccgatagtaggtacacaagaaaagaaaacaaaggaggaaccctatggagggtcccgaaatcaaggctgttgaagccgtaatcgataatggttcattcggcaagcgtacgctgcgcttcgagaccggtcgtctcgcccagcaggcggatggtgccgtcgccgcctatcttgacgatgattcgatgattctgtccacgaccaccgccggttccagcccgaaggagaactacgacttcttcccgctgaccgtggacgtggaagagaagatgtacgcagccggcaagatcccgggctcgttcttccgccgcgaaggccgtccgagctccgaagccatcctggcctgccgcatcatcgaccgtccgctgcgtccgctgttcccgcacaccctgcgcaacgaagtgcaggtcgtcgaaaccgtgctcgccgtcaacccggatgacgcatacgacgtcgtcgcactgaacgccgcctccgcctccaccatgatctccggtctgccgttcgaaggcccggtctccggcgtgcgtctggccctgatcgacggccagtgggtcgccttcccgcgctggagcgagcgcgaacgcgccgtgttcgaaatcgtggtcgccggccgcgttgtcgagaacggcgacgttgccatcgccatgatcgaagccggtgccggcaagaacgcatggcatctcatctacgacgaaggccagaccaagccggacgaggaagtcgtcgccggcggtcttgaagccgccaagccgttcatcaaggtgatctgcgaggcccaggccgagctcaagaagatcgccgcgaaggaaaccaaggaattccagcttttcccggagtacaccgaggatctgtacaaccgcatcgacgagatcgcccacgccgacctcgacgaagccctgtccatcgccgaaaagctgccgcgccaggaccgcatccacgagatcaaggaaggcgtcaaggccaccctcgccggcgagttcaccgacatggaagacgccgagaaggacaaggaaatcggcaacgcgttcaaggagctgcagcgccagatcgtgcgccgccgcatcctgacccaggactaccgcatcgacggccgtggcctgcgtgacatccgcaccctgtccgccgaagtggacatcgtgccgcgcgtgcacggctccgcactgttccagcgtggcgaaacccagatcctgggcgtcaccaccctgaacatgctcaagatggagcagcaaatcgacgcgctgtccggcccgcagtccaagcgctacatgcacaattacgaaatgccgccgtactccaccggtgagaccggccgcgtcggctccccgaagcgccgcgagatcggccatggcgccctcgccgagaaggccctcgtgccggtgctgccgagccgtgaggagttcccgtacgccatccgtcaggtctccgaggcaatcggctccaacggttccacctccatgggttccgtctgcgcctccacgctgtccctgctcgccgctggcgttccgctgaaggctccggtcgcaggcatcgccatgggcctcgtgtccggcgacgtcgacggccagcacatctacaagacgctcaccgacatcctcggcgccgaagacgccttcggcgacatggacttcaaggtggccggcacctccgaattcatcaccgccctgcagctcgacaccaagctcgacggcattccggccgacatcctggcgtccgccctgcagcaggccaaggaagcccgcaccaccatcctcgaagtcatcaacgagtgcatcgacggcccggccgagatgagcccgtacgcgccgcgcatcatcaccaccaccgttccggtggacaagatcggcgaggtcatcggcccgaagggcaagatgatcaaccagatccaggaagacaccggcgccgaaatcgccatcgaggatgacggcaccgtgtacatctcctccgaaggcggcgaggccgccgagaaggccaaggagatcatcgaccagatcgccaacccgcacgtgccggaagccggcgagacctacaacggcaaggtcgtgaagaccacctccttcggcgccttcgtgaacctgaccccgggcaccgacggcctgctgcacatctcccagatccgcaacctcgccaacggcgagcgcatcgacgccgtcgaagacgtgcttaaggaaggcgacaccgttgaggtggtcgtgcagggtgttgacgatcgtggcaagatctcccttgccatcccgggcttcgaggatcaggaatcctccgctccgcgtcgtgaccgtggcgatcgcgatgaccgccgtggcggccgtggccgtcgtgacgaccgacgtcgttccgacgatcgcgatgatcgcgattacgacgatcgtccgcgtcgccgccgttccgaccgcgatgacgatcgtgattatgatgatcgtccgcgtcgccgtcgttccgaccgtgacgatcgcgactacgatcgtgacgatcgccgttcgtcccgttccgatcgcgatgatcgtgattatgatgatcgtccgcgtcgccgtcgttccgaccgcgatgaccgtgactacgatcgcgatgaccgccgttccgaccgtcgccgtggtagccgtcgtgacgaccgcaacccgcgttacgccgccgacgagaactacgacgagtaccgtgccgatcgcgaagagcgctccgagcgtccgcgtcgccgcgtgcgccgcgacttcgatccgttcgaagactgacgtcttctcacggatccttcgcagcgaagctgctcacttcacctacgagaagcccactgggcttctcgcttgacggctcagcattcgaagactgacgtcttctcacggattcttcgcagcgaagccgataggtaatctaacgaaaaacccactccgtaaggggtgggtttttcgtacgttcaacatgctgtgcgaatattggcatcaatcgatttacgggtgcatggaaaaaccgacaatacaacgaaatgtgtagccctcatgcgaaaattagacaaataaacaagcaaagaagcaaggattttcacatgatattcggcattattgcactcattgtcatcgtcctgatagtgctgtggggagtgtccgcctacaacagtctggtcacattgcgcaatcgcgtcaaaaacggctgggcgcagattgacgtgcagctcaagcagcgtgccgacctcattccgaatctggtggaaactgtcaaaggctatgctgcccatgaatccgacgtgttcacgcaggtgacgcaggctcgtgccggcgtcatccaggctgcgcaaagcggtgatgtgcagcagcgcatccaggccgagaaccagctgagccgtgcgctggtgaacctccaggccaccgccgaggcatatccgcagctgcaggccaaccagaacttcatggatctgcaggggcagctcaaggggctcgaggagaaaatcgcctacgcccgccagttctataacgatgtggtgcagaagtacaacaccaagatcgaggtcgtgccgaccaacatcatcgccggactgttccacttcgagcaggcggcgtacttccaggtcgacgaagcggaccgtcaggctccgcaagtcaagttctgaacgtttccatacaagaaaggggagcgctgacgaggtgtgatgtcttgccagcactccctttcctgtattacggtccgttgacgccgaaaccatgcgttggtgcttgaggacccttgagagagaacagagataccgccgatgaatatcagacgtacgttggtcagtctgctgtccacgattgtggtcacgttgacgatgttgggcatcgtgctcatcaatgcgcagacctccgatgaggaacccgatttaagctaccgcacgcttgactacgacgtggcggtgcagaggaacggcgatctcaaagtcacgcagcatatcgacatgaggctgaatgaccgtggctttgattggaaacagatgtaccagcagtacacgctaaaagccaataatctgacgaatatcagtgatatcagcgtgaaggatgtcaccaacaacgaaacgtacatccaaggtagatttgtgaatcccaatgatgtcaccgattggaacgctgaacacgcaggtcagtggtatatcgcggatgtcagcgtactcagagatccccaaccgttcaatcctgaaacagatggtttgaaagctgactcctcatccgataagactttggaaatcggctggaacattccggaaactgcgtccgctgacagcctcaaattcgacgtgtccatgaccatgcatggcgtaagcaccgcctatgacgacgtcgtctctttccaatgggagccattcggcacgacaaaccagattccgattggcaaggtggccggcaaggtcacgttcccagacggcgtcaccaagaagaattcttgggcatggctgcataccaagaacacgtccaccgcgaaacgcgacaagaacgggttgctgctcttctcggccgatgacgtgcgtgcaggcgactatctggacgtcgtggccatgttcgatgtctcgaaatcgcaaggtgtggaacgcaagataagcggcaaccacaagcaagagctcatcgatagcgaaactcagaaagaggaggaatggcgcgataagcagcatgatcaagcggtcaagcgagtgaccggttgggctgtttcggccctgatcggcctggcgttcattatgggatcgctgtacctcggtatcaccagcttccgtaagtcgcaatacaaaggcgatgtcgaatattaccgcgatttgccctacatgagtccggccgccgcggcacggatgaatgatgtcatgagcgcgtcatcttcgattctcggttcaggcaaaataaaaaacggcgacaaactagtcaatcggcaaatgtcctccactgtgatgtcgctcgcgtcaaaaggggcaatcgccatctatcccggaccggcgaaactgtatgacggcatcgacctgaccacgaccaacgcggcatcagtggcgggcaggctcggctccgacgccgcaaccgcacgcaagatgaagaagaccagcaccatcgtcatcatgccggtggcgcgcaatgacatcggttcgctgctgctgagctcatccgaacatgcggcgcttgacatcctgctcaaagcgtcttcacggttgagggatacgcaggtattcgatctcaaacagatgaacaaggcgttcaaacactacaaaaagggctacaagttgctacaggatttcgataccgcctgctccacggaattcgacaatctgcgcgccgttgattcatcgaggggattcctgaataatctggtcggcattcttggtcttgttttcgcgttctataagggcgtgcagtacgcggagagaggtgagatcgcagtgacgatgagcatctgtgtgcctgtcgtgctggcctgcgcattcgcgttggtgtatggcaaatatcatgcattgaccgacaatggtcagaaatatggtggccaagtggctgggctgaagcgctatctgcttgatttcagtgatttcagtgaccgtggcgtgcttgatatgacattgtggggccgatatatggtgtatgccaccgcattcggcatttccgacaaggtgatggcgcagctgaccaaagcatatccggaagtggccgatcctcagtggctggatgagcatgccgcttcgtcgtacatgtacatgccgttgcattccagcagcgttatgggcgcgtccactggcgctgcggtgggtgcaagtgttgccgccgcgtcggtgttcagtgcgaattatggcgatttcggcgcgcagctcagctccagtttcgccgacgtgcgcaacacgatttccatggcggcaccgtcctccggtggctcgggtttcggtggcggtggttccggcggttccttctccggtggcggtttcgacggcggtggcggtggttccggcggcggttcgttcggaggacgctgacatgtgcgatacgcatatacgagtggcacacggtatacgcaggaagaaagggtgatggtatatggatgcgaaacgtgtccgtggaggactgctcgcggcgggtgccgcatttgttgcggtgctcgttgtagcgctcctgctgttcttcgtctccggcgacgaagccgatctaagctaccgttccgtcgattttgacgcgcagctgcaaagcaacggcgacatccgtttcacggaacatctggactaccagctgaagagacgcgagaatgatgacggcgacacgaaaccgtggaagcaactgtatctgacgttcaaactgcgcaaccaggatctgacgaacatcaccgacatctccgtgacgaacgcgtccaccggcgagcaatacacgcagatcgcaccgcagttgccgagcggcgtatccgacagtgaatgggaatcggaatatgccggacattggtatatcgccgacaccacaatcggctccaactatccggaaccattcgactctgccaccggcgggcttgaccccaacggttcggacaatgacaaacaaatcgaaatcggctggaacattcccgccaccgtcaaacagagcagtctcaaattcgacgtgaccatgacgtttcataacatgggcacgcagcatagtgacgtgacgaatctcatgtgggagatgttccccgaagacaaccaggtgccggctggcaaagtcaccggcaccgtgcgcttccccaaaggcataggttccgacgattcgtgggcatggctgcacactgaggccacatctcaaacgtctcgcgacacggacggcacgttgcatttcaccgtcagtgacctgcgcacgaaccagtacgtcgacctcgtcgccgcattcgacaatgccggggcaagtggcgtcgaacgtgtgcgttccggcgactatctggacgaattgaaatccacggaagcaaacaaggagcagcaatggcgtgacggccagcggcacaaagcccagcttacggtcgcaggttggctggtatgtctgattttgggcggactgtgctgcgtactggcgattcgtggcgtgatttcctcaaaccgtgaggccacctaccacggcggcatcgaatactggcgtgagtcacctcaagtcagcccagccagcgccgcgcatctgatcgatgtggtggacgattccaagggtgaacagtcctcgcgtgccatgacggcgacggtgctggcattggtggtcaagaaagcgctcgccgtatatccgggacctgccgacatgtatcgtggcatcgacctgagcagggcgaacgcggccgatatggcgcgcatgatttcctccgatccatcccgtgcctctgccgcgtcaagtactagtacgttggtgattctgcctcaggcgctatcccatcgggaaacccttggtctgagtcgctccgaggaagcctgcctgcaactgctgattcgtatttccgcacgcgtgggttcgccggtattcgactttaaccagatgaaggaggcttgctccagctgggagaacggctatcaggagatgaaccatttcaccaatgcctgcgatattgaattcctgcaattgaacgcggtcagggatgtcagcggacgttggatagcgcccaccatcttcgccatggtctttggcgtgattggaatgctggtcaatattggaagcaatatcgcggtggcgttgtgcttcggcggcgcgttcgcatgcgtcggcacgttctgtttagctaccggacgcaaggaaggcctcaccgaatccggacagacctatgccggagaatgcttgggactcaaacggtatatggaggatttctccaatttctccgaccgtggtgcgctcgatttggtgatgtggaactggtatatggtctatgcggccgccttcggcatttccgacaaggtggcaagggaattcgccaaggcgtaccccgaagtcaacgatccgcaatggcttgacgcgtatgggtacgattccctcggctattggacgtatcgctcccacgcgtggaatggtatgtccactatgggaggcatgtcgaccggtgcgtttggcggatcgcagttcatgggcggcatcggcgatatcggttcgcagctgagttccggtttcgattcggtcagttccacgatttccgctgcggctccatcgtcatccggtggatctggcggttccttctccggcggcggcttcggcggcggtggcggaggcggcggcggtggaggcggcggtggccgctgatccacgacatgccgcccgccgtcggacaacgtgacgccctatgacattgcgattgtcggcattgtgtttgcccacgcccggtccggcctaggaagcctacctttcgcccatggcgattggtaggcttttccattggcagaacctgaacgagatgccgtccgacttggttccgacccggctccaaccggctcgcgcctgccggaagacaccactttcgaaggagaagacatgacgttgttccgtaatctcggaccgttccacaccaccgccatcggccacggcgagatgccgctaaccattgaaaacaaccggggccacgacgtcggcatcgaaaccctgcacgcctcgcttgacgccggctgccgccacatcgacacggcatgggcctactacacgccgggcgaagaggaacagaccggcgaaaagctggtccgcgaagcgctggacacatggaaggggccgcgtgaggaagtcaccgtggccaccaaggtcggtctgcgccgcgcgtgggatggcgacaagccgatctggccgcgcgacggcaagccggaacacctcatcgaatacggcaagcagtccgcgcaggcgctcggcgtcgactcgatcgacctgctctacctgcatcgccacgatccggaagtgccgtacaacgagtcctgcgaaggtatcaaggcgctgctcgaccagggcgtggcccagtgggcgggcgtgtccaacgtgagcatcgaacagctcaaaatcgcacaggagattctcggcgacaagctcgttgccgtgcagaaccagtattcgccgatccatctggaaacccaggacacgttggaatactgcgcgaaggaaggtctcgccttcgtgtgctggagtccgctcggcggctaccgccacccgtacgacgagcatctgttcgacccgttccgcgaagtggccgccaagcatggcgtgagctaccagcgcgtggtgctggcttgggagctggccaagggcgaccacatgttcgtgattccgggcgcacaccgtcccgaaaccatcctcgactccctgaaggccgacgagctcgaactcactgacgaggagctcgccttcctcggctgaaaaagcactgcccgtccgcattttgttaacccaaccactcagctcgggcagcaaaacacggacgggcatacgtttttgcggaaccggacggctatcggggattacagcacggccatcacgaaatcaatcagcagtttgacgccgtacagcaccaccaccgcgccacacacgcggttcatcgcggtgacgattcgcgggctgaacttgtggctgaacatcgacaccagcagggtgatgccgaagaaccacagtgccgacgcggtttccacgccggtgatgaacggcgtggactgaccgacggtaagcgtcgcgctgaacgcgccgagcatcagcgtgccgtcgatgatggcctgcggattgcaccacgtcaccacaccggcggtgacgatggtgtgcagcagctcgctgtcgccgccgaatttcgaagtgacgcgttgcgcaaagccctgcgattgcgaggtccgcgactgcggcgtttgcgcggcgccatcatcgccacccttgccgggaaacagcagacccgcgccgatacggatgaccaccaagccgccgatcgccagaatggccagcttcagccatgcgtaatcctgcatcagcctgccgatgccgaaaaagcaggacagcgacaacgacacgtcgaaaaacagcacgatcaacgcggtcagcagcgcacggcggcgcggcttggtcagcgccgaatcgatgacgaacagattctgcataccgatcggcgccacatacgccaatcccaacgtcagcccttggaaaaagaatcccatactcgcctcttatccatccaaacatatttggttggttgtaatcaacccagccaaaaccaaccaaatcgctcattctgtaatcgcaggaaaaacctctattctgcgaaaaacaacgtaaccagtgtcatattgtataggtgttgctacaataggcaaccagccaaaagctgaggtttggctcagccaatcgcaggacggtccactgtcagaaagcagatgcgccgaccacggaaaacgccgaaccataccgacaccaccaatgtgaaggagcgtcatggcacgcatcgcgccgctgaacatcgattggaaaccggaccgtaccaccggcgaacccgtcaccgaacaaatcgtcggatacatgtgcgaacaggtgcacagcggcaactggccgattggctcgcgtctgccgtcgcaacgcgcgctcgccgaatggttcggcgtgaaccggtccaccgtcatcgcagccatcaacgagctgtccgactatggcatcgtcgaagggcagcatggagcgggcacgcgaatcgtcagcaacacgtggtcgctgatgctgccgggcgcgcccgactgggccgattacgtggattccggcttcttcaaagccaacaacgacaccatccaagccatcaaccggtacgagttcacgccgaacatgacgcgcatcggcaccggcgagctcgacccgcggctctttccgaaagccatgtggcggcaggtgctcggcgaggcggcggacgagatcgaaacgctcggctacccgccgcccgaaggcctgcccgaactgcgcgaggccatcgcggcgcacatgcgcaccaccggcgtcgactgcacggcaagccaggtgctggtcacatccggcgcgttgcaggcgctgcagatgatttcggtgagcctgctgccggccggcaccaccgtatacgcggaatcgccgagctacatcaagtcgctgcaggtgttccagtcggccggcatgcatctggaaggcgtgccgatggacgacgacggcctcaacgtgcaggcattgcgcggcctgctggcggaaggggagcttgacaccggccgtccggcgccgctcaacgcgcgcaaccgcaaaggcaatgcgatcctgtacacgattccgaccaatcacaatccgacaggcgtcaccatgagcgacaaacgccggcatgaactggtcgagctttccgtggacagccgactgccgatcatcgaggacggcgcctaccgcgacctgtatttcgaggatgatgccccgctgccgtcgctgaaggccctcgatgagaccggcatggtcatcacgctcggcagcgcgtccaaatcgctggctcccggactgcgcatcggatggctggtcgccgccgaaccgatcgtgcagcggctcgccgacgtgaaaatgcagatggactacggtgcgagcgtgctgagccagtggacgttcgcgcgattcctcacgaacggcatgtacgacgaatacgtggccggcctgaaacgggagctgcggcaccgccgcgaccgcgcgctcgttacgctgcaggagaaaatggacgggctcgcccactggaacgtgccgtccggcggcttctacatttggatgaccttcgaccggccgatacgcatgaaccgcctgttccagctggccgccgaacgtggcgtgctgctcaaccccggcgacatctacgatttcgccgccgacaactccctgcgcctgagctactcctacaccacgccggaagagttcgccgacgccgtggacgtactcgccgccgtcgcacgcgagctggcgtagcccgagcttgcgtaacggctggacgggctttgcctgtcccgtgaatctacgacaatatctgatggtcttttacgagtaagaggaacatccgtgcaaagaagaaacaagccagaagtgttggctcccgcaggcaatttgaggggactgaaaaccgcggtcgattacggtgcggacgccgtctactgcggcggcaaggcgttcggcatgcgcagcgcgccgaaaaacctgagcctcgaggatttcgaggaaggcgcacgctacgcccacgagcgtggagcccgcgtgtacgtcaccttcaacgtgctgccgcgcaacaacgaggtggaagccatgcgcgaatacctcggcaagctgaaggacaccggtgtggacgcgctgatcgtctccgacatcggcgtgatgctcatggccaagcaggtggctccgaacctcgaactgcatgtgagcacgcaggccggcgtcaccaactaccaggccgccaacgcgttctacgaactgggcgcacgccgcgtggtgctggcccgcgaaatggacctgcaggccgtgcgagacatccgcgcccgcatccccgacgacctcgacatcgaatgcttcgtgcatggcgcgatgtgcatggccttctccggacgctgcctgttctccaactatctgaccggacgcgacggcaaccatggcgaatgcgcgcagccgtgccgctggaagtattccatcgtggaggagaaacgccccggtcggtattttccgatcgaacagaccgcggaaggcgcgtacctgttcaattcgcaggacatgaacatgctcgcccacatcgacgatctgctcgattcgggcgcgacgagcctcaagatcgaaggccgttccaagagcgcctactacatcgccgccatgacgaacgcctacaagacggccgtcaacgaatacatggtccagcgtggcttcgaagatgccgacggcaatgtgctgaagccgttccgcgaccgcgtgatccgtcccggtgacccggaatacggcaagccggacaccgaggatgcgatcatggccaacgccgatggcgcgttcgcaggcaagcccgacatcgacgccattcccgttgggggcgtgccgtccggcaacgtttcggctggcaacgtttcgtccggcaatatcgcgattggcgagccggacaatctgagctaccacgcacgcagcacccgacgcaagtcgaacaccgccgccgaaatactgccggaaggctggcatcacgccggtgtacggccggcaccgcatgtcaccctgccggattggctgctcgacgagcccgacaaagtggcgcaccgcgactactccaccggcttctactatccggaacacaaagtgcagcaaagcaccgaccgttccgcatacttccgcgcatggctcgtcgtcggcgaagtgctgtcatggagtccggaagacggaggacgcgtgaccatcatgagccgcaacaagatcgaagccggccaggaagtcgaattcgtgctgcccggcgcggcccccttcgcctacaccgtgcctgccggcggtttccgtgacgccgacggccactgggtcgaagccatcaacaaccccgcgcacgtcttctccatgccgtgcccacaggaggtgcccgtcaacgcggccatccgctcgcgcacgaaaaagccgacgctgaaagccgaatagaagacggcaatcgcaagcaggccttccaatcgcaaaaccaaggaaaaacaagacatgagcagcacacaatacgatgacgcgatcctcgattccaacgccatcgaccccactgacaaaaacggcaacccgattcccgtgaccattccgatcatgctggcccccggcatcaaagtcgtctacaccacgcgactcggcggcaccagcgaaggcgatttcgcgcacttcaacctcggcggcaaatccggcgacaaaccggaacacgtgctcgccaaccgcaaggcgctcgccgacgtgctcggcgcgaaaatcagccttatcagccaggtgcattccggcgacgcggtggacgtggacgaatcattcgtcatcaaccagccgttcggattcgacgtgtccggcacgaagaagccggaagacgagacggacggcgaaaacaacgcgacggggaatgacggtgagccgaccgtcatcgaagccgacggccaagtgacgtcccggaagaacgtggcgctcggcatgttcgccgccgactgcctgccggtgcttatggccgaccccgaagccggcgtgatcggcgcagcgcactgcggccgtcgcggtctgcagaaaggcgtgatcggcgcgaccatcgagaagatggtgtccaagggcgcccagccggaacgtatcgtcgccacgctcggcccctgcatctgcggcgactgctacgaggtcggtggcgacatcgccgacgaattcgatgcgcagttcccgggaaccttcacgttgagccgatttggccagccgggcatcgacatcgccgcggccgccctgcaggagcttgccaaagcgggcgtgccggccgacaacatcgtctcatcccgtccacgcgtcaacgcggccacgcagtacctgtccgaagacgaggaactggccggcatctgcgccgccgatggcgaaggcgatccgaagctttccgaacggttcaacaagatccgccgcagcctgtgcacgctcgaaaacccgttgtggttctcgcatcgccgcgcgtcgctcgccaaaaaacagcatgaaggacgcatgctggcgctgatcgtacgcgaataatcaccatacgagtcatacaagccacgcgattcgtgcgattcgcgtggccactgttgcggattgcgtgcagaacccgccacggaacggggtggcatgcggccgcggctttacggtggagcatatgagtaagggagagcagatgcaggaacagaaaatgccggtcgtggccgtggtgctggcagcgggattcggcacccgattcgacgagaacaaccccaaacagctggtgtcggtgggcggcaagccaatcatctgctggagcatcgaggcattcgaaaacaacgaccgcatcagcgacatcatcgtggtggtcaacgaacgtgtcgaagagacggtgaacgagcttatcgacgaagccggctacgccaaagtgcgggccatcgttcccggcggcgccgaacgcgtggacagcacgctcgccgccctggacctgctcaaacaggccggcattccttccggcgcgaaaatcctcatccatgacggcgtgcgtccgttcgtcgaggagcggtccatcgacggctgcatcgacagcttggaccagttcaacgccgccaccgtggcctacgcctccaccgacacgattctgctcacagaggatctgggcgatcgcaaggtggtcaaatccgtgccggaacgtccgaataccttccgcgcgcagaccccgcaggcgttccgtttcggcaccatcgtcaaagcctacgaactggccgccgccgaccccgacttccacccgaccgacgacacgcgcgtggtggtggactacctgcccgacgagccggtcgccatcgtggacggttccgaaacgaacctcaaaatcaccacgccatccgacatgccgatcgccgaaggcatagcccgcagcctcgaccccgaacacgccaaggaggaagccaaggcacgcatgcacgccgtgttcgccgaagcgttctcccagatgcacagccgttgattttcatcgaacgttaagtccgtcgacgtgtcggcagacttaacgttcaacacattcaccacgtacactggaaaccatgcagcagatcaacatcgtcatctccggtttcacgccctacgaaggcatcgacgtcaatccggccgtgctcgtgccggcggcggtagccaagcaatgggccgatccggcgcaatcgcaggcgatctccgaagaactgctgcaggacatcgccgtcaccgtcaccaacgtcacgcttccggtgagcttcgccaaagcctggcccacgctgctggaagccatcgaacaggccaagccggacatcgtcatcgccacagggctcaagcgcacctcccgtggcattctgctggaacgatgcgccacaaatctcatggatgcggccaagccggatgccgacaacgtgattccgccccgccgcccgatcgacccggaaggtccggccgcgtactggacgcgcctgccgttgcggtcgatactgcacgatttcgccaaacacgagattcccgccgcgttgagttccgacgccggtacgttcgtatgcaattcgctgttctaccatctgctcaactggtcggcgggccaggaacgtcgcattctgtcggggttcgtcagcctgccgatcgtcaacggtcggccgcacgaacgtggactgtcgatcgaacagcagaccgctgcggtcgatgacgtgctgcgtgaatcggtacgatacttcctgcaaccctcgtcaagcgacattctgcttggctgaggacggctccgctttctacggcacgattttctgcggcatgtgagtcatgcggtttcgacacgtggtcgcggacataccgccatacccccgacggacttttttcgaacgatttctgtgctctctgtgagaataatgcatttcgttctgcgtgccgcctgctgactgagatagagtactggacgagtgcgcgctggcagatgcgcaaagtgtagggaattcgtgaaaggaaaagggcatggttgagcagttcccaatcgtgttgagggggtacgacaaggatcgagtcgacgaggcgttcgcttcggctcaggagacggtgaaccgtctgcgtgagcaggtcaaggccgacgaccagaccatccttgagctgcaggcgcagctgcaggaggaaaagaacaagaaggccgctccgaagtccttcgcgtcactgggcgccaacgcccagcagatgctcgccagcgcggaacagaccagcgccgagctgcttgaacgagccaagaaggacgcttccgcggcccgcgccacggtgcagctgcaggctgaaacactgctgaacaacgccaaaatcgacgccaagcgcatcatggacgacgccaacgccaaggcggccaaggtgctcggtgacgccaaggacgaatccgaagccatgagggccaatgcccagcatgaggtcgaccagatgcgcagcgaggcccagaaggccgtggtggcgcagcgtcagaccgtcgatctggaactgaccaactcccgtgaggaacacggcaagcgtcttgccgccgaacgcgccacgcaggaacgtgagatttccgacatgcgcaccgaggcgaccagcaagatcgccgaacagcgcaagaacgccaatgaggagatctcccgcctgaagagcgagaccaacgaccagatcgaatccgcgcttgccgaagccaacaagaagctggcggacgtgcgcgagcaggtgtccaagatgatgaccgacgcgcagcgccgtgccgccgaaatcaccgacaccgccaaggcgaaggcccaggagatcaccgacgaggcggaggtgcaccgcaccaagaccatcagccaggtcaacgccgaagtggagcagatccgcgccgacatctccgcccagcaggaggaggccacgaagaaggtcaatgagctgctcaccgacctgaacgagcgtcgcgaggccgccaacaagcaggccagcgagttgatttcctccgcgcagaagacccgtgacgaggctgaggcgtacgcttccagcaagcgtgacgaggcggacgcgaacgcggcaagcatcctcaagcaggccaccgaagacgccgacgagcagatcaacgagcgtcgcgaggccgcgaagaaggaactggacggcgtgcagcagcgcatcgccgacctgcagagccgtgaggcccagatcacgcagcgcgtcagcgaactgcgtgccatgttctccaacgcgttctccggtttcggcatgaacgacctgtccgtggtcaacgccgtcgatgaaggcgagccttccgacgcgcaatctgatgacgacgcgcagcacgacgatgagaccgccgcaccggcagacgccgacacgcaggatgccgtcgagaacgattccgcagccgagaccgagccggaaggcgacgccgaatccgcagacgcttcgcagaacaactgaaaccatagaaagggaatggataatgaccgacatcacgccattgagcggtgatgaactgaacaagctcgtcgacgatttcgaagcaagcgagcacaatcgcatggccatgaacgccgtcacggcggccggcatcgacaaggtggcgcgcaactacgatcgcgcccgtctgatgcagcgtcgtttctccaccgtcgtggacaacggcaccgtcacccatcaggaccgttccggccgttgctggctgttcagctcgctgaacgtggcccgtttcgtggccaagcagaacatgggtcttaaggagttcgagttctcccagaactacgccatgtactacgacaagctcgaacgcgtcaactacttcctgaaggacgtggcggctctggtagaggccggcgagcctgccgattcgcgtctgatgcagcatctgctgtccgacgtgatgggcgacggcggccagtggaccatggccatgaacgtgtacaagaagtatggcgcggtgccgaaggatctgttcccggagaccgaatcctccaagaacaccggtgagatgaacgtgcagctgcgccgcatgctgcacaccgcggttgcgcatatgtacgctgatccgtccgcgatcgatgcgatcatcgccgatgcggtcgccgccggtcaccgtattctgacgattcacttgggcgagccgccgaagagcttcgattgggagtggaccgacaaggatggcgagttccaccgcgatggcgagatcacgcctgtcgagttctggaagaagtatgtgggttccgccgatttggaaagctatgtctgcctggtggacgatccgcgtcaggagcacgtcaagggcaagaagattggcatcgagcatctgggcaacgtggccgggggagacccgaccgagtacctcaacgtgccgaaccagttcatgaaggactgcgtgcgtcagattcttcaggaacagggcattccggtatggttcggcgctgattgccatccgatgatggaccgtgagaacggcgcgtgggccaccgacctgttcgagtatggccgcgtgtatggcgtcgatttcgatctggacaaggaacagcgtgtccgtttcggcgattccgcgatgaatcacgcgatggcgttcgtcggtgtggatgtggatgaggatggccacaccacccgccgttggcgtgtggagaactcgtggggagacaagattgccgacaagggctacttcaccatgagcgacaactggttcaccgaatacgtctacgaggtcgccgtccccaaggccctccttcccgccgaatacctcaaggccctagaagaacccgccaccatgctccccgcgtgggatccgatgggcgcattggccaaatagcgcgcggagcgcgcgctggccaatacgcgccgagcgaatagcggaagcccggtgggcttccgccgcgagggaaaacgccgacaggcgttttcgaggctgcaggcctcatcgcctcagcccggcaggccccatgacgcacgtttcccccaaaaaagacccaacccggactctccgtccgcgttgggtctttcctatatcgctttcttcgtcccgcgtcacccccacccattccaccatgcagtcgcccatccccatatcccgtccccatccgttaaggtaacgacggtggcgctatcgcgctacgcaagcataacgatgcaggggaggaacagaagcgatggcaggtcttcgcggtccggatagttcgaaggatgcacagctgttggatgagcgcgccgtgtttccggagaccgtggatgtcaatattcgtcagcttgacccgattcccgctccccgatattttctgaaggaacttccgctcacgaacgagatgagcgatctggtgttgaagtcccgtcaggagattcgtgacgtgctgcatggccgtgacgatcgtctgctggccatcgtcggcccgtgttcgattcatgatccgaaggctgcgcacgagtatgcggagaggcttgccgccgtcaagaaggagcttgatgatcgtctggtcatcgtcatgcgcgtgtatttcgagaagccgcgcaccacgatcggttggaagggtctgatcaacgatcctgatcttgacggccagttcaatattcgcaagggcatgttcatggctcgcaaggtgcttaccgacgtgctggggctcggcttgcccgccgctacggaatggcttgatccgattaccccgcagtatatttgcgatctgatcagctggggcgcgatcggcgcgcgtaatacggaaagccaggtgcaccgcgagctggcgtccggcatgtccatgccgatcggtttcaagaacgctacggatggttccatcaagccggcggccgattcgtgtttcgcggccgctttcgagcatcatttcctctccatcaatctggatggtcgtgtgatttccgcggagaccaagggcaatcccgactgccatctggtgctgcgtggttcctcgcatggtccgaactacgatgccgcttccgtggcccaagcgttggcggatctcaaggcttccaaggcttccggaccaagcgagcatggtctgatcatcgatgccgcgcacggcaactgcggcaagaacgaggtgcgcgaggccgaagtggtcgaagaaatcgccgcacgcgtcgcggccggcgaacagggcattctcggcatcatgatggaaagcttcctcaaggcgggcaatcagaagcccgcgccgctcgaccagctggaatacggcaagtcgatcaccgacgcatgcgtgccgtgggatcgtaccgagcagctgctgcacacgcttgccgacgcggtcgacgcgcgtcgcaagcttggctgatgtttctgcaccatcgttgctatccttgggaaaggaagcgacaaggagagcgagatcatgcagcagcagctgaacacgcctgaggatttacgtgccattaggcaggccatggatgagggcaagaatccgctggtggagaccgacgtgccgcgctgggaggaccaggtgggcatcagccgcatcgtgaaccgccgcgtgctggaattcgaagtgttgcccacgccggcgcaggtgctgggcgatctgccgttgagcgagcaggcgcaggagatcgtcgcctattcgcgtgatgagattcgtgcctgcctgtacggtcaggacgatcgcctgctggtggttgtcggtccgtgttccgttcacgatccgaaggccgcgctcgattacgcgcgtcgcctgtccgcgttgaaaggcgagttggatggcgagctgctgatcgtcatgcgcgtgtatttcgagaagccgcgcaccacggtcggttggaagggtctgatcaacgatccggatatcgacggcagctgcaatatcaggaagggcttgctgttggcccgccgcacgctgcttggcgtgcttgacgagggtttggcggcggccacggagtttttggagccgaccagtccgcagtatatttccgacgcgattagctggggtgcgatcggcgcgcgcaatacggaaagccaggtgcaccggcagttggcgtccggcctgtccatgccgatcggcttcaagaacgccacggacggttccatcaaggctccggccgattcctgcttcgcttccgcacaacagcacacgttcttcggcatcgaccatctcggccgcgccgccgtggtcaaaacgctcggcaatcccgactgccatgtggtgttgcgtggttcctcgcacggcccgaattacgatgccgcttcggtggccaaggccatggacaccatccgcgccgaaatgccggccgattccgctgcggcacatgggctgatcgtcgactgctcgcatggcaactccggcaaggacgagcatcgtcaggcgcaggtggtgcgtgacatcgcgggccgtatcgccaaaggcgagcagggcatcaccggcatcatgatggaaagcttcatcgaaggcggcaaccagaaggccgcgccgctcgaccagctcgtctacggcaagtccatcaccgacaaatgtctgagctggaacaccacggaacagctgctacgcgagcttgcccatgcggtggccgtgcgccgctggaagtgaccgattcgattcactatccgcgcgattgcagaaaattcgggaaacgcgaatcgcaatcgcgtaaaacaacactcaagacagcacgtaagacagggagggtgcaatgaccgcaatcgccatcatcggcgccatggatgaggaagtcgccaatatcgcaacggcactgagcaacgtcaccgtcaccgaggaagccggcgtcaaggtgacgcgcggcaccctcgaaaccaacaagggcaccgtcgtcaacgtcgccgcgaccgtcggcggcatgggcaccgtcaacatcgccgccaccacgcagcatctgatcgacgctgaccagccggacgccgtgatcttctccggcatcgcgggcaatctcaacacgaatctgcacatcaacgacgtggtgctcggcggcaccctgcgctatctcgacaccgacatgcgattggtgggccagttcaagcccggcaccgccgaccggcccatcgaggaataccatagcgacgaccgtctgctcgaactggccgaccaggcgctgaacgacttgaacattcaccatatcgtcggcatcatcgccaccggcaactatttcgtcgatgatccgcagaaggtcgagcaggtgatccgtgagaccggcgcggacgcggtggaaatggaaggcgccgccgtcgcgcatgtcgccgcccgcaacgacgttcccgcattggtgattcgcgcgctgagcgacaacgcggacaccgactacgaggatttcaaaacgttcgacatttccgaatacgcggacaccgccgcgaaactgacggtgaacatcgccaaacgcatgtagcgttcatgtggcgttgcgaaacgcctaacgttgcgaaaagccgtttccacatcccgtttgccgcatgacccgtcatcatgcatcgtcatatcggcaaacgggacgtctcatattccgatatgctgcgtttcggaagatgaacggcaggaaaacttccggtggcgtgagagaatcgcatacgcgaaagcctctccgaagccgctagtcttaaggaagaactgaggattatcggaaggtgaacgcatgacgttggagcagatgctggcaacgccgtcggtggttgcggcattggtggtcgtggccgtggtcgtgttcgtcgtggcgttcctgcttggccacagacgaggcttccaggatgtgcaggacggcgtcgaccccaatgatccgagcctgttcggagctgcgaagaacgcgtccctgttcggcccccgcgttcccgtgcagtccacggaacgccagctggtggccgtcatgcccgaagctttggtggtcgtagactcgctggccacggtccaatacgcatccccggccgcgcggcgcttcggcatcatccacgaccaggcgatggcgctcgcggaaatccgcgacatcgtgaaactggtctccacagacagcgtggtgcgcgaacgcgaactgaccatccccctgcacggccgcacgcgaacgggcgtggtgaacacgaacggcaaaggcgtcgaagccggcaagccgctgcccgaagacacgctctacctgcacgtgcgcgtcggacagatcgccgacaacctatttgcgattttcatttccgacatgagcgagcaacgccgtttcgaaatcatgcggcgcgatttcgtcaccaacgtctcgcacgaactgaaaaccccggcaggcgcgatttctctgctcgccgaaacgatcggcgacgcggccgacgatccggacgcggtgaaatacttctccggccgaatctccaaggaatccgaacgattgacggaactggtccaccgtctgatcgacctgcagaaagcgcaaagcgcggcagcgatgctcaacgcggaacggctgtccgtgctgtccgtggcacgcgaggcgctcgccgaaaaccaggtcaaggccgaatcgaagcacatcagcctggtcctgtccgtgaacggccggcaggtgctggtgcatgcgaacgccgaggaactggccaaggaagccgaacagaacctggacgtgttcgtggtcgctgaccatgagaccatcaaaactgcggtgaagaacctggtggagaacgccatcaactattcgccggaacataccacggtggccgtcggcatcggcatcgaatccggcaaggtggcgattcgcgtcgtggaccagggcatcggcatccccgcggcgtcgctcagcagaattttcgagcgattctaccgcgtcgatccggcgcgctcccgtgaaaccggcggcaccggcctgggattggccatcaccaagcattgcgtcgaggattgcggcggcaccatctccgtatggtcgcgtgagggggagggatccaccttcaccatcacgatgccgcaggcttcgggcgctgcggaacccgaccatccggcggattcggcgaatgataacacccgtgaaaagaaacagtccggccactccaccacaacagagaatgaggagaaccactgatgacgcgaattctgatcgtcgaggacgaagagtcgtaccgtgagccgctggtctaccagctcacccgtgaagggtacgacgtgtccgccgcggccaccggtgaagaaggattggaactgttcaccaagggtggtatcgatctggtgctgctcgatctgatgctgcccggtcttgacggcaccgcgctgtgccgtcggatccgcgagcaaagccgtgtgccgatcatcatgctgaccgcgaaaagcgcggaaatcgacaaggtcgtcggccttgaaatcggcgcggacgactacatcaccaaaccgtattccttccgtgagctgctggcacgcatccgcgcggtgctgcgccgcaaccagatggtcgccgaatccggagaagccgccgacgacgatattccgctcgtatgcggtgacatttccatgagaatcggccagcatgaggtgacggtccgcggcgagaacgtgttcttcccgctgaaggaattcgaactgctggaatacctcatgcagaacaagggccgcgtgatgacccgccaccagctgatcgaccgcatctggggctccgactatgtcggcgacaccaagacgctggacgtgcatgtcaagcgcgtgcgcgccaaaatcgaggaggacccgggccatcccaagtatctgaccaccgtgcgcggcctcggatacaagatcgatacgccaagcgaatgatgatgaaaagcttggtatagcgcgcattcgcatcgtgcttgcaaagaacggtgaacggaaggaacgtcgaacggcgaaggtgtcgtagactgttcatcttccgttcaccgtttttggtttggggcgagtgaaacgcccaataggctggagattgtcatgaagaacgatggcgacaacagaaaatcgaaaaatcagaaacacacgccatctgaacgttgacagagggaaaagaataatgcgtaactccattctcgtacgctccatcgccgctgtgtccggcattgtgatgctggcttccgtcgcggcttgcggtgacaacaccaccgcttccaccgattcttcggccaagtccgataccaagaccgaaaccgtttccggcaacttctccggcgctggcgcttcttcccagcaggccgccgtcgaagcttggatcgccggcttccagggcaccaacccggacgccaaggtcgcttacaacccgtccggttccggcgctggcgtgtccaccttcctgaccggtgcaaccgcatgggccggctccgacgcctccctcgccgataacgaggtcgagcagtccaagagcgtgtgcgcttccggcaccgccttcgacatcccggtctacatttccccgatcgccgtcgtcttcaacctgcagggcgtgtccggcaagggcaagaccctgaacatggacgccgagaccatcgccaagatcttcgacggcaagatcaccaagtggaacgatgacgccatcaagaagcagaacccgaaggtcgatctgcctgacctcgacatcaccgtggtgcaccgttccgacaagtccggcaccaccaagaacttcctgagctacgtcaaggacgccgctggcgacgcatggagctacgacctcggcgagaactggccgaacgaggtcggccagggcgccaagggcacttccggcgtgatctccaccgtgcagcaggctgacggcaccatcggttacgccgatgcctcccaggccggcgatctgggcaccgtggccgtgaaggtcggcgacgattacgtcccgttctccgctgaagccgccgccaaggtcgtggacgcctccccgctcgacgattccgccaagggtgacaaccgcgtggtcgtcaagctcgaccacaacaccaccgagaagggcgcctacccgatcgtgctggtctcctacgacgtcgcctgcccggcatacaaggacgccaacaccgccaagttcgtcaagtcctggctcacctacgtgaccagcgacgaaggccagcagaccgccgcttccgcagccggctccgctccgatgtccaacaccctgcgtcagaaggtcgtcaagtccatcgacgccatcaaaaccaagtgagcccgtcacagtggggcgatcgctttcggtgatcggtgactgaccgtaggtttcaggccgcagccgcgtaaaaaacggctgcggcctgaaacgatacctacggacgatacgcaaaaccagaaaaatcgaaagcaatcgcaagcaaaccaaaaggagaacccgtgagttcgcaaagcaaaacggcacagcagccggtgagcggcaagaacgcggataaggtgttcaagggcgtggcctacgcctgcggcatcctgatcctcgtcgtgctcgccgcggtcgcgctgttcctgctgttccgcgcgtggccgttgatcggcggtgaccagaaggccaacagcgcgaccatcagcaacttcaccggcggcaaggtttccagcttctggggctacgtcggaccgctgctgttcggtaccgtgctgatttccgccctggcactgctgatttccttcttcgtgtcggtcggcatcgcactgttcatctcgcattacgcgccgaagaagctcgccaccgccctgagctatgtggtcgatctgctcgccgccatcccgtccgttatctacggtctgtggggcggtctggtgctggtgccggccatctatccgttctggaattgggtggccaaataccttggctggattccgattttcgccggtcccgccgccaatccctcccgtaccgtggccaccgtgtccgtggtgctggccgtcatgatcctgccgatcatcacctccatgtcccgcgacatcttcctgcagacccctcgccttcaggaagaggcggctctggccctcggcgccacgaagtgggaaatggtcaagctcgcggtcctgccgttcggcaagtccggcgtcgtgtccgcctccatgctcggcctcggtcgtgcgctcggcgagacgatggccgtgctcatgattctgtccccgggcctcaactactccgtcaagctgctgcaggcctcgcagaaccagaccatcgccgcgaacatcgccgcgcagtatccggaagccaacgatctgggtgtttccgtgctgatcggcaccggcctggttctgttcctgattaccttcgtggtgaacttcatcgctcgtaagctcaccgagaaagcgagtgtgtgatgaccgccgcaaataacgacgcttcgccgatggacggcgctcccgtcatcgacttcgacaagttcaagccgacccgttccttcacctcagcgcgcaagcgcaaggacttcgccatgaaggcgctcatctcgtgcgcgttcatcgtggcgttgatcccgctgttctcggtgctgctcaccaccatcatcaacggcgtcaagaggctgaacctcaacttcctgagctacaacatgaccggcgtggtcggcggcaacccgaccccgtccggcggctacggcggcatcctgcacgccatcatcggcacgctggaaatcaccttcggcgccatgctcatctccatcccgatcggcctgatgtgcgccgtgtacctggtggaatattccaaccgtggcaagctggcacaggtcatcaccctgctggtcgacgtgatgagcggcatcccgtccatcgtcgcaggcctgttcgccttctcgatgttcacgattctgatcggccccggcaccatcaacggtttcgaaggctccgtcgcactttccctgctgatgctgccgaccgtggtcaagtcgtccgaggaaatgctcaagatcgtgccgcacgatttgcgcgaggcctcgtacgccctgggcgtcacgaagcagcgcacgatcacgaagatcgtgctgcgcaccgccctgccgggcatcgtttcgggtgcgattctcgccgtcgcccgcgtgatcggtgaaaccgctccgttgctgatgaccgcaggctacatcgcctccacgaacgtcaacctcttctccggccagatgaccacgcttccggtgtacgtctaccaggagtattccaagctcaacgcgaactgcccggccaacgcttccgcggcctgcgtcaccaccatcccgatggaacgcgcctgggccgcagcccttgtgctgattctcatcgtgctgatcctcaacctcatcggccgtctcgtggcgaaggtcttcgccgtcaagtcggaacgctgagcgcggtcgaatagtcgaaaacataagaacaataaggaaaacaaatgggacaacgtattgatgtcaaccatctgaacatcttctacggcgacttcctggccgtggaagacgtgaacatcaacatcgaagccaacaaggtcaccgcgttcatcggcccttccggctgtggcaagtccaccgtgctgcgcaccctcgatcgcatgcacgagatcattccgggcgcccactgcgaaggcgaggtgctgctggaaggcaagaacctgtacgacaaggatgtggatccggtcgccgtccgtcgtgacgtcggcatggtgttccagcgtccgaacccgttcccgaccatgtccatccgcgagaacgtgctggccggtgtgaagctcaacaaccgcaagatctccaagtccgatgcggatgatctggtcgagtgggccctgcgtggcgccaacctgtggaacgaggtcaaggatcgtctggacaatccgggcatcggcctgtccggcggccagcagcagaggctctgcatcgcacgcgccgtggccgtgcacccgcaggtgctgctcatggacgaaccgtgctccgccctcgacccgatctccaccctggccgtggaggatctgatcaacgagctgaagaacgagtacaccatcgtgatcgtgacgcacaacatgcagcaggccgcgcgtatcgccgactatacagctttcttcaatctgaaggctgtcggccagccgggtcacctcgagtacttcaccgacaccaccacgatgttcaacaacccgcagaacgaagaagccgaacgctacgtctccggacgttttggctgatcgataaggccgattcgccaaaacgtagtgccaacccggtgggttggtgcgagtcagcttcagctggccagttaatagcgcttcgctgtgcgaaactctgtaattgtacgttttggctgattggcagctccttttccccgcaaaccgacgttgagattgctctcggcgtcggtttgttgtttttcttgtggaagcgacacgcgctgttgagaatcattctcagttacggttatgatggattcaccgaagcatgaagcgtatgaaaatggaggaaccatcgtgaaccgttatgcaagaattgcgattgccgtactcgcttccgtcggccttctcacttccgcgtctgcctgcggaacgtcgcagaacggtgccggttccgcgcatggcgcgatttccgtcgtctcctccatcaaccaatggggcaccctcgccgagcagctcggcggaagcggcgtgcgggtgaccagcatcatcaactccaccaacgtggacgcgcacgactatgagccgaccacgtccgacatcgccaaactgcagaaggcgcgaatcgtcatcgtcaacggcgccgggtacgactcatgggccgtcaaagccgcgcaatccgccaaatcgcaagtcatcaacgcggcggagatcggtggcgtcaaggatggcggcaacccgcacgtctggttctcggcggcggtgcgcaaagcggtcgcacaggccatcaccagggcatacgagggcacaaggcccgacggcaaggccgatttcgacaagctgaaccagcaatggcgttccaaggaagacgagatcgcccgaaaaatcacggagaccaaacgcaaggcggatggcgaagcctatgccgccacggaatcggtcgccgaatatctggccggggacctgggcctcaaagacgcgacgccgaccggctacacgcgtgccacggccaacgaaagcgagccaacgccgaccgacatcaaacagttcaccgacatgctggaagccggcaaggtcggcctgctggtggtcaacattcaggaggagaccgagctgaccggcaagatcgtcaccgccgccaaatcgtccaatattccgatcgtggagctgaccgagcagatgccggagcagtacgattccctgacggactggatggccgcgctcgtcgacgcgttctcccaagccatctgatgcggaccgataaaaaagacgcgaaagtcgataaaaaaagggcgattccactgaaggaaccgcccatttccgtatgaaaaggactgttacagcaccgcggtgatgatgaagtccagaatgaacagcacggccacgacccagatcaccggatgcacgtccttggcctgcttcttgcaggtcttgacgatgcagtaggtgatgaagccgccggcgatgccgtaggagatggagtagctgaacgccatgaacacggacgcgaagaacgccggaatggcttcggagatgtcgccccactcgatttccttcaaggaggaagccatcatgcagccgaccacgaccagcacgcctgcggtcgcggcggacggcacggcggagatgaccggggagaggaaggcggacagcgcgaagcagatcgccacgaccacggaggtcaggccggtgcggccgccggcggcgatacccgcggaggactccacgtaggtggtggtgttcgaggtgccgcagatggcgccgatggaggtggcgatggagtcggcgaacagggccttgtccatcttggaggagaagccggaaccgttctcaagagccttctcgtcctcggcggagaagatgccggtacgacggccggtgccgatgaaggtgccgatggtgtcgaaggtgtcggacatggagaacgcgaagatggtcagcaggatgatcggcagcttcgacacgtcggagaacagcgccgggaagccatccttggtgaagatcacgccgaaggtctgcggcagctgggcgaaggtgtcggcgatggacacggagttggccatggtggtctggcccatcggaatgccgacgaccgcggtgacggcgatggcgatcagcatgccgccgcgtaccttgagcacggtgagcacgatggccagcaccaggccgatgatgaacagccagatggtcggattgttcatgacggcaaggcccggggtggcctgcacggtgtcgccgctcttggccgcggacttggtggtgaaggtgaagaaaccgacgttgaggaagccgacgtaggccacgaacaggccgatgccgccgccgatggcgttctgcagcacttccggaatggcctggatgatcatcttacggatcttggtgacggtgatgatgatgttgatcaaaccgcacaggaacaccatgcacagggtttcctgccacttgaagccgaggccgaagcacacggtgtaggtgaagaacgcgttgaggcccatgccggcggcctgcgcgtacggaacattggcgaacaggcccatcacgagcgtgccgatgatggccgcgatgatggtggcgaggaacacgccgccccacggcataccggtcgaagacaggatctgcgggttgacgatgatgatgtaggacatggcgaagaacgtggtcaggccggccatgatctccgtggagacggtggtgccgttctccttgagatggaagaatttctccattttctcttttctcatctttcttgggttggtaggcgcgtgccatatggtggcgtgcgccggcgagaatcgcgactcgcctgggacatgcgtccctgaacaaagcaaacgtagcacctatgtaagtcatggaaatttcgtgcgattggtaaggggttgcttttgcggcggcgcgacacgccggtctggattagtccaaacgggtcagtaaattacccatttgtaaaccacagaccgttggttggagcgtgcaagcgctcacgaagtttggttcgccaagccagcgcaggttgaagaacatacgcccaccaagggcttcccgcttagcggtcgaatgttgctctgcctgcgtgcagggctttttttattgccctgcgaggtgttccgaatctcacagtcaacggttgactaaggaaggaacgccatgaagaggcccgaaaaggaagcggtggtcgctcagcttacggacaagttccgtaacgccgacgctatctacctgaccgagtaccgcgggcttaccgttccgcagatctctgaactgcgcgaaaagctaggccgcgatacttcctacactgtggcaaagaacacgctcgttcgcattgcagccaaggaagctggcatcgaaggtcttgatgaacttctcgccggcccgaccgctgtgaccttcgtgaagggtgacttcatcgaagctgcgaagaccctgcgtgacttcgccaagaccaacaaggcactgatcatcaagggcggcttcgctgatggcaccgtctacgatgctgaaggcgccaagaagctggcagacctcaagtctcgcccgcagctgctcgccgagttcgccggcgacatcaaggctacgatgtccaaggccgcgtacctgttcaacgctctgccgaccaaggccgtgcgtacgatcgatgcgctgcgcgagaagcaggaaaaggctgcctgatttcgctgcggctcgccgcatgaatgaagcaaccacaaaaaagaaaaacaattgttttaggtgacggccacctcttcaattcagtccgtcgccaagaatgaaaggaagccattatggctaagtacaccaacgatgagctgctcgaagctttcggtgagatgaccctggttgagctctccgagttcgtcaaggccttcgaagagaagttcgacgtcgaggctgctgccccggtcgccgctgttgccgccgctccggctgctggcgctgctgctgaggaagagaaggacgagttcgacgtcatcctctccgccgttggcgacaagaagatccaggtcatcaaggccgtccgcgctatcaccaacctgggcctggctgaggccaaggctctcgtcgacggcgctccgaaggctgtcctggagaaggccaagaaggaagacgccgagaaggccaagtcccagctcgaagaagccggcgccaccgtcgagctcaagtgattcgcgcggcttcaagccgcaatcaccaagctgtaatggaaaccccgtttgccgtaaggcagcggggttttccgcatatggagcatgactcaggcatgttctaaaatgggggaattaggcgaaagttgtcaatttatcggttcggaatccttactttcgcgatgaatcatgacacaatggcagatagtgtagtgcgaaaggaaggccgacaacggtgagcgaggatcgacgaatgacgcggcagtggaccgtcaaagttgacggaaacaacgtgaaaacgcttcatgacggcgaaagcgtggaaatcgggcgcaaaccgttgcgcccgctgtcggatgacgggttcgctcgtctcgacatcatggatccgggcaagtccatgtcgaaaagacatgcggtcctctccgtcgacaagcagggcaattgctccgtacgagatctgcattccaccaacggctcgttcgtggtgacgaacaacggccaactgatgcgcctgcccgcaggcgaggacatcaagctgcccatcgactcgatgaccctgcagttcggcgacgtgcgtcttacgctcgaatccgcattcgaacacgatgacgaggatgacgacgccacctccggtgtctcggatgatacaagccagccggtttcgaacctgttcgaatacgcggtctccgacgaggctccgcaggaaccggatgcagccgacatgtccgtggacgacatcctcaatctgcgtgccggcgagccgacgacgttcttccacgcgcgcaatgtcaccgaccgtgccgatgctctgcaccaggcggaacgtcagaccttcacgccggagcatgccgacaagccggaactcgaagatgcattcccctcggtctccttggttcaggaaaccgtcgtggccgcggacaagccccgcgacctgttcgccgacgccgcagcgcaggccgaggctgaagctgagatcgaggccgatgcggccgattccgctgatgcggctgcgaccgatgccgaggtggctgccgtctcaaccgagacagccgctcggcccttggaagcatcccatgacggtaacaagaacaacctgattccggtggacaagctgttcagcgcgcgccccaacacgccaatcgccgtcgctctgcccgacaggaacgacactggcgataacacaggcaacgttgacaaggctgacaatgcggctgacgcgtccgcccaggaacagacgcagtccgccgaacaatcgcagatggcggaacagcccacatcggaaactgccgaacagcagcccgccgaacagcagtcgaagccgatgcacgctacgcagccgcagacggaacagccgggaacggtgaccgcggaagacgacgacgagcggttccgcccgcaaaacagccaatcgcagcccgcgccggacgaaaccgccgcattcaagccgatcttcgaaccgggatcggtattcgaccgtgtatccaaaggcggcctcgccaagcaggagcagaccatcgaggtcgacggcctgacctccgatgacgccaaacgcacggatgatttcacagtgcagttccagatggcgcgtcatccggaactgttgccgttcctcgccatgaacccatccctatacgatgacctgtacgcgtggttgggcgcattgggcaaccaagacatcgatgcggctttggcacacaatccgggatatgaggaataccgcaaggcagtagggaagtgagtcggtatatgagcgaaaacgaagagacggccaccgcgttggaccgtatccgcggatggcgtgaggagtatcgccttggtctggcaccatccccgcttgaggatgtgacgcaactgagcgcccagcttgacctgacgcatgcgcacccatcgggcatcgcgcagctgttcgccaaaggacacgtcaccttggactcgttgttccgagacaacggcatgctgcgcgccgcgggcaggcgtgtggaacgcgtgctcgacgaccgtgacgcgaaaagccgtgtcagcggcgtcggcgaactctccttggtggtcggcgtggccatttggaaaggcaaccagatgccggtgctcatgtatccggtcgaagtgcgcaaggaaggccgcaacatcgagaacggcaccgtcatcgcgttcaccggacgagtgcgtctgaacgcggccttcgccgccgtgatgcgtgaaaacaacgtgacattggacgagaccaagctcttcgatggttcgaattacgaaagcggcacccccgaaacgtccgcggtgttcgcggccatcacagcgcgcgcgtccagcgttttccccgatttcgaaatcgaacgtcacatcatcctcggctgcttcatggacccgtcctcgcagatgctggtggaaagtcgccagatcatcaaccagctgtcccaaggcccgacaggcaacaccgtcctggacgcgctcgccgggaacaaggaagccgcggacgcgctgaaagacgcgcagattcccgaatacagtccgttcgacgccgatccccatggcgaatacgagattggcgacgttgacaacaccgtccgatacgcggcgcagctggccgcatccgggcattcgattttcgtggacagcgcgatcagcggcaacacggccgaacaggccgcggcaatcgcctcccgttgcgtgatgggcggacacagcgtgttgtacgtgccgtgcgtcaccgaccaaaagcgccgtttcatgcagacgatcgcggccaacgagatgagcggccaattgctggacatcgccgatgacggcgccaatgcggcaatcgaccgtcagctgatagccgcagtcggtttccaatccggcgtcgcgacttcgcgtttcgaccagatttcggatgagctggtgggtgtgcgttcccgcctggcccgctatctgggcgacctgcacggcgtcagccaggaatggggcgtgtccgcataccagaccatccagaacctcgcacaaatcgccgtcctgcccacgcatccgaccacgcatgtgcgtctggccaagcagtccgcccattccatcgcggacaagatggaggaatgggctcagaagctgtatcgcgcgggagaactcggcgaatacaccatcggcgcgcaggacaccgcctggtacaaagcctccctgtattccgaagaggaagcggtcagcgcataccagcgtgtggtcgagctgctgcgcaaggtgctgcccgccacccgcaaacaggtgtccagcaccgtgcagacctgcggcttcccgattcccaccaccgcgcaggagtggggacgccaggtcatggtgctcaagaacctgcgccgcgtgctcgacgtcttccagccggaaatcttcgaacgcgacatcgattccatgatcgaggccaccaagcccaaggcccagcgcaaggccgaaggcagctccatgggattctgggaacgtcgccgccatatcaaggaggccaagtcgatgctgcgcgtcggcgcgcaggtggagaacctgcatgaggcgctgctcgtggtggccaagcaggccgaacagtggcacatgttcgttcctcacggcggatggccggtgctgcccgccaaactcgacgacatcatcaacacgcaggaccagctgacgaacgatatgaccgcgttgaacgtggcgctcgccaccacaccgcagggcggcaatctggacaccgtcgacctcaaccaggtggaagagcgtctgaaggccctgtatgacgacaagcaggcgttggatacgctgccggaacgcgcccgtctggaacgtgagttccattcggccggtctggatgagcttgtggcggacctgagcaaccgcggcgtgccgaacgacgccgtggccggagaactgcagctggcgtggtggaccacggctttcgaagacatcgtgaagtcctccgccatcatttccaaccaggatggctccgccatgcaaagcgccgccgaccgattcacccaggtggatgtcgaacacgtgcgttccatcggaccgatggtcgcccaagagtccgtacgccgtctgtgcgacatgcttttctcccgcacgcaggaagccaatctgctgcataccacgcttgccggttcccgaaacgtgccgttgaacaggctgcgtagggagcatccgcagattttggccgcggcaaagccgattctggtggcaacgccagccacgctcgctgccatcaccgacccggcgccgcttgccgataccgtcatcatcgatacggccgcacatattccgtccatcgagctgctcagcatcatcgcccgcgcgaagcaggtcgtggtgatcgcgcaccgcaagaccgtcacatccgatggcctgcagcgactgatcgcactgctgccaagcgtgaagataaccgacaggccggttcgccgtgcgccgaagctcaacgccttccttgaatcggaaggatacggctccgtgccgtgcgatgtggcgcgtgaaggataccaaggcgaagtcgcgtaccatttcgtgccggacgccaacggtgtgccggtcatcaattccggtctggtcgaatcaagccagcaggagatcgacgaagtggtgagcatcatccgcaagcgcgcggccggtttcaccatcgttcccgcatcgtatgtgcttaccgtggtggcgctcacgcacacgttccgcatccgtctgggtgccgagctcaagtcgcttgccaacaaagacaaggccatgggcatgttcctgcgccacgtgcgcatcgtggacatcgtcgatgtggccggtgcccacgccaccgacgcgattcttgcgatgtgctacgccaagacctcgcacggcaggctgctgcagcagttcggcgcgctggaatccgacggcggtcgaggcatgctgctggacgctttggcggtaccggaccgtcatctcgacatcgtctcgtccttcgcatccgacgatatggacgacgagcgactgcatcaggatggtccgaaggcgctcaaaaccgtgctgcgttgggccgaacagcttgatgacagcatggtccgcccggcgatcaaggagtccggagagaacgtgctcttcaacgatctcgccgagaggatccgcgaacgcggcttggacgtggccgtcgattacggtttcgatgacggactcaaactgccgttggtggttggtctgaaaggcgagccgttcgctttggtcgtgctcaccgatgacgcgcagttcatgggattgcaatccaccagggaacgccatcgcgtgctgctgcaggacatcgaatcgcttggctggtcggtgatgacggtatggagcgtcggcgcgttcgtgaaccccgataaggaagtcgaccgcatcgtggcacgactgggaagcctgtaccgggaggaacggtgagcgccgagcatatcgaaaacgtcatggagcatgacgattcgcagacccagtccgagacgcactccacacccagttattccgccacgcggcggaccgcacgcaagcataagcgcgtggtccgccaaggtacggaactgttcgatgccgatggcgtcaaactcgaaccttcggacgtgctcaccaagcgccaacgcgaggcggatgacgacaagcgcatcctaaacgagcttccgccacattgggcggtcttctccgaacgcggccgctgatacgtccagccgggtgccagctatcgattaggattatcagccattaattgatggtggcgatgaccgcactgtattcctgaacccgcaacacgacggccgcctcattgggcggcatggcgaacaccgcgatggtattgccttgcgcatccttagccggtttgccggtcagcagcgcttcggcgcagatcgtgtgtaactgcgcatccacaccaccgtccggcatatcattagccatgccggacggcgtttccgtaccgttcggcatatccgcgacattcggtgtgccggactgcatctcagcatctgtcatggtggcgctggaaagcgtcaccttgtctccgggaatcaaaccgccggccacacttgccaaacgcacttcgatactcgtatggccctgcggcacaacgggggacgcacgggccatgcccgacataagcacatcgtgcgcgccgatgcccacctgtgcgatcaggccgacggcgtcgtcaagcgtatggaaggcgttgctcagcgagccatcgctcggcgcctcacgtaactccacgtcttcgcgtgtgatggccgtgcctttggcgacattccgcaccgcgaccacaataggctgcgtggcgatggctgcgcgtacgcattgcagcgtggcgaataccgtcaggccagcgcacaatgcggcgaggaaccgatgcaggcgtgcgttgcttcgtctggcttccaacgatgcggcagtcgaaccatgacggtctcgttgcagacgcgtcgtgcgcgcggtccgtccttccgaagccgtcgatgtgcgcaaactcgaatgtggccggcggtccatcaaggaatgaaaaaaggtcatcatgcatgcatgatgacctgattgttatgaccacggcaagcggaatccggggttgtggtcggagaatgggagttatccacaatcttcggcgtgtcgcgttggattccgcgcctgtgggtcacttggatttgtcggtgcggtagaagccggaccccttgaactcgatcggcaccgcggaataaaccttgcggacctgctcctcgccgcattccgggcatacggtgatcggatcgtcggtgaacgactgctgctcggtgaagtcgtagttgcagttcttgcaacggtaatggtaagtaggcacgatatcctcgctttacgcacaatcccaaatttcttaacgggacatatcctagtacgttccctgagacggccccgcaaccgtcctatcctcggacatcggcataaccatccggcgtgagcacgccgtcgacgggaatatcatgcggctcatgcggcacggtctcgtcggtcggctcccaaggccagcaaacggcgaccacgcgcgcggtgctgctacgatgctccaaagcgcggtcgtaccaaccgccgccgcgccccaatcggaaaccatgttcgtccacagcgaacgctggcacaatgatcagctcggccgaagtgagaacttccggtccttccgctgcgttttccggctcctgcgggcgatgtgtgttgatggaaccatcagcattgcgctggtcgcgcagatcgtcaagaccgttcagctcactccagccgacttccatgccagcacccagacgcggcaccaaaacacggcaatccgtgtcgaacatcgcttcgagcaacggcatcatcgatatttcactgcccatcgaggcgaaggccgcgacggttgatcgcggtcgaatcaacgacgcttccaatgcgtgttcggcaagcagtcgtcccgcttcgcgccgctggtcggcggacgtccgctttcgtcgttcgatcgcagccgcgcgccaatgccgtttcagctcgcgttgttgctcatacatgtccatatcgttcgttgtaccacggttcgattgcgtggaaaacggaacatggggtatgggtggggcacaatggaagggtgacgattttgcaatccttgagcgacatgatgcgtcgtccggggaataattcctttgaaatgccggaattcatccaatcgcatagcatgcgcgtcccggtgagtctgcgcccgttgacgggtgccgactatgacgagtggaacgaggttcgctggcgcaacgatgcctggctcaagccgtgggaatccggcgatccgctgcacggcgcccccatcacctacaaggaatggatgaaacaactgcggcgcaacgaacgggccggtaccggtgccgtgttcgccatcgaacagcatggccgtatcgtcgggcagatctcgttgggcgcgatctgctacggcgcgatgcgttccggcgtggtcggctattgggtggacgagcgttgcgccgggcgtggctacgcgccgatggcggtggcgctgttggcggattgggccatgttcgacccgaccggacctcgactgcatcgcatggaaatcgacattttgccggaaaacaagcggtcccgtgccgtcgcacgcaaggtcggagcaacgttggagggggtgcggcgcgcgtatatgtacgtcaacggccaatggcgcgatcatgaaagctacgtattgatggccgaggacgcgccaaacggtttcaccgcgcgtctgatgacagggaattcaccctcctgattcgacacgccggggaggactcgcctcgaatgtcggaatgtcacctattcttatgacatatgggttatgaatcgttaagcacggtggtcgtgcttgcgatcgttgtcatcctgatgctcatttggttgcccagacggacgattaaaggcatgaagagggtgatcgaacatcgcgaggaccgcttttcaccgtcgttgcatctggtggatgccgacagcggaacgcgattttccgatgagaccgtcgcggcagcgaaaggggtactgatgcagtccacagaggcgcacaaaggcgcaacatccgaagaacggatcgcggaaattcgcgcccttcgtcacgccgcggtccgcaggaggcgcgccatcgccgtctcattgctgacaatcacggtcgttgtgctggtctgtgcgttcgcactgcacttcagtccgctgttcgcgctcattccggccgcgttgctggccgcggtgctcgcgttgggtgtgcgtgcgtccaagcaggccgtggcgtgggagcggaaggtcgccagataccatgccaaggtgaagaagcgtgccgccgccgaacgcaaacgtgcgcaggcggagcaggcggaacgtgccagactgcgcgcgcaggagctggccgaggcccgcaaggtcgccgacgagcagttgaagaccgatgtcgttcccgagggggagattcgccaggcgatcgcccgcggcaaggccgatcgggacgccgcggtgaaacggcgcaaggaagagatgtcttccaaggaagagacgcagactgccgagaaggccgtcgaccagacaaccgaacgtgcggatgccgcgcccgctgacgtcaaggaagtgggactgtccatccacgatgagcgagacaatatggccgaagaagccaaaaccgttgccgtcaagtccacgcaggacttgatttccttctcgttgggtgcgcctcgcgacggtgccgacgttgaggtggatgctccggaaagcatggagatcaaatccaccaaacaagtggccaaggccgtgcccgtcgaaacgccttccgacgaggctgagccgttgattccgccaagcgacgcaatgggcagcatggatgccgatgaggccgccgcccgcgtggatgagggcgtgcacctcagagaggtcgacgttccgggattccacgatgccgaagtacgtgccgatgtggaggctccggatgtgacttcggactccctaggcaccggcctggaggccattctggcccgtcgtagcgcctgacgaaacgcttgaaccgttttttacaaagtctggaaccgcatggtttcaggcttttttgataatttctctcagagcgttagcactcgagttggcagagtgctaataatcgcgctaggataagtcacagcgcgaaaggacgacgccgtaagtgatcgtcagcctcttgctagcgggtcccggcgcggtaagtatcgatttctctttagaaagaggaggtccacagtgtcgatctcactcacaccgttggaagacaagatcatcgtcaagcaggcggaagccgagacccagaccgcttccggtctgttcattccggacaatgccaaggagaagccgcagcagggtgaagtcctggctgtcggcccgggccgtcgtaacgacgccggcgagcgtatcccggtcgacgtcaaggtcggcgacaaggtgctgtactccaagtacggcggcaccgaggtgcactaccagggcgaggattaccttatcgtctccgctcgtgacatcctggccatcctcggctgagactagcgcgtagctgtcgaaaccccgtttcccgtatattgcggttcgcaaggctcgggaggcggggtttctgcgttgttcggcgccgatttgcgtaaaacgttggaatttcaacgatttgggccgtttttggctgtcgcgacacgccgtatttgcataagtcggccggtctgtggcatactaaacgggttgccggttggggttcaaccaaacaggcagcacggcggatttcccaagcggtcaaagggaactgactgtaaatcagtcgcctcgtgcttcagtggttcgaatccactatccgccacgcctcgatagctcagtggtagagcacttccttggtaaggaagaggtcgtgagtccgattctcactcgaggctctcatggcgggatagctcagctggctagagcgtacgactcataatcgtaaggtcaagagttcgagtctctttctcgctacaaaggccgacggaatgtcggtatagcaacgaaccacaagaggtgaactaaatggcaagcaagagcgccgacattcgtccgggcatcacgctggcatgcaccgagtgcaaggagcgtaactacatcacgacgaagaaccgccgtaacacgccggatcgtcttgagctcaagaagttctgctcccgctgcggcaagcagaccgtgcatcgcgagacccgctgagcggaatcaagctttcgaaacccgaccaatttggtcgggttttttgttactctggagcgttatgactagttttgcagatctcaccaccatcggcgtgggcggtcctatcgccactttcctggagccgaccacgcgcgtcggcgtcatcgaggccgttgaggaagccgattcccaaggactgccattgtgcgtgatcggcggcggatccaacatgctcgtatccgacacgccgttcgaaggcgtggtggtccgcgatgcaagacgttccatcagcgtgttggatgaggcggctccggtcgaggatgatgggcgtgtcgtccacgtgaacgccgaagccggctgcaactgggatgatttcgtcgattactgcgtccgacttggactggaaggcgtcgaaggcttgtccggcatccccggcaccgtcggcgcgtcggtcgtgcagaacatcggcgcgtacggtcaggaggtcgccaccagcgtcgacagcgtcgaggtttgggaccgcaaggaacgtgcggtaaaggcgttgcgcaacgatcagctcgccttcggctaccgcatgagcgcgctgaaagccagcatgtacagcgctccggcgactccggccgcggaatttttcccgacgccgcgatacgtggtgctatccgtcacgttcgcgttgcggcacagcgatacgggcgtggtcggttatggtcagctcgccaaggcgttggacgtcgccgtgggcgatcgcatgaacaccgcggacatccgcaacgcggtgctgaaggtgcgtgcggctaaaggcatgctggaagacgcgcatcgctatgcgtcgccggccatgcagggcaccaagaagacgaatctggtcgatgtcgctcttgaatcgcaatccaagcagaacggcgatgacggtccggacttcaaccgccatagctgcggcagcttcttcatgaacccgattctcacgccacagcaggccgagacgcttcccgaagacgcgccgcgcttcgacgcggcattgccgggcggcgggcagggcgtcaagacttccgcggcctggctcatcgaccatgccggcttccataaggggttcaaaatcaacgaaaacgctccggctggcctgtccacgctgcatacgttggcgttgaccaatcgtgggggagcatcagccgaagatatcgcccgcctcgccaaaaccgtgcaggacggcgtcgaggccgcgttcggcatccgactggtgcccgagccggtcgtcatcggcatgaatcttaaatagcgtcacgcacgccgtcaatgtgacgaaaacgacttatacttgcgccttgtgctctagaaggtggagcgtgaaaccgcgcgggcggaaagaagagaaggacgagacatgaacgtatttcgcaagaaatccgtcgaacagacgctggctgaaacaggtgagtccggccatgcgctcaaacgcgatctgacctggtgggatcttgccatcatgggtgtggccgttgccgtgggcgcaggcatcttctccatcggcgcgcaggcggctgccttccatgccggtccggcggtggtgctgagcttcctaatcgcaggcgtcgtgtgcggcgccgccgtgatgtgctacgccgaattcgcctccatgattccagtggcgggttccgcctacaccttcacctacaccaccgtcggcgagatcgtggcatgggtgattggctgggatctgatcctcgaaatgctcatggccggttcggtcgtctccaaatactggggcgtgtacctcaaccagttcttcgagctgatcggctggaacatcaacaccaacatcgccatcggctcgttcaacttcgacctggctccggtcatcatcgtcgccttcttcaccgcgctgctggtgatgggtaccaagatcggcgcccgcgtggacggcgcgctcaccattttgaagatcgccatcgtcgtgttcatcgtggtcgtcggcttcttctacatcaaggccgaaaacttcaccccgttcattccgccgagcgaacccgcagcatccaccgacggctccggcgtctccgcggtcatggaacagccgctgtggcagtgggccaccggcatggcccccagcatttatggcgtgaccggcatcatctccggcgcggcactcgtgttcttcgctttcctcggcttcgacgtcgtggccaccgcttccgaagagaccatcaaccccaagaagaacgtgccgctgggcatcggcgtgggcctcggcctgatcatcgtgctgtacaccctcgtggccatcgtcaccacgggcatggtctcctataaggaccttgccaaacagtccgatccgtcattggccgttgcgttcaagatggtcggcgccgactgggctgcgaagatcatcagcctcggcatcgtcatcggcatggccaccgtggtcatggtgctgctgctgggtctgacgcgagtggtgttcgccatgagccgtgacggtctgctgcctcgcggtctgagccataccggcaagcatggcactccggtgcgcctgcagatcatcgtcggcgtggtcatggcgctgatcgcggcctgctgcaacgtcggcatcctgtccgacatggtgaacatcggcacgctttcggcgttcacgctggtggcgatttccattccgatcatgcgcaagaagcgccccgacctggaacgctccttcaagatcccaggcaacccgtgggtgccgatcctgatcgcgatcgccaacctgtggctgatggtcaacctgagcgtgctcacttggatccgtttcgtggtctggctcatcgtcggcttcgccatctacttcggctacggctaccgtcatgcccgtctcggtgccggcgaactcgaagttgccgcgcaagagtaatctggaacagtacacgttgttgttgaggaggtaagcatgccgtacgttgttgcccagccgtgtgtggacgtcaaagacaaggcctgtgtggacgagtgcccggtcgattgcatctacgaaggctcccgttccctgtacatcaatccgaacgaatgcgtcgattgcggcgcatgcgagccggtgtgcccgaccgaagccatcttctacgaggatgacctgccggacgagtgggcttggtacaaggacgccgccgtcagcttcttcgccgaagtcggcgatctgggcggcgcttccgccgctggcccgatcggcaaggacccggagcaggtcgccgcgcttcctccgcagaaccagtgaccatggcttgttgaaccgtcgtgccgtccattttgctcgtcgagcggatttggacggccgattcgttttctggaccggttcgacttcgacgtttccatgcgccgaaggcgaaccggtttttcgtatggacggacgaccatgccgtcgggccgattgccgtatgctggagcatggtttgagattcccgttggaaaaggagacttacggatgggctttcatgagttctcgtcaccgtacgattggtcgcgcatcgcatcctacaagcgcacggcgaaggccgcgttcggcggcatgatcgacctgtccgtcggatctcccgtcgaccccgtgcccgattcggtgcgcaaggcgctcgccatctcgtcgaacgatccgaacgcgtacggttatcccgtcacggccggcaccgccgatttgcgtgacgccattcacgagtggttcgcggccgcccgcaatgtcgatttgcgtgcgattggcgccgatgtggtgccgacggtcggttccaaggaaggcgtcgcgttgatggcgtcgctgctgcatttcggcgagggcgatgtcgtcgtgcagccgaaggtgtcgtatccgacgtacgagatcggcacgcagttggccggcgcgcaaacgctgaaggtcgacgacgtggcggatgcggattcctggaaggatgtgccgggcgtcaaggccgtttgggtcaattcgccgtgcaatccgaccggtgaggtgctgtccgcggaacggatggccggtattgtgcgtgccgcgcgcgcgattggtgccgtggtgctgtccgatgaatgctatgcgttgatgcaatgggaagacgacgttgcggaagcggatgcggatacacttgcctccacgccgtgcgccttgcgcgccgatgtgtgtggcgggtccgccgaaggcgtattggtgctgtattcgctgagcaagcaaagcaacatggccgggtatcgtacggcgcttatcgctggcgatcgatcgctgatcgggccgatggcggcataccgcaaacagatcgggcagatcattcccggaccggtgcaggctgcgatggccgccgggctgcgtgacttcgacgcggtcaagacccagcattcccgttaccaggagcgtctgggcatgctggtgagtgctctgcgcgcatacggatactgcaccgacatgccgcaaggcgcgttgtacgtgtgggtgaaagccaagtccggcgactgctgggaggatctgcgccagcttgccgaaatcggcatcgtcgccagccccggcgagttctacggagcgccggaatacttgcgattctcggctacggccagtgatgcggcgatcgcctccgccgcggaacgattggcacgttgacggtttgctgacgatggccttttgacgaacgaaagcgttgaaaacaaaaaggacctccgattcactcggaggtccttcattatggcggagtcagagggagtccaacgcccatgcgtcttatggctatgtgcagctgttgatgtcgctgatccaggagtggtgcagtgagagagctctccccagtacagtgtcagtttgtcggccaatgaagcatcgatgataacgctattgccggggacagcgtaaatagtttttgcagttaatcgtgtttgggcggaagcctgtaatttcctgcgtttggaatacttaaatctattcgaaagtttcgtaaatagttgcatatagaactttcgtaacaaaaaatttaagtatttagttaaatgacttgactttcttgaaagtcaagtcatataatcaagcaatgctttgactgaaatgctaaagcatttacgaaacatgaagatgtgtgttcgtgcatgtcgccaagggagaaagactttgtattcccacatccgatattggataaggagattcagcaatgaagtttgaataccatgtcaaaccaaccggcagcgatgctgcgtgcggcgacgcggagcatccgttcgccacgatttccaaggccgcgcagatggcctctccgggcgatacggtaatcgtgcatgaaggcgcataccgcgaacaagtcgatccgaaacgtggtggtctgagtgaacatgagcgtatcacctactgcggagccgaaggcgaagcacggccggttatcaaaggctcggaatgcgtgcggggctggacggaattggccgatcatccgcatgtgtggacggtgatgcttgataatacgatgttcggggatttcaatccattcgcgaccccgattttcggtgactggctggaaatgcccaagttcggcaaggactcggacaaacatcttggcgatgtgtatctcaacggtgtttccttcttcgaatcgacgacgttggaaggcgtatacgatccgcagccgcgtgatacggatgaggatttcgcgttgaagattccctgccctgtgccggatgtggaccgtacacgttatgtatggcatgccgaagtggacgagaatgccggcaccacaacgatctgggcgaatttccaaggtgccgatccgaatgaggaactggtggaggtcagtgttcgtcgcacatgcttcttcccttcccgcaaccatgtcaactacatcaccgtgcgtggctttgaaatggcgcaggccactggagattgggcgccgcctacctcgcagcagtggggcatgatcggcccgaactggtcgtatggctggatcatcgaagacaacgtgctgcatgacgccaaattctccgcggtgtcattaggcaaggaaatctcatccggcgacaacgagtgggtgaaaaccgagcgcaagaccggttaccagtaccagttggaggccgtgttcaaggcccgtcgcatcggctgggaaaaggggctgatcggcggtcatatcgtacgcaacaacgacatctacgagtgtggacagaatgccatcgtcggacatatgggcagcgcattctgccgtatcgagcataaccatgtccatcacattgcgttgaagcgtgaattcttcggatgggaggtcgctggcatcaaattccatgccgcattggatacggtcattgccaacaacaacatccacgactgctcgctgggcatgtggatggattggcagacgcagggcacacgcatcacgcgcaatgtgttccacgataacgtccgtgacctcatgattgaagtgagtcatgggccgtatctggtggacaataacgttttcgcctcgccggtgatgttccagaactggtcgcaaggtggtgccttcgtcaacaatctgatttgtggcggcattgaaccgcataccgttctcgaccgttccacgccgtatcactatccgcacaccaccgaggtggccgggtgcgctgtggtatccggcggcgatgagcgttggctgaacaacatgttcgcgccgcaaccggtgaaaccgactgtcggtgaatatggtttgtccgcctacagcgattgcccgatgtcgatgcatgaatacttggaacgccagcgggccatgtgggcagatccttcgcagggtggtggcgagcgcaatcctctgcagtctctatatgcgggcggcaacatctatctgtccggcgcacaggggctgaacaagcaggaaggtgcggccgacgattcggagcgcatgcaggaggacgccccgttcttcggcggcaccgtctccacgagcgttgcgtgtgatgagcccatgccggtgacattggtcgaagaacccgatggactgtatctgcagtgcactgtgccacaggccgtcgccgataccaggatgcaggtcgtcaccagcgatatgctcggcgtgcctcgcatcgtggaggaacgctatgaacagcccgatggcagtgactatgtgctagacaccgacttgctgggacaagccttgaccgcaacggaacgcaaagccggggcgttgaatggtcttgtctccggagagaatcgcatccgaatctgggaatggaacaactgatatgacaaatgcaaccgataccagcaagacattgggcgagtccatgttcgcacagtgcggatatgcccaggacgccatcgataggcgcgtgtcacaggtctggtatgaaattttcgaaggtccgaacaaattctattgggagaacgacgaaggccttgcctatgtgatggacaccggcaacaacgatgtacgtaccgagggtatgagctatgcgatgatgatcgccctgcaatacgaccgtaaggacgtattcgacaagctgtggggctgggtaatgcgtcacatgtacatgaaggacggtcatcatgcgcattatttcgcatggtcggtcgagccggacggtacgccgaactcgaatggtcctgcacctgacggcgaggaatatttcgcgatggacctgttcctcgcctcccgtcgctggggtgatggcgaggatatctacgaatattccgcatggggacgcgagatcttgagatattgcgttcataagggcgaacgctacgacggcgagcccatgtggaatcccgacaacaagctcatcaagttcattccggaaaccgagtggagcgatccgtcctaccatctgccgcacttctatgaagtattcgccgaagaagccgacgaagaagaccgtccattttggcatgaggcagccgccgcaagccgtcgctatctgcaggcggcctgcgacgagcggaccggcatgaacgctgaatacgcggattatgacggaaagccgcatgtcgacgagtccaatcattggcatttctattccgacgcctaccgtaccgcggcgaatatcggactggatgtagcctggaacggtccgcaggaagtgctgtgcgaccgcgtcgccgcgctgcagcgattcttcctgacccacgaccgtactagcgtctacgccatcgacggcaccgccgtggatgaggtcgtgcttcatccggtcggattcctggccgcgaccgcgcaaggcgcacttgcggcggtgcattcggcccagcccgacgcggagcataatgcccgtgaatgggtgcgcatgctgtggaatacgccgatgcgaaccggcacgcgtcgttactatgacaacttcctctatgctttcgccatgctggcgttgagcggaaagtatcggtatgaatgatgattacctcaactaatcctatggtctacacggattttcctgatccagacatcatccgggtcggggacgtgtattacatggccactacgactatgcatttcacacccgggtgcgatattctgcgcagctatgacctagtgcattgggaattcattgcgcacgcattgaatatcgtggcggatacccctgaagaacgtttggaatgtgaaggtgccaacgcctacggtcgaggcatgtgggcgccgtcactgcgttaccatcggggcacctggtatgtgttgttcgccgccaacgatacgcataccagctatctgctgacggcggacgatccatgcggcccatggcgaaagcgtgagcttgacggcttctattacgacagcggactgttctttgacgacgatgatcgagcctatgtcgtacatgggcagtcgacattgcgcatcacggagttgaatcctgaattaagcgggccgatgccgggtgggctcgaccgggtcatcgtgcaggacgatccgcaggctgaccttggttatgagggcagtcacctgtacaagcatgatggacgctattacgtcttcacctgtcacttcccgcaaggcaagggcaaaacagaagcctgcttgatggccgaatccttggatggcgctttcgaagtgcgtgaaattatcgaagacgacctgtccttccacggttacggagtcgcgcaaggcggtatggtggacactccggacggcgactggtatgcattcatgatgcaggaccgcggcggtgtgggacgcgtgccgatactgatgccgatgcggttcggcgaggacggattccccgtcgtcggcgagaacggcaaagtgccgcagtcggtcagcgtgccggctgcaagctgtgccgaacctgtcacgcccatcaacggcagcgaattcatagcccggtataacgccgaaggcggagtcgatgccaactgtctgcggccatactggcagttcaatcacatctcacataacgaatactggtcactgacggaacgtccgggagcattccgcctgcattccggacgcatcagctcgaatctcaatcatgcatggaacacgctgacgcagcgcacgatggggccggtgacggtggccgaagtcaccgtcgacgcgtcgacattgcatgatggcgacttcgccggattggcggcgttccaaggatgctattcctacatcgcgcttacgcgaaggaacggccgcacgatgctgaccgtccaatacaagccggcgaatgacgattccatcttctccgataatgattgggacagtccagccgtaacggatgcggaaatcatggcggatgcggattgcatgcgcctgcgcgcggtatatgatttcaccgattgcaaggatgaagtgacgttcttctaccgcgatgcggatacgccggaatccgaatggtgtccattggggacagcgcaccggatggtcttcaaaatggatcatttcacaggttgccgtatcggattgttcctgtattcgacaaaagagaccggtggaatcgccgatttttacgactttgcgtattcgacgccggatacgaaggaaagagagcaatgaagcgacaggtcatagtggcgcaaggacctgtcgaaggtttggcggctgaggatcagggcatcaccgtgttccgaggggtcccgttcgcccagcctcccgtcggcggtctgcgctggcgtgcgccgcagccggccttgccgtgggatggtgtgctgcaagccttcgatttcgggcctaccgcgatgcagccgacgccgggcgcctccgatgatttctatgatcgtgaatggggcactgatccggccgtgccgatgagcgaggattgcctctacctgaatatttggactccggcattacgcggatatggcgcggatagcatggtaacttccgaaaagctgccggtcatggtctggatctacggcggagcctatcaatgtggcggcacgtttgaaaaggaattcgacggcacacatctcgccgcgaacggcgtcgttgtggtcagtgtggcctatcgtctgaatgcgtttgggtttatgacgcaccctttgcttcatgaggaggccgtagaacgcggcgacggcgaaccatatgcgaatttcggattcctggatcagcgtgccggaatccaatgggtgaaggaaaacatcgcgaagttcggcggagatccggaaaacatcacggttttcggccaatcggccggtgccgccagcgtcttggcccagatctgctcgccgatgaatcatggcctgtttcagaaagccatcatgcaatccggcgcaggcttagggtatttcaatgcgcggcaggacacgctggagcatgcgcaggccaacggaatccgtctgttcgaagcattgggtgtctccacgctggagcaggcccgtgcaatcccggcccgaacggtattggaagccgccgagtccctgcctgttccaccggacagcggacgtgaagatgactggtcgatgatcgtcaattgggtgccatgcgtggacggcctgttccttcccgatcaggaggagcgtatcgtcgagggctgcaaggctaacaacgtcgacatgctggtcggcaacacgaccaatgagttcatcgcttcgactgaagatgggaagcctgtgcatgtcggccagctcggcaatctcacactgatccgcaaatggaccgcaagcggtgggaccgcgccatactactatcatttcgatgtcgccatgccgggggatgatgccggagccttccactcgtccgatctgtggttctcctttggaagccttgcgaaatgctggcgtccgttcgttggatggcattacgatctggcaaggcgaatggggctgtactggaccaatttcgccgccaatggcgatcccaacggaacggaccgtgacggaacgccgcttcctgtatgggatccttgcatcggtgaggaatgccccgccatgcatttgtgccaagaaccgggcatgcggacggattggcttaccgaaacggatcgaaaagcattcggcatgtgacggcatgccgttgatgtatacatactgatatgtaaacagggacggtctttgcggatcgtccctgccgcataatgatttgccgttgcgcgtgcaggaggatttcgagactgattatccgacttttcaccgtttctgtcgtctggttcgtcggtggcgtctcgcggaggctcgggccattaaagaccctgttcggcgttgtgcaggctaggagctgtttgaagtgttctaggccggacgtttcgccgtataggggcgtgtctgcgtggattccgtcggatgtggcgtctcaattgttggacgttgcggtgagcgtgaacgggggtgattatgaggaagactgacccccccgctcatgaccattgccgacacgatggcctatttgcagtgcagtcgtcggctgtcttgttgggtacccaattcgggtaccttgctgggtaccggaaatgttggcattggcgtacatttccgtacattctctgtttgcgccgtatgtcttgaaatcgttggtattccgccgttttggcatgaaaaaaagggcttccggatttctccgaaaaccctcaaggcggagtcagagggattcgaaccctcgagccgctaaacacgactaacaccttagcagggtgcccctatcggccactcaggcatgactccactgttgcgttacgacgcaacagcatgtaactatagcatctatccgcgtgcgaaacaccatattgtgaaaaaatgagagaaaaacgtgtggtgatgtcagtgggactcgaactcgtgagccgtgtcgagcggtctcattgatatgcgacacgccggtatgcccgcaggtttcgccatattcgaacatttgttccaaaactgccgaatcgttgtctatcatggaatcatgagcacggcaccaagaatcgcagcggccaaacgtgactggggtcacgatgaggtcggatgcacggtgctgcatatcgacatggacgcttttttcgcatccctcgaagtggcgcggcatccggaatacgccgacaaaccggtaatcatcggcatcggcaaccgttccgtggtgtccgcggcgaactatgaggcacgcaaatacggcatcaattcggcgatggcaagctcccgggcaagaaaactatgcccgaacggcgtctttctgccggtggacatccactactaccgtgagatgtcccgacgtatcttcacagaggtgttctcccgcgtcaccgatcgcatcgaacaggtttccgtggatgaatgctatatggacgtctccggcgcgctgctgcggtggaagagtccccgcgccatcggagcttggatacgcgatcaggtcgccagacggtaccacatcacctgttccgtcggcatcgcggcgaacaagcttgtcgccaaaatggcttcgaccaatgccaaaccggatggcatgctcatgatccccgtggccagacatgccgaattcgtgcagatgatgccgttgcgtggcgtacctggcatcggtccgtccttggagaaacgactgaacgcatggggcgttgattccgtggctgacttggcgaagatgagcatggaatcgcttgagcaggcgacggggtcagccatcagcgcgcgcgggttgtacatggcggcacgcggattggatgaccgccctgtcgcaccgcgtgcgcaggagaaatccgtcggcgcggaacgcacgttcaacaaggacacccaagacatgcggcaggtgacatccatgctccgctggtgttgcgatgatgtggccggcacgctgcgcagacgagggttgatggcgcgtaaggtcatggtgaagctgcgattcccggatttgagctatgcgacgaaaggacatacgctggactgtccgacggatgcggcaagcatgctgtatccgcaatgtgtcgcattattgctggccatgatgggcatgccggaaagctctatcgacgccatttccttgaccagaccggtgcgacttgccggcatgagcgcgggcggtttggtcgaagcggcggatgcggcggttcagctttcgcttgatgacatgcttgaagagcagaacgaggcgcagcggggtcgtggaacggataccgaaccgtcgacccaatcggaacggttacgcggtgcggaagcggcattagacgcggtacggctcaaatacggtaaaggaagcgtgcgtcttggcatatggcgtacggggccatcaggtaatcttgaacattgagagtgatgtggagcatgagaagaaacagggggagtgccatgagatacagggacaaggcggtgcatgcccgcaacccggaagtgctggttgcagggcgtcgcaggctggccatcgtcgcagccgtcgtgcttgttgtattgctggcggtaggtgggtggttcctgacgcggtgcttgcattcatcacagtcccaagccgggcagggggccgcaacgcagatggacgaggccaagcagaaaaagcatgtggtgaaaaaggccgagccgaaggaacatcacggcaattcgccggactgtccggataccgattgcatcgccatgatggtcaatggcgatctgctgttccaccctggtctgtgggacaacttcgccggtcccaataccgcggcgacggacggtacggcctatgacttcaccagtctgttcgaaccgatgcgcaagtacatcgatgcctccgatatcgcggtgtgcgaattcgaaacgccgatcgcgcctcgcggtggcccctacaccgggtatccggtgttcaacattccctcggaggtcgccgacgcggccgccaaggtggggtatcgcgcatgcacgcatgcgtcgaaccattcgtgggatcaaggcgcggatggcatcacacgcctgtgggataccctcgaccaggacggcatcgcccagacgggctcctacaagaccgaggaagactctaccaaaccgctggtcatcgattctccgaccggtggcggcaaactgggcctgatcgccggtaccgtgtccctgaacgcgcaaactcccgattatgattggcgcgtcgaccgtctgcgcgagagcggcgatccgaaccatcaggccgacatcgacaaagccgtggccaaagccaaagaggcccgtaaacaaggcgccgacgtggtggccatcgccatgcattccgtgcaagaatatcttgactacgccgactcgtggcagcagtccgaagcgcatgagctggccgacaccggtgcgttcgacgtcatctacggtgccggatgccactgtgcgcagcccgttgagaactacaacggcacatggatcatctacggtctgggcaacgcggtgacggtcacgtcctacattccaggcaacgaggtcaacaaccaaggcgtgacggcccgcgtccagttcgccggcaagaaaggcgtggccggctcatggcgggtcaatcgcatcgattgggtgccgacggccaatgtgcgtcaaggccaataccagtggtgtccgatttcggacgaccatccggatggagcctgttggaacgaaacagaagatgccaatcagagacaacgtatctggaacgtgatctattccatgggcgcggatcagaacgtggttcgcgaatggaacatcaccgcagagcaagctggttcatctggaaagtagtttcccgtggcagaatatgcctcgtattcgttaatcgacctgtatggagcgtttccgctcgtgatgtgaggtgaaagaaatggatggagttttcgagacccagccggaccgcaccgacttgccgctggtggtcatgccggtggtcatcgaatcgatgatcggaccgttcaaacggaacttcacgatgctcgaaaacgtggcccgcgtgcggatgtacgaggatttcacactggacgaggacaccatcgtggaacgctgcaaggatgccgacgccgtcatggtcatcggattccactgcgccgatgccatcctcgacaggctcgacgccaagtgctatgcgttcggaggcaccggcgtcgccagctacatcaatcttgagaaaaccaaggaacgcggcatccgtgtctgcaacgtgctgcattacggcgatcacgccgtcgccgagcacgccatggcgttgctcatggaactgaccaggcacgccggagcgcttgatatgcaggtcaagcaaggcgattgggacggtgccgacggtttcgaactgttcggcaagaagctcggcatcatcggactcggcggcatcgggcagaccgtggccggcatcgccaacgctttcggcatgaaagtatccgcgtggaactcccacgtgccggcacaggtgttcgagaacctgaatgtcactccggtggaagacatgaacgagttgatctcgaattcagacgtggtcagcgtgcatatgccgttgcttgactccacccgtggcatcatcacggcgaagaacctcgacgcgttgcgtccgggaaccctgttcgtcaacaccgcccgcgccgaagtcatcgaacccggcgcactgctcgcaagacttcaacgcggagacattccggcggccttggacgtgttcgatcatgagccgcttgccgccgacgatcctttgtgcaagattcccggcatcgtgctcaccccgcacatcgcatggcgcaccgacggcgcgtatatcggcatgaccaagcaggtggtccaatccatcgccgccttcttcaagggggaggaattcaacgtcgtcgtctgaaaaaataaccaggaagcagcatatgcgcgcggtcggtgaggttaggtaggttgaacagcatgcagaccatactcgattccgccgatcggccggcgcacgacgccttcgtcgaaaagaaatcggaattcatcggagacgcctgtcatatcagctcgttggatgaggcgctcgctttcgttcagacgatccgtgaccagcatccgaaagcccggcatgtcgcctatgccgcggtgtgtggtggatccgatggacgtcttgcggaacgcatgagcgatgatggcgagccgtccggaaccgccggcaagcccattctcgacgtgctgcgggcaaacgaaatgactgattgcgtggtcgcggtcacacggtatttcggcggtatcctgcttggttccggcggcctgatccgtgcgtattccacaggtgcgtcaattgcggtcaaggctgcttccaaggcgaaaatcgtaccgtgcggcgaatatcaggtaactcttgattatccgcagttgggcagcttccagaatctgttatcaacggtggaaggcgaacagaccgacgcgcagtacactgaccgcatcgccttgactgtggtggttccgcaggaacaggcgaatgtcttcgaatcccgagttgtggaaactttcaacgctacggtcgttccgcaactggtgggcacgtccaaccgtccggtcaaagtatgagttcacgttgtgagccgcatgcatatagtgtcgtaaggtgaaaatatgagtgatgagaacgagcagcatgagaatgatccgcaggccgacgcctcgaacgccgatgagaccgtggatttcgagccgttgaccgccacatacgagcggctccggcattccactgattccaccgcattaagcgagttcgccagacgtccgctgccggaccggagcgaccaggcggcgttctcccgtgccaccgcattgcttgaggctgtggctggcaacgcgcatacgccggtggaggaccgcgtcttccttgccgaaaccatgccgttcccgaacattctggtcaagctttccaccgacgagtctcctgacgtacgcaaagccgttgcgggaaacgccgatgacaagaactggctggtgggccgactgaccaaggatgagtcgcccgaagtgcgtgccaccgcgctgcgcaacaaacgtacgtcttggaaaatgcgtcttgaaggcgccgaagattccaccatggattccgacacgcttgatttcctgggctcgttgggaacgcaggtcgaaccggacgctccggtggtgcttgcgaccatggtgcgcagggccgtcgccttgaatccgaatgtttccgatcggatgctccagcagttggcgcaggacgcttcaagcgacgtgcagaaggccgctcaacggcagcttgcggaaaaataattgcatacgttgtcatttttatgagattcctgcgcgtggtgcgcatgttttggtcctagactgggaaccatgacagaacagaccgaaaacgcaacgcgtctcgcccgtccgctcattcgtctggcaaagctggtgggtgtcgccaccagctacgtcggtatgagccatgattaccacgaaatcgaagacgatgttctagtggcggtgctcaaggcgcttggtattgacgcttccaacgatgaggcgatcaaccagtccatcacatccatcaagtccgaacgcgaaacgcgcgtggtggctcccaccgtgctgcatatcgtgggcaaggaaagcaaggtggaggtgcacggcggtatgttcgatgtgccggaagcctccatcacgctggaaaacggcaagcaattcacgggcaaaatctcccatgagggcggtgagaaaatcgcccatgagattgatggcagcttcttcttcacgtcgtatctcgtcctgcccgccgatctgcccgaaggctatcacaccctcgaggtcactgtcggcaacgaggcggagaatgcaaccgttatcagcgctcctgagaaaatcgaactgctcgatgatatgaagaacggctccctgtgggggtggatgagccagctgtactccatccgttccaagggatcctggggcgtgggagacttcgaagatctgaagaccatgctggtcgaggccaaaaagaagaccggctccgacttcatgcttatcaacccgatgcacgccgcggagccggtgcctccgctgacgccatcgccgtatctgccgatttcccgccgtttcatcaatttcagctacatccgtccggagtccatgccggaatatctcacgctgtcccacgaggacagggctgaagtcgatgcgctgcacgagcaggtcgaatcgctgaatgacgacgcgcggctgatcgatcgcgacgccatgtggcgcgtcaagaagcatgcgctgtgggtcatctacaaggccggccgaaccaaagctcgccaggccgaattcgaccgttacctcgccgaatgcggagacgagatcgaatcctacgccacctggtgcctgtgctacgacaagtggggagctccctccgacgacgccgataattgggtgcgcaaatacaaccgtgattccgaagaagtcgcgcagttgcgtgagaagttcccggacacccttgagttctaccgctggcttgagtgggtcgccaccgatcagttgcacgcggcgcagcaggccgcccgcaaggccggtatgaagatcggcatcgtcgcggatatggccgtcggcgtgcatccggcaggatccgatgtgtggtggaatccggaacgcttcgccaagggcgccacggtcggtgccccgccggacatgttcaaccagcagggccaggattggagccagccgccgcttaacccgatcgccctcgaacagaccggattcaaggtgtaccgggatatggtgcatgacatgttcgccaatgccggtgcggtgcgtatcgatcatatccttggtctgttccgcctatggtggattccggaaggcaagcccgccactgatggcacatatgtgcattacgattccgatgtcatgctcggcattctcgcgcttgaggcttcccgcgctggtggcgtggttgtcggcgaggatctgggtgtcgtgccggcctatgtgtccaagtcgctgtccgaacatggcattctcggttgtgccgtggaatggttcgaacagatggacggtgtgttccgcactccgaaggattggcgtccgtacgcactggcgtccgtcaatacgcatgacatgcctccggcggccggttacctcgaatatggccacgtcaagttgcgtgaacagctcggcctgctgtccggtccggtggaggaattccagaagtccgcaaccgccgagcacaatgccatgctgaacatgctggtcgaggagggctatctcgacaaggctgctctggatgacgaagccgccaacgaaaacgagattgtcgacgcgctgtaccgtggtctgaaaggttcgccctgcaagctcatggccgcctccatcgtcgacgcggtcggtgagaagcgcacgcagaaccagccgggcaccaataacgagtatccgaattggcgtattccgctggccgatggcgaaggcaacgtggtgccgctcgaaaagctcttcgacgaaccgcgtctgcaggaggtcaccgccatcatgcgtggctgatcttctataggcgattccatggggtgtccacaggtccgacggtctgcggacacccttgtttttcgtgttgccgaatgtcaaggcaggcgatatactagtagactgttgtgtttccctacggggtccttcaaagcgcttttcccactcgccatcgaggactttcagggagcccacggataatgagacctgaaaaacggcattattccgcgcccaaccaacgcgtgtaatgctgatggatggtccggaacacaatatatagaaaaggtacatcgtgaaaactttcactccgaagccagctgatctgactcacgactggtacgtcatcgacgccaccgacgtggtgctcggtcgtctcgccactcaggcggcaaccctgctgcgtggcaagaacaagccgacctacgctccgcacgccgattccggcaaccacgtgatcatcctcaacgccgacaagatcgctctgaccggcaacaagttgggcaaggaactgtacatgcactccggtcgtccgggtggcctgcgccgcgatagctacgcccagctgctcaagaccaaccccgagcgcatcatcaagtctgccatcaagggcatgctgccgaagaaccgtctggccaaggttcagctggatcgtctccacatcgttcgcggtgccgagcatccgtacgctggcatgaagccgcaggttttcgagatcgctcaggtctcgcagcaggctaagtgaaccgaagggagataagaaacatggctgaaaacaccaacgactccgcggttctcgagaccgaagaggagctcacctcgtacaccaccgagaccaacgctggcgctggcaccggtacttccaccatcgctccgggctacggcaccggtcgtcgtaaggaagccgtcgcccgtgttcgcctggttccgggcaccggcaagtggaccatcaatggtcgcaccctggaagagtacttcccggccaagctgctgcagcgtgaggtcaactccccgatcgttctgctcaagctcgaaggcaagttcgacgctatcgtcctcgttgacggtggcggcaccaccggccaggctggcgcaatccgcctgggcgttgcccgcgctctgaacgctatcgatcgtgatgcgaaccgcgccgccctgaagaaggctggcttcctgacccgcgacgcccgcgtcgtggaacgcaagaaggctggtctgcacaaggcacgtcgcgctccgcagttctcgaagcgctaaagcttacagcaagctttattcgaaacccctcggaaacctatggtctccgaggggtttcctcgttattgtgggcaagcattagatgcgttggacgcaatgggctcgttagatgtgttggacgtatctggcagacgttgcagatgaagcatccgcatctccctcattcgcggcccacccgttaccggacgtttcggatgggccgtttgcgtattgatgtatgcgccgattcgttgcgccgtccgctgcgcgtcaatccgtcgaaatctgcttcatcgcgctgatgctcagagccggcagcgtccacagggtcggatcgtcctcggacaacccgtcgtccgcggagttcagactgtcggcattctcatccatctgacaatacatggtattgagacgctgcagatggttgcggaatcgcccggcaggtttgtcctccgcttcctcatcgaactcggccagcttctcgatctgcgtgccctgtccgggatattcgccggcgatttccgccgaggaccagatcatttcccattcgatgtcgttgggcagatggaatctgacgttctcgtcggacccattgaccagaatgagcaggcttggctcgtcgggggagagcagctgcatggcgaacgatcggaccgagggattcgtccaatccgcatcatgcggcgtctttccgttcggcaggaaccagtgcacgcggtcggatttcttcaacagtccgattttgctcagtcgggtgaagaaatcctcatggttgtagaggtcccgggcctttctcagcgctatcagccgggaagtgaggttgaacagcttgagctccgcggtctgctcggtgctgtacagccaatcccaatccagccatgtggtctcattgtcctgcgtgtaggcgttgttgttgccgttctgcgagttgccgaattcgtcgccggcaagcagcatcggcgtgcccagggagagcagcagcgtgcccagcatgttcatgatggcccgttctcgttgctgtgtgatgatcggatcactgaacgggccttcatgtccgaaattgacggaatggttgttgtcgctgccgtcccggttgttctctccgttggcttcgttgtgcttatgccgatactgggtcagatcggcggtggtgaagccgtcgtggcatgccacgtagttcacggatgcggtcgatccgcgtccggggtcggtggcgaacagatcggctgagccgcataggcgcgtggccatggactgcatggtcatgtcgccggtttcaccaccacgtgcacgttccacatcggtcagccagaaggtgcgtgtgcaatcgcggaagcggtcgttccattccgcgaaggggatgccgaattgtcccgttctccagccgttcgggccgcaatcccacggttccatgatcatcttgaggttgccgagcagcagatcggagcgcaacgcgtacaggaacgggtggtatcgcgtgaattcgccgtcaagacgcgccagcgtcgccgcaagatcgaatcggaatccgtcgataccaatgcgtttggcccaatagcgcaacgaatccacggcgaacgtggtgacgtgcgtgttggtgaaatcaagcgtgttgccgcaaccggtggtgtcgtacaggcggctgatcttgtctttggtgcgtcggtagtacgagagattgtcaaggcctcgccagcaaatggtcgggccttcggggcctgattcgcaggtgtggttgtacaccacgtccatgatgacctcgaaaccggcctcatgcatggcccgcaccatgtcgatgacctcctgccgcacggcgcccgctcccgcttcctgcgcctgcttggtggcgtacgaggcttcgggggcgaagtagccgagcgtggaatagccccagtaattcgtgcgattgcgttcctgcaggaacagttcggattgcttggcttggatgggcagcagttcgatggatgtcacgccgaggtcctgcagataggagagcgtggccggatgggcgaggccggcataggtgccgcgcaattccggaggaagccatggggcgttcgcggtgaatcctttgacgtgcagttcgtagatgacggttttgctccatggcacatgcgggtgggatggttctcccatatgcttgttgatgtcgcggtcgtcaatggccacggaaacaggcatgtgtcccagagagtccacggtgctcatcggtccgaacggcgaaccggcgaccttgccgtttttgatctcgcattcgtaggcgaaggcgcccgggtcgagttccatcttgccttcgatgcctttggcgtatgggtcgagcagcagtttgtatggattgaagctcacgccatggtttggatcccatgggccgttgacgcggtatccgtattgcatgccgtcccatgcttgcggcacgtgcacgtaccacagtccgtagttgggaccgtccatgcggaacagtgtttcgcgaagattgagcgagggaatgcgtctggtgcagatgcgctgttttttggcctgatcgatgaacgtgagtccgggttcgttgaacagccgtgcggcgtcggcatagaaggcgctcggttggtcaagtggttcaagtacgcaaaaccacacttggtctgctgtttctgagcggacaacggcgtccgcgccaccatcgtcggtgaaatagagacctgggcgggttgcgtagcggtgcaaaggtgggttcttcataacctcattctaaacactttgaaattatctgttgacttgctatgtcgaggctgtcgacgctcgtgccggtctgatccagccgtgagcttgaactcgagcaggtgcaggacttcctcgacggcaaaatcgccgccgcttccaaggctgtcgtcaaaatcggcgccggacgctgtttattcgtcctgaacagcttggaattagcgaaaaagtatcacgacatgacggcaaatgcgccgccgacatcgccgcatagcgcatatcctaatcacaaaagggaaaaaatcaatcgtattcatcgttatcaggaggtaattttatgacgaaagcaatgtctgaattcactaccgatctgcagcattccggtatgccggcgaaggatctcgacgaaaccatcgaattctatacgaagaagcttggtttcgaactggccggactgttccataacggcgaaaatcgttgtgcattcctgcgttacggccatctgaccatcgaaacgtgggagggtgatccggctccgctgaccactggtgccatcaatcattgggcattcgacactcccgacatcgaagctgcattcgaaaacgcgaaggaactcgggctgaatttcaaagataacgaaatccagcatatcgacagcttctgggagcatggcatccgctacttcaacgtgtacggaccgaacggcgaaaccattgaattctgtcaaattgtcaaataactatcgttagatgattgctgtcaaataatcgttgaaaacaaatacaacaggcgaaacagacggaagcaaacaaagaagcgtgcgctgaaccttatatacgggttcggaacacgcttcttttttgttatgcaatcgatgcgactaatgcgattaatatgtgcgcaaaagcggtcacatatcgcatagttcgcgtacgtacggctccacaaaacgcagagccgcgccgataatgtcttgatggtcgagcgccattcccttgcgcagggtgaaatccgtggtgccgaatggcgtatgttccaccacgcgttcgcgtagtccggccatatcgtcctcatcgagatattgtgctgcctcaccgctgatgatcacgtcaccggccagcaccgagcgaatattcgttaccgccagcgccacataatccagccattgcgagaatcgttcgcgatgctcctgctcgccttgttccaacaccgagaagaagccgggcaggctttcgccgtcttccatcagcgtttccggcgagcaatacgtatccatgcagccctgttgcccgcagtagcaggtgttgcctcctggaatcagcgtcatatgttcgattgagccattgcattggttgggcccttggtagagcgatccgtctacgatgaccgcgcctctggggcgtcgctcgaggtagatgcagacggcatccttcagattgtggtcgaaccagagttccgccatggcagaagcgtcggaatcgtgaatcatcagcgacggatagttgaggccgtggctgagttcgttgagtttcaggccggtgttgttcatgattttgccgaaggtgatcgactgcccgtctgccgatacgatgccttgcatgcagaaggccacgcctcgcaccgtgctgccttgtttcgccagttcctgcgcgaaatcgttgatgatgccgttcatgcgctggtagtaggcgtcgttgttacgataggggagtgtgcgctgtctggtggccacggatttgccgttcagatcaatggcgatggccgtgattcgtgtggtttggattcgcacgccgatagccacgctggagtgtgccgcgaattcgtagatttgcgctttgcgtccaccggtggattgctgcatctcgcctttgacgatgagcccgtcggcctccatggcgcgcagattctgcgtgatggttggcaggctgagccctaattcgtgttcgaacatctgcttggtggctgaaccttgagtgtagatgaacgcggtcatggccttgagattggcttctttgactgatagggcggattgggctttcactggttgatccttcctgcgcaacttcttttccaagattacttcataaaagtcctttccttatgtctcgtgttggtctgagatatcaggtattgcaaaaaagtatcaaaaacagctgtgcataaaggattttctgccacttttctgcgtcgaaaatatatttatcaacaaaaaaagttgagacggtgacaacgacgttctaccaagaaaagagacatgttatgaagataggtctgccgcgcacgctattggccggcttggtcgccatagcggtgttcatgaccggcgatggctttgaattgacttttttgtccaaatacatcgtggaccagggattcagctcttcgcaatcgtcgctgatgttcaccatgtacgggctggtggctgcgcttgccggctgggcgtccggtgtgctagctgaaatgttcggtgccaaacgcatcatgcttatcggcgcgagcgcctgggtcgttttgcacctgctgttcgttggtgtggcgttgccgagcggcgtctatccgctgatgttaggcgtgtatgcgttgcggggtgttggctacccgctgttcatctactcgttcgtggtgttgatggcgcaaaccatcgatcctgccaagctcgcgtcggccatggggtggttttgggccgcctactcgttcggcatcggcgtgtttggcgcatatttgccgagtttcaccattccgatggtgggcgagtactattcgctgtggctttcgttgccgttttctatagctggactgctgatttgcctgctgatggtgccgaaaagcaagggttctggcacctcttccatgagcaatgcagacaagctgcgcgagcttagtcgaggagtcaccattctggtgcataatcgccaaatcgctttggctgcggtggtgcgtgtgatctgcaatctgacgttgtatggctttcccgtcatcatgccactctacttggccactaccaacaatggcggcggtgcttggtttaaggtttcgcaatggagccagatttggggattccagtttgtggtcaccattttcggcaatgtgttctggggtcgtatgggcgattcgcatggttggatgcggcaaatgcgctggtttggctgctggttctgtgtgatcggcacgctgggcatgtattacattccgcagtttttcggggcgaatatggtgcttatgtgtgctgatgcggttgttcttggattgggaatttccgctttcgttcctatgggagccgtgtttcccgcgttggcgttggaacataagggtgctgcgatttccgcgcataatttcgcttccggcctggctacgtttttcggtccgctgattgcgacggtgctggtttccactatcggattcggcggcgtgtgctggacgtatgcgatctgctatgcgatcggatcgttggtcacgttcggcattcatcctcatcaacccggatttgacgatcgcggccatcgcattgccgcgatcgagcgtaactaatcgcaattgaatatcaattgctcgatcatcatttttctcaaaaaacatcattatccacaaaggagaataatcatgaaggcagtcgttctcgaagagcagggcgtcatcaatgtgcgtgaggtgcctgacgtccccgcacctggtctaggcgagctgaagatcgcgccgcataccgttggtgtgtgcggttccgacctgcactattacactcatggtcgcgtgggcaaatatgtggtggagcagccgatgattctcggtcatgaggcttccggcacggtggttgaggtcggtcctggcgtcgaaggcttcaaggtgggcgatcgtgtggccatggagcccggcattccggatatgagttcgcgtgccagcaaactgggcatgtataacgtcgatcctgcggtgcgtttctttgccactccgccgattgatggctgcctgtgcgaaacggtgaaccatcctgcggcgttcacctacaagctgcccgacaatgtgagcttcggtgagggtgcgctgcttgaaccgttggctgtgggcatgtggtccgccaccaaggctcgtatcaagccgggcgatgtctgcgtggtcaccggatcgggcacggtcggcatgctgaccgcgtcgtgcgcgttggcaggtggtgcttccaaggtgctgatttctgatgtgtcggcaatcaaactggcgattgcggctcagattccaggtattattccggtggatctcaccaaagaggatctggtggagcgcgtccgtgaggaaacggggggttggggtgctgatgtggctttcgagtgctcgggctcgccgaagtcatacgagacattctggaagctgattgctcccggtggcgctgccgttatcgttggcattccggtcagtccggtggctatcgacattacggaactgcaggctaccgaggtgcgcatcgaaaatatcttccgttatgccaatgtgtatcagaaggccattgacctcgtggctaacggtaaactgaatctgaagccattcatcaccgacacctatgcgatggaggatgccaaggcggcgttcgatcgcatggccgaggggcgtcctggagatattaagctgcagattaccgtgaataacgactgacgttacgcacgttacggaacgacgaaaggggtctaggccatgggtgctgttgtacaagtcaacgataatcggcatgggaaggcggctttggctcagacctcttttggtggattcgtgccgaaaggtggaagttcgaacgattccggcgtattggagatcattgtgccggacgcgcaggcttcggtgcgttgggtgaagcatggctacccaagctcgttggcgaaatggcatcatcatcctcatattgaaattcatctgattcgggaaggtaccggattgatgatggcgggcaatgccgttgttccgtatgaggccgggcaggttgcgctgattggttcgaatcttccgcataattgggtgtccgacatcgctccgggggagcggcttcgtcagcgtgatgtggtgtgccatgtgcgtccggaaaccatacgtctgctgatgtctggatttccggaaacgtctggttttgcaatggtgttgaggcgtgcggggcaggcgttggtgctgagcggtgaatccgctcgtcaggccggttcgattctggaaagcatggaggaacatagtcttgcttgccgtgttagtgatctgattcgtgtgttggatgtgttcgcgcatgcctcagcagatgaatcctatacagtggttgcgtccggatacgatccggctgtatgcagtggtgcggaaagtgtggtcaacgatgccattgagtacatttcctcgcatctgagcggtgaaattagcctggatttggccgctcgtcaggctggaatgagtgtgtcggctttctctcgtctgttcaaaagggccgcaggaataaggttttcggattttgttcgacgattgcgtatcgggcatgcgtgcagattgctgacgaccacgaatcaaagcgtcgcgtcgattcgtcgtgcttgcggatatggaaacgcttcgaatttcaatcgtcgcttctttgaagaaacgggcgaaactcctactggctggcggaaaaaatacattggacggacaagataagtaaataaagtttgtaaaagtttgatatgattgatatcatatagaaaatacttttataaaagatgaggaggtgagacttgagaaagtgtgtgtgatttatgataaaaagcaacaaaaacgctcaaaatgatgtttttaaagctttttctcttcacaaaagaacgcaatctaaacattaaatgaacagaatataacatttctcttgcgacacgacgcagtggaaaatcatattgcatactcactaaagtgtgtcctaggtcacaaaagaccagcaacgcgtccatccgcttcgaggtgggtggaataacgggaaactactttgcaaacccccaaagaatcgaggaggacttcaagtggcagacgcaaagaaggaagagccgaccaagccgactccggaagagaagctcgccgcagccgaggctgaggtcgacgctctggtcaagaagggcctgaaggctcttgacgatttcgaaaagctcgatcagaagcaggttgaccgtatcgtcgccaaggcttccgtcgcagcgctgaacaagcatctggtgctcgccaagatggccgtcgaggagacccaccgtggtctggtcgaagacaaggccaccaagaacatcttcgcctgcgaacacgtcaccaattacctggccggacagaagaccgtcggcatcatccgcgaagacgatgtcatgggcatcgacgagatcgccgaaccggtcggcgtcgtcgccggcgtgaccccggtcaccaacccgacctccaccgccatcttcaagtcgctgatcgcactgaagacccgctgcccgatcatcttcggcttccacccgggcgcgcagaagtgctccgtagaagccgccaagatcgtgcgtgacgcggccatcgaggcaggcgctcccgagaactgtatccagtggatcgagcacccgtccatcgaagccaccggcgccctgatgaagcatgacggtatcgccaccatcctcgccaccggtggtccgggcatggtcaaggccgcatactcctccggcaagccggccctcggcgtcggcgctggcaacgctccggcatatgtcgacaagaacgttgacatcgtgcgcgccgccaacgatctggtgctctccaagcacttcgattacggcatgatctgcgccaccgagcaggccatcatcgccgacaaggaagtctacgctccgctgatcaaggaactcaagcgtcgcaaggcctacttcgtgaacgacgaagagaaggccaagctcgagcagtacatgttcggctgcaccgcatactccggccagaccccgaagctcaactctgtggtgccgggcaagtccccgcagtacatcgccaaggccgcaggctttgagattccggaagacgccaccatccttgccgctgagtgcaaggaagtcggcgagaacgagccgctgaccatggagaagcttgctccggtccaggccgtgctgaagtccgacaacaaggaacaggccttcgagatgtgcgaagccatgctcaagcatggcgccggccacaccgcagccatccataccaacgatcaggctctggtccgcgagtacggccagcgcatgcacgcctgccgtatcatctggaactccccgagctccctcggcggcgtgggcgacatctacaacgccatcgccccgtccctgaccctgggctgcggctcctacggcggcaactccgtgtccggcaacgtccaggcagtcaacctcatcaacatcaagcgcatcgctcggaggaacaacaacatgcagtggttcaagattccggccaagacctacttcgagccgaacgccatcaagtacctgcgcgacatgtacggcatcgaaaaggccgtcattgtgtgcgataaggtcatggagcagctcggcatcgtcgacaagatcatcgatcagctgcgtgcacgttccaaccgcgtgaccttccgtatcatcgattatgtcgagccggagccgagcgtcgaaaccgtcgaacgcggcgccgctatgatgcgcgaggagttcgagccggataccatcatcgccgtcggcggtggttccccgatggatgcgtccaagatcatgtggctgctgtacgagcacccggaaatctccttctccgatgtgcgtgagaagttcttcgatatccgtaagcgcgcgttcaagatcccgccgctgggcaagaaggccaagctggtgtgcatcccgacttcctccggcaccggttccgaagtcacgccgttcgctgtgatcaccgaccacaagaccggctacaagtacccgatcaccgattacgcgctgaccccgtccgtcgccatcgtcgatccggtgctggcccgcacccagccgcgcaagctcgcttccgacgccggcttcgacgccctgacccacgcatttgaggcttacgtctccgtctacgccaacgacttcaccgatggcatggctctgcacgcggccaagctggtgtgggacaacctcgccgagtccgtcaatggcgagccgggtgaggagaagacccgcgcccaggagaagatgcacaacgccgccaccatggccggcatggcattcggctccgcgttcctcggcatgtgccacggcatggcccacaccatcggcgctctgtgccacgtggcccacggccgcaccaactccatcctcctgccgtacgtgatccgttacaacggttccgtcccggaggagccgaccagctggccgaagtacaacaagtacatcgctccggaacgctaccaggagatcgccaagaaccttggcgtgaacccgggcaagactccggaagagggcgtcgagaacctggccaaggccgttgaggactaccgtgacaacaagctcggcatgaacaagagcttcaaggagtgcggtgtggatgaggactactactggtccatcatcgaccagatcggcatgcgcgcctacgaagaccagtgcgcaccggcgaacccgcgtatcccgcaaatcgaggatatgaaggacatcgccatcgcggcctactacggcgtcagccaggaggaaggccacaagctgcgcatcgagcgtcagggcgaggccgccacggaggaagcctccgagcgcatgtgaggtccgcgtgaagcgcaccatatatatggaccacagcgcgtccatgtatatataaggagtaatccgtaaggagcccggtcgggaacggtcccgccgggctccttggcattgccgcggtcttccgtgatgatgggtatccgccgacagcatggattcccggcgagagtgatatggcgtggctttgagcgtaatggggctggatttcactgttgttttttagtagcgtagtggaatgaccgatatttcgaatcaacgacctgcgcaattacgaagacgcggaggattgcgtttatggctccctgggcagccgggtgcgctcatgatggtgctttccccggccgttgcgggaatcgtggtcgcatgggcgtaccgtggattcgcgtggacgccttggtggttgctcatctgctggctgttgtgctactgcgtgcagttttccgccgcgcgttggttcaaatcgcatggtgcccgccgctggatgctgcagccattggtgtactgcatcgtgctttgcgcggtcggtctgccgtttgtggtgctgcatccggggattctcgcttgggctccgccgtttgcggtgcttgccgcgatttcgttccgtgcctcgtgggtgcgcaaggagcgttcgctatggtcgaacgccgcggcggtgtcggcctcctgcctgatgccgatgctgacgttctgctatggcgtcgatacgcctgacattccgtatctcagcatacccgggatatcgttgttccttacgtttttcatggtgcagttcggctcggtgctgtttgtcaagacgatgattcgcgagcgggggagaaggtcgtacatcgtggcctcctggatttggcatgccgtcatgctggcatggtggaccttcgtcggtaacggatatctgatcgcattggcggcgatgctgctcatacgggccgtcgccctgccgatgatcgcacgtcggcgtacggtcaggccgttggccgtcggcatcaccgaattcgtgacgagcacggcctcgctgatactcaacatctgcgcattgctttgatggcattcggcgacacgccagaatttcttaaggccacccctgatgcttaaataaagaagttgcctgattttagggctcgcaaattggaattaaaaaagcgagcgtggcacagagattcacgtgagtgagcatctgcatggctacgcactgatgtggtatgaccacggggctgtatggctctgtgggtcttctgcgccggtgccctttgagaagcaggctggtaaacagtaaataacgaatcgctagaaagggcggaaggcaatggcgggacagaaaatccgcatcaggcttaagtcctatgaccatgaggtcatcgaccaatcggcgaagaagatcgtcgaaacggtgacgaacgcgggcgcaactgtggttggcccggttccgctcccgaccgagaagaacgtgttcgtcgttatccgttctcctcacaagtacaaggattctcgcgagcatttcgagatgcgcactcataagcgtctcatcgacattgtggacccgaccccgaaggccgtggactccctcatgcacattgatctgcccgcagacgtgaacatcgagatcaagctgtaagggaggagggaaccattatgtctaatcgcaccgcactgctgggcaagaagctcggtatgtctcaggtctgggacgagaacggtttcttcgttcctgtgaccctcgttgacgtgtccaccaacgtggtgaccgctgtcaagtccgaagagtccgacggctacaaggctgttcagcttggctacggccaggttgacccgaccaaggtgaccaagccgctcgccggccacttcgccaaggctggcgtcaccccgcgtcgtcacctcgctgaggtccgcaccgataacgccgaagagttcgagccgggtcaggagctgaccgctgagctgttcccggaaggcaccctggtcgacgtgaccggtaccaccaagggcaagggcttcgcaggcaccatcaagcgttggggcttcaagtcctatcgtcgtacccacggctctcacaagaacgagcgtcgtcctggctctgttggcgcatgcgccaccccgagccgcatcctcaagggcaagcgcatggctggccgcatgggtcatgtgaccaacaccgcgctgaacctcaccatcgtttcgtcggatgttgagaacggcgtgctggctatcaagggcgccattccgggcccgaagggcagcatcgttctcgtccgttcggcagtgaagggagcctgataaatcatggcaaacgttactctgaacgtcaccgataaccagggcaaggccaccggcaccgtcgatgccccggctgagatcttcggcttctccgctgaagaagttcagtcccgcatcccgctgatccaccaggtcgtcatcgcccagctcgccgctgctcgccagggcacccacgccaccaagactcgtggcatggtttccggcggtggccgcaagccgtggaagcagaagggcaccggtcgtgctcgtcagggctccatccgtgcaccgcagtggtaccacggcggcaccgtgttcggtccgcagccgcgtgactactcccagcgcaccccgaagaagatgaaggccgctgctctgaagtacgtgctttccgatcgtgccaacgccggtcacgtggccgttgtcgacttcggtgtttccgaagccccgtccaccaaggccgccgtcgccgcgcttactccggtgaccgagaacaagttcaccaccgtggtgctctctcgcgagaatgtgaacgaatggctttccgttcgtaacatcccgaccgttcacccgatcttcgccgatcagctcaacacgtacgatgtggtcaccgctcagtacgtggtcttctccaaggaaggctttgatgctttcctcgctgcgaaggctgagccggctgcaaaggaggcctgattttcatggtcgctattcacaagcccgcacacgacatcatcctcaagcctgtcgtttctgagaagagctacgctctgtccgatcgcggtcagtacaccttcgtggtggccccgaacgcgaacaaggttcagatcaagcaggcaatcgaagagatcttcaatgtcaaggtgacgaacgtcaacaccctcaaccgcgccggcaagcgccagcgcacccgcaacggtttcggccagcgcgtcaatcagaagcgcgccatcgtgaccgtcgccgagggccagacgatcgacatcttcggtaactgaaggctagccgagaaaagttaaaggaagaactagattatggctatccgcgtttataagccgacgactgcaggccgccgtaacgcgtccgtctcggacttctccgagcttacgcgctccacgcctgagaagtcgctggttcgcaagctcagcaagactggcggtcgtaactcctacggccgtatgacctcccgtcatcgcggcggcggtcacaagcgccagtaccgtctcatcgacttcaagcgttgggacaaggacggcgtgccggccaaggtcgctcacatcgagtacgacccgaaccgttccgcccgcatcgcactgctgcactacgcagacggtgagaagcgttacatcatcgctccggaaggcatcaagcagggcgacgtcatcgagaccggcgctcaggctgatatcaagccgggcaacaacctgccgctgcgcaacatcccgaccggtaccgtggtgcacgcgattgagctccgcccgctgggtggcgccaagatcgcccgctccgccggtgctgccgtgcagctcgtcgccaaggatggcgcctacgctcagctgcgtatgccgtccggcgaaatccgcaacgtggacgctcgctgccgcgcgaccgttggtgaggtcggcaactccgaccacgccaacatccagcttggcaaggcaggccgcgctcgttggatgggcaagcgcccgatcacccgtggtgagtccatgaaccctgtcgatcacccgcacggcggtcgtacccgcggtggcaagccgccggtttctccgtggggcaagggcgaggttcgtacccgccgtccgaagaaggcttcgaacaagatgattgttcgtcgtcgcccgaatggtaagaaccgtaagtaagggagtgtcgagtagatgactcgtagcatcaagaagggccccttcgtcgacgcccacctgcagaagaaagtcgacgagcagaacgagaagggtacgcacaacgtcatcaagacgtggtcccgtcgttcgatgatcacccctgatttcatcggacacaccttcgccgttcatgatggccgcaagcatgttccggtgttcgtcaccgaatccatggttggccacaagctcggtgagttcgccccgaccaagaccttcaagggtcatgtgaaggacgacaagaaggcacgccgctaaaggagagtaaggacacatggaagctaaagcaatcgctcgtcacgtccgcgtgacgccgcgcaaggctcgccgtatggtcgacctcatccgaggcaagaaggcgaccgaagccatcaccattctgaagttcgctccgcaggacgcatccctcccggtgcgtaaggtcctggagagcgccatcgcgaacgctcgtgtgaaagccgacaaggccggcgagccgttccgcgagaacgacctggtcgtgaaggagacctatgtggacgaaggcgtgacgctcaagcgtttccgcgcccgtgcacagggccgtgccgctcgtatcaacaagcgcaccagccacatcacggtcgtcgtcgctaacaaggaaggaaaccgctaaagatgggtcagaagatcaatccgtttggctaccgcctgggaatcactgagaaccatcgttccaagtggttctccgattccaacaaggttggcgaacgctaccgcgacttcgttctcgaagatgacgccatccgcaaggccatgagcaaggacctcgagcgtgcgggcgtgtcccgtatcgtcatcgagcgtacccgcgaccgcgtgcgtgtggacatccacaccgctcgtccgggcatcgtcatcggccgtcgtggcgctgaggctgagcgcgttcgcgccaagctcgagaagctcaccggcaagcaggtccagctcaacatcttcgaagtgaagaacgccgcactggacgcccagctcgtcgcacagggcatcgctgagcagctcaccaaccgcgtgaccttccgtcgcgcgatgcgtaaggcccagcaggatgccatgcgtgcaggcgccaagggtatccgtatcaagctctccggccgccttggtggcgccgaaatgagccgttccgagttctatcgcgagggtcgcgttccgctgcagaccctgcgtgccctcattgattacggcttcttcgaggccaagaccacttacggccgtatcggcgtgaaggtctggatctacaagggcgatatgaccgagcgtgagttcgaagagcagcaggcacagcagagcaacaaccgccagggtcgtcgcggcgatcgtcgtccgcgtcgcggccagcgcaacgctgctccgcagcagaacgcagcagcagaggctccggccgctgctgaggcacctgccgcaacggaaacgaaggagtgagctgagaatgcttatcccaaagagaaccaagtatcgtaagcagcaccgtccggtccgccgtggcatgtccaagggcggcaacgagatcgctttcggcgatttcggtatccaggctctggctccggcttatgtgaccaaccgccagatcgaggccgctcgtatcgccatgacccgctacatcaagcgtggtggccgcgtgtggatcacgatcttcccggatcgtccgctgaccaagaagccgctcggcacccgaatgggttccggtaagggtactccggaattctggatcgccaacgtccacccgggtcgcgttatgttcgagatcggtggcgtgtccgaggatgtcgctcgtgaggctctgcgccgcgcaatcgacaaactccccatgaagtgccgtgttattgctcgtgaaggcggtgacatctgatggcagtcggaactgcagactacaccatgaagaatctcaacgagaagaccaacgaggagatcgagggcttcctcaagaagtccaaggaagagctgttcaacctgcgcttccagtccgcgaccggtcagctcgaaaacaccgcccgcctcaaggcggtcaagcacgacatcgccaggatgtacaccatcctgcgcgagcgtgagctcggcatcagccaggcccccgaggcgaccgaaacgaaagctgaggagaagtaatggctgaagagcgtaacttccgcaaggttcgtcgcggttacgtcgtgtccgataagatggacaagacgatttccgtcgagctcgagcagcgttcgacccacccgctttacggcaaggttgtgcgctccactcgtacggtcaaggtccatgatgaacacaacgaggctcacattggcgacctcgtgagtattatggagactcggcccctgagcaagaccaagcgttggcgtctcgatagcattatcgagcgcgctaagtaaataagttcggcaaggctccgtgagtcaccccgcctgcttctagcaggcaggcggggtgcttggggagaaccagctcggctaaggagaatcaatgattcagcaggaaacgcggcttcatgtcgccgacaacacgggtgcgaaggaactcctcgccatccgagtgctcggcggatcgaagcgacgctatgccggcatcggtgacgtgatcgtcgcctccgtcaaggacgccatccctggcgggtcggtcaagaagggcgacgtcgtcaaggctgtcgtcgtccgcactgtcaaggaacaccgtcgtgtcgacggctcctacatcaagttcgacgagaacgccgccgtcattctcggctctggccgtgaaccgaagggcactcgtatcttcggaccggtcggtcgtgaactgcgcgacaagcgcttcatgaagatcgtgtccctcgccccggaggtgatctgacatggcagccaagattaagagcggcgacctggtcaaggtcatccgcggcaaggatcgcggcaaggaaggcaccgtcaagcaggtgctcaaggacgatcgtctgatcgtcgagggcgtgcagatcgtcaagaagcacgtccgcgccacgcagcagggccagcaggccggcatcgtggctgtcgaggctccgattcatcgctccaacgtgatggtcatcgatccggagaccaagcagcccacccgcgtgcgcatcgtcgaaaaggaagaggctcgtgacggcaaggtgaagaccgtgcgcgtgcgtgtcgccaagaagtccggaaaggagctggcatgaccgataccactgtcgaagcgccggcaactccgcgcttgaagcagaagtacaacgagcagatcgtgccggagctggagaaggaattccactactccaacccgatgcaggtcgctcgcgtccagaaggtcgtcgtctccatgggcgttggcgccgcagctcgcgactccaagctcatcgaaggcgctgtcaaggacctcactctgatcaccggccagaagccgaagatcaccaaggccaagaagtctgtcgcgcagttccatctgcgtgagggccaggccatcggcgcctacgtcaccctgcgtggcgagcgcatgtgggagttcctggatcgccttctgaccatggctctgccgcgtatccgcgatttccgcggcatcaacggcgaccagttcgatggtcagggcaactacaactttggcctcaccgagcagtccatgttccacgagatcgatccggattcgatcgatcaccagcgtggtatggacatcaccgtggtgaccagcaccaaggacgacaaggaagctcgcgtgctcctgaagcacctcggcttccccttcaaggagaactgatatggcaaaaaccgctcttaagaacaaggcggccgctaagccgaagttcaaggtgcgcgcctatacgcgttgccaggtctgcggtcgtcctcactccgtctaccgcaagttcggcctctgccgcatctgccttcgtgagaaggcccaccgcggcgagctgcccggcgttacgaagtccagttggtaaatatcgacgctgaaggtccgcggcccgatcgcctctaaggcgtgagggcggcggaaaccatggcgagaaagggcgttagcccaaatgacaatgacagatccgatcgcagacatgcttacgcgtctgcgtaatgcgagcgcggcaaagcacgagaccgtggatatgccgtactccaagttcaaggcgaacatcgctgagattctgaagcgtgaaggctacatcaaggacttcaccgccaaggaagccaaggttggccagactcttgaggtcaccctcaagtacggtccgaacggcgagcgttccatccagggcatcaagcgcatctccaagccgggcctgcgtcgttacgcaaagtccgatgctctgccgatgccgctcggtggccttggcatcgcaatcatctcgactagctcgggactgctgacccagaaggaatgcctcgaccgaggcatcggcggcgagatcgtcgctttcgtttggtgagaaaggagagctgaaacatggcatcgcatattggtaagctccccgtcaccattccggctggcgtggaagtcaagatcgacggtcagtcctttaccgccaagggcgctaagggcactgactcctacgagattcctgaaggcatcaccgcagtggtcgaaggcaacgaagttgtcctcaccccggctgatgacctgcgtccgacccgtgcaaagcacggcctggctcgctccatcgtggcgggcatggtcaagggcgtgcacgagggttatgccaagactctggagatcgtcggtaccggttaccgcgcccagatgaagggcaagggcattgagttctccctcggctattcccacaccatcaccgtcgagccgccggcaggcatcgaattcgaactgccgaacccgaaccaggtgatcgtcaagggcatcgacaagcaggctgttggccagtgcgccgctaacattcgtaagcttcgtgctccggaaccctacaagggcaagggcatcaagtacgcggatgagcacattctgcgcaaggctggaaaggctggtaagtaatgagcgtccagattctcggtaagggcaagaaggtcgcgcttaagcgtcgtcacgctcgtctgcgcaagcacatcagcggtaccccggagcttccgcgtctggtggttacccgttccaaccgtcacatggttgcccagatcatcgatgacaccaagggtgtcaccctggtgagcgaatccactctgaccagcgatttcgccggtttcgagggcaccaagaccgaagccgccaagaaggtcggcgaactgatcgccaagaaggctcaggacgctggtatcaccgcggtcgtgttcgatcgtggcggcaacaagtatcatggccgcgtcgcagctgtcgctgaaggcgcccgcgagggaggtctggcactgtgagcgacaacgaaaaggaaacccaagtggctgaagaaactcagaacactcaggctgccgctgagtccaacaacgaggaccgcaagtcccgtcgtggccagcgcggtgagggtcgtcgtggcgagcgtcgcaaccgtcgtgaggaatctcacgagaacgagatgctcgatcgcgtggtgaccatcaaccgtgtgtccaagacccacaagggtggtcgtacgttcagcttcgccgccctcgtggtggttggcgacggcaagggcaccgttggtgttggctacggcaagtcccgtgaggtcccggctgcaatcgccaagggtcagctggatgccaagaagcacatgttcaccgtgccgcgcatcaagggcaccgtcacccacccggtgatcggccacgatgccgctggcaccgtgctgctgcgcccggctgctccgggtaccggcgttatcgccggcggtgcagtccgcgccgtcatggaatgcgctggcatcaccgacgtcctgaccaagtcgatgggctccgccaccgccgtcaacgtggtgcgcgcaaccgtcgacgccctcaagaagctcgaagagccggaagagattgccgcacgtcgtggcatgtctctcgaagaggtggctccggacgcgctgctgcgtgctcgcgccgaaggcatcgccgaggcccgtaaggctcgtgaagaggctcaggccaaggctgctcagaaggacggtgagtgatgactaacctgaacatcaagctgcaccacggtctggtgaactccactccgaagcagcgtgctgcggctcagactctgggcctgaacaagatcggcaagaccgtgactcgtgaggacactccggcccttcgtggccagctgcaggtcctccgtcacctgatcaccgtcgaggaggctgactgattatggcagacattctgcagatgcatgacctgaagccggctccgggtgccaacaaggatcgtatccgcgttggccgtggtgaaggctccaagggtaagacctcgggccgtggcgacaagggcaccaagaagcgctatcaggttcgtccgggcttcgaaggtggccagctgccgctgtacatgcgccttccgaagctgcgtggcttcaagaacccgttcaagaaggaataccaggtcgtcaacgtggctgctcttgcggaactgttcccgcagggcggcgagatcaccgtggctgatctggttgccaagggtgccgtccgcaacggcttcccggtcaaggtcttgggcgacggcgaggtttcggctgcctacactctcaagggtgtcaaggcttccgcttccgccaagtccaagattgaggctgctggcggctccatttccgaggactgattccaacggaatatagctgactgaagctcagacatgaggcttcccccgctttagggcgggggaagcctcattcgtttgcagtcaaaatgcaatcatgcatggaaaaacaaaaaaacagacgaataatgacgaaaacgccatatcggtagacgccgtacgctagactcgagcgttagagtctgtttttgcacgtgtgcgcaggtgcgcacgacgatggaaggaaccccaggtgaggacgttaatccaggccttgaagaccaaggaattgaggaataaaatcctcttcacccttggtatcatcatcatttatcgtatcggttcattcatcccgacccctggcgtcgattacaccgtcgtccagcagtgcgtcggcaagatgaacaacgcttctgagaactttatcggtctggtgaacctcttctccggcggcgccatgctgcagctgtcgattttcgcattgggcgtcatgccgtacatcaccgcatcgatcgtcatccagctgctgcgtgtggtcatccctcgtttcgaggcactgcacaaggaaggccagtccggcgaagccaagctgacccagtacacccgttacctgaccatcggccttgccgtgctgcagtccaccaccatcctggtgaccgcacgttccggcgcgctgttcaactaccagtgctcccaggtcgttccggacggttccgtgtggaatctcgtggtcatggtgctcatcatgaccggcggcaccggcctcatcatgtggatggccgaattggtcaccgacaagggcctcggccagggtatgtccatccttatcttcatgtccatctgctccggcttcctgccgcagctgtgggagatcggctggggcaccaacggtaccgatggcaattggggcaagttcgccgcggtcgtcggcacgctgctggtcatcatgatccttgtcatctacgtcgagcttgcccagcgtcgtattccggtgcagtacacccgccgtatgatcggccgcaagatgtacggtggctcctccacctacctgccgctgaagatcaacatgagcggcgtcatcccgccgatcttcgcatcctccatcctggccgtgccgacgctgatcgcgcagttcggcaattccgaccagtcctgggtcaagtggatcaactccaacctggccaacaccacatccgtgtggtacatcgcactgtacgcgctgatgatcgtgttcttctgcttcttctacacggagatcaccttcaacccggacgagaccgccgacaacatgaagcagtacggcggcttcattccgggcatccgcgcgggaagcgccaccagcaactacctgagctacgtgatgaaccgtctgaacacggtcggcgccgtctacctgctgttcgtggcgcttatcccgacggtgctcatcatggcgctgaacctgaacaccaagctgccgttcggcggcaccaccatcctgatcatcgcaggcgtcggcctcgacaccctgcgccaggccaaggcccagaccgaacagttccagtacgctggcttcctgttcgaggacaccgaccacaaggaaggtaagtaaccacttgaatcgtgatgccgtttccgttgatcgggagcggtatcacgatttttatgttaggtaatccatcatccgaaaatccccgttgaggggaatgaacgaaacggagaacaacacatgcgactgctgatcatgggcccgcagggcgtaggcaagggcacccaggccgctctgctgagcgagcactacggaatcccggcgatctccaccggcgatatcttccgctacaacatcaagaacaagaccgagctcggcgtcgaagcgctcaagtacatcgacaagggcgagcttgtgccggacgagctgaccaacaagatcgtcaaggaccgtctggccatggacgacgccaagaacggctggattctcgatggctatccgcgcaacgcctcccaggtcgaggctctcgacgccatcctgggcgagctggacaccccgcttgacgcggtcgtcgcactggatgcagatcacgacgtgctcatggagcgtatgaagaagcgcgccgaaatcgaaggccgctccgacgacacccctgaagccatcgccaagcgtcttgacgtgtacgccaaggagaccgcgccgctgctggacatctaccagaagcgcggcctgctcaagacgttcaatggcgtcggcgccgtcgacgagatccaggccaccatcgtggcggagcttggctgaaggaaaaaccaagcagaataacatatttccaacgaaagcgggaatcgcgacacgccgaacgtgtcttgattcccgctttcgtgtattcttgcaagttggtgtgtcttcgggcacgcatagtaatcgccaaggaacggaacgaggctcatggctaaagacggtgtgattgaagtcgaaggacaggtagtggaagcactgccgaacgcgatgtttcgtgttgaactcgaaaacaagcatatcgtgctcgcaaccatttcgggcaagatgaggaagaactacatccgcatcctgccgcaggatcgtgttgtgctggagatgagcccctacgatctgaaccgcggccgtattacgtaccgttacaagtaaaggtacacaagcaaaggaaaaccatgaaggtcagccctagtgtgaagaggatctgcgagaactgccgcgtgatccgtcgtcacggccgcgtcatggtgatctgcgtcaacccgcgccataagcagcgtcagggctgagagcagatccagcggcataaacagtacaggcgctgagtcacagcccgtgaaagcgggatgaaccccgggtacgcaggcccgggccgggaaaccggacgactcggtgcaagacctgcggaaaacagaaggaatcgcaatggcacgtcttgccggagtcgacatccccaatgagaagcgcatcgagatcgccctcacctacatctttggtgttggtcgtactcgtgccaaggaaacgcttgccgcgaccggtatcaatccggacattcgcgtcaaggatctgacggatgagcagctgattacgctgcgtgattaccttgagggtaactacaagatcgagggtgatctgcgtcgtgaaatcgatgcggacatccgccgtaagatccagatcaactgctaccaaggccagcgtcaccgtaagggacttcctgtgcgcggtcagcgcaccaagaccaatgctcgtacccgcaagggcccgaagcgcacggtcgccggaaagaagaaggccaccaagtaatcggtggctgacagttcaagccacgaggtgtgagcctcatcgtttgaacatcaaagcaaattcgttattaggaaacgagggtcaatggcagctcaaaagcaagccgcgcgcaagccgcgtcgccgcgaccgcaagtcggtcccggttgggcaggcgcacatcaagtccactttcaacaacaccatcatttcgatcaccgacccgtccggcgcagttgtgtcctgggcgtccggtggcgatgtcggcttcaagggctcccgtaagtccacgccgtacgccgctggcatggccgccgaatccgcagcccgcaaggctatggagcacggcctcaagaaggtcgacgtgttcgtgaagggcccgggttccggtcgtgaaaccgccatccgttccctgcagtccgccggactcgaagtcggttccatcaccgacgtcaccccgcaggcacacaacggcgttcgtcctccgaagcgccgtcgcgtctgagcactagaagaaatcatcaatccaacgccgcttatggccggtgagtgcaccaccggcctgaagctgaaaggataaccacagtgcttatcgcacagcgtccgacacttaccgaggaatctctcaaccctcagcgttcccgcttcaccatcgagcctcttgagcctggtttcggctacacgcttggcaactcgctgcgccgtaccctcctgagctccattccgggagcggctgtgacttcggtgcgtatctccggcgtcccgcacgagttcaccactctgccgggtgttgaagaggacgttaccgaaatcctgctgaacatcaagggcatcgtgctcaccagcgaatacgatgagccggttgtcatgtatctgcgcaagagcggcaagggcgaggccaccgcgggcgacatcaccccgccggccggcgtcaccatcgccaacccggacatgcatatcgctaccctcgccgaggatggcgaactcgagatcgagttcaccgtcgagcgtggccgcggctatgtgcccgcccagatgaacaagcaggataacgccgagatcggccgcattccggtcgactcgatctactccccggtgctcaaggtgagctatcgtgtggaagccacccgcgttgaacagcgcactgacttcgacaagctcatcctggacgtggagaccaagccggctatctccccgcgcgatgcagtcgcatccgcaggctccaccctggtggaactcttcggtctgtgccgtgagctcaacacccaggctgagggcgtcgaggttggccctgctcctgtggcagaggaaaccaacccggagatgaacatcccgatcgaggacctgaacctcacccagcgcagctacaactgcctgaagcgcgagggcatccacacgatcggcgagctggtcgcccacaccgagcaggatctgctcgatatccgcaatttcggtatgaagtccatcgatgaagtcaaggagaagctccagtctctgggactcgccctcaaggcttccccgctgggtaacttcgataccaataatctcgaaggtggtaccttcttctcgccggaagacgagtgatccgccacttttgacctaaccgcttcgttggattcggacgttcgggcaactgcccacctgaatccaacggggctttcaaggagaaacaatgcctacaccaaagaagggtccgcgtctggcctccagcccggctcatgagcgtcttatgctcgcgaacatggccaccagcctgttccagaacggccgcatcaccaccaccctgccgaaggccaagcgtcttcgtccgctggccgagcgtctgatcacgctcgccaagcgtggtgatctgcacaaccgtcgtcgcgtgatgcgcgtcatccgcaacaagtccgtcgtgcacaagctgttcaccgagatcgccgagcagatggagcagcgcgaaggcggctacacccgcatcgtcaagatcgctccgcgtcgcggcgatgccgctccggcagccatcatcgagctcgtcaccgagccggtgagcccgaagcaggccgtggtgaaggaagccgaagccgcaaccaaggttgccgctgccgaggctccggaagccgccgctgaagaggctaccgctgagaacgccgagtgaatcgctcttagctgattgaaggccgggaatcgcaaggttcccggcctttgtcatatctgctgccaagactgtcgcgccacatgcctcactatgccagccatttgctatgctcaatgccgtgagactacgcatcgatttggcatatgacggtaccggcttctacggatgggcgaaacagcccgaaatacgtacggtacagggcgaaatcgaacgcgtgctgcataccattcttcgcgtaccggaaggagacccgaccgaaccgctgcgccttaccgtggccggacgaaccgacaccggcgtgcacgcctcgcatcaggtatgccatctggacgtcaacgaggacgtgctcaaacgctgcgtcggccacatggacgtgccgcccgtcatcgcgcttacccgcagacttcagcgcatgctgccggccgatatcgcaatccgcggcatcgcacccgctccggacggtttcgacgcgcgtttctccgcgttggaacgtacctacgtgtaccgaatcgccgataggtcaagcgaggtggaccctcgtaccagaaacttcgtattgcatatcgacgatgaacttgacctcaaatccatgaacgaagccgctgcgatgacgatcggcctgcacgatttcggctcgttcgccaccccaaatccgggcggcaccaccatacgcgaggtgaggaccgcgtattggcgtcgcgtgccgcagcggacgcttatcgacgacggcatgacgatgggggagcggtaccgtacgccgaccgtggaatcgggcctcgtctgcttcgtgatcgtcgccgacgcgtttgcacgcaatatggtgcgctccctcgtcaacggctgcgtgcaggtcggtatcggcaaacgttccctcgactggtttgcaggaaaaatggcggctccgctgcgcgaaggctccacaggaccgatcgcgccgcaaggactgacgctggagcatatcgaatatccggccgacgaccagctggcggtccgcgccgaagccattcgtgccaagcgcacactgtaactttattgcgattgtcatagccaggttacgggcgcttgtcatgtccattgccgagacattgtcgtaacagaccgtttcgttttccggaaacgctggttcgttaggtttttcttccatcaaggcacgatgcctcagattggcatgcgttcgcatggggtggaagggagcgtggaacgatgattgaatccgccgcacgaaggttggcttcggaactggtcgatcgtcgggagtcgatcaaccgggagctgagccgtaatggcgtacggttcggcatctacaagaacggcgagtaccatgaccggctgtttccgtacgatccgattccgcgcatcatcgaatcggacgaattcgacagaatggaagccggactgaaacagcgcgtcaacgcgttgaacgcctacctgcgcgacatctactccgacaagcaggccatcaaggacggcatcgtgccggaagaatacgtgtacacgtccgcgggatactttccgcaagtcaacggcgtgacacctccgggcggcgtgttcgcgcacgtcgccggcgaggacctggtgcaggggcaggacgggcaatggtgggtgctggaagacaatctgcgcattccatccggtgccagctatccgctgttcgcccgcgatatcgaacgcagaatcacgcccagcctgttccgcaacgtacgtgtgcgcgacaatcgcgattatccacgactgctgcgccaatccatggatttcgtctccaccgacggcatagcagtggtgctcacccccggcaggtacaattccgcgttcttcgaacatgcatacctggccgagaaaaccggcgcggcgctcgcgttccccgaagacctcgaagtcgtggacaacaaagtgtacttcctcgactatgccggcaggaaacaccgcgtcggcgtggtctaccgccgtctgtccgacgaatatctcgacccgttcgcgttcaacccggattccgtgatcggcgtgccgggaatcctgtccgcctacaggtcgggcaatgtggcgatcgtcaacgctccgggcaacggcgcggccgacgacaaggccatctactatttcgtgccgaacatgatccgctattatctcggcgaagagccgattctgcacaatgcgccgacctacatgccgatgttcgacaaggaccgcaaggaggtactcgaccggctcggcgaactggtcatcaaggatgtggcggaagcgggcggctacggcgtcgtgttcggctcatcgctcgaccggtcgcaacgagaggaactggccgaacgcatcaaggccgaaccgcgccggttcatcgcgcaggaggtcatccaattcaaggacatcgacgtggtggaccccgaaaccggacagatgagcccacgtaaatgcgacctgcgcgccttcgtggtgaccggcaagaacacgcacgtatggtattcgggactgacacgctactcgtccataccgggccagatgatcgtcaactcatcacagggcggcggtttcaaggacacctgggtactggccaaagagaccggcgtggagcatgattacgcacccggctcggaggtcgtgcgcgtgctggagcagtcccgcaagcactcgctggcactcgtcaccgcgtcgaaggccgacaacctgttctggctcggccgctacacggaacgcgtattcaccacgctgagccaattcttccccttctacgaccgtgtgatggacacggatgtggacgcgttccgaccgttcgcccgtgcgctcgacctgccggaggatttcgaggatttcgacgcgttcatccacagcttcctgtacgacgagaagaatccggattccgtacgcagcgccatcgtctacgcgttcaacaacgcggtgattctgcgccccgaacttggttctcgctcgttgcagcaggtggagttggccatgagctccatagtggaggcatccgaatacggcggcacggacgcggacatcttcaaacaccgcgacatcgcggacaacatgctcgccttctggggaggtgtggagaattcccccgtcgaaccgactctgaaatcgttcattttcgtgggcaaatatctggaacgtctggatctgtacacacgattcggatattccgtggaagagctcaaggcgccgctcgccaaactgggcagctacatcctgccgttgaacggtctgccggtaccgcaatgcttcgccgaaggattgcgctggctggtcggccagctgccgcagcggggatatgcggagcttgcggaaaaactggggatgctgctgaaagatttcgatgggcgcatctccacgaaggatctgaaggatctgggcatgctcaacacgatggacatggacgccgcgcgactgtgaagaatacgtgccacagccatcgcacggtgcgtgtataacggctagaacaaggcccacggcgtggaaaacgccgaaggaacgacaataatcgctgaggagacgatgtgaagaaactggtgtttgactatgagatgaagctctcattcagctcgcccgtgaccgaccatcgcttccaactgcgctgcattccagccaccggcccacgccagcaggtgatcgacgtggcagtcaaaatcgaaccggatgtggaactcgaaaccaccatcgattccttcgattccgtggtgatgaccggattcattcccgaaccgcacaccatgttcaactactcggtgaccggcatcgccttcgtggacaacgcgcatatcaaatccgaaatctacaagccgctgtaccgcttcaattcggcgttgacagtgccggggccggccatcgaagcgttgatcggcatctgccgtgaacgcatcgcgtccctgcctgccgactgcacgccgatcgaccaagcccgtgaggtgatggacgaggtgttcaaaacgttcgtctacacgccggcctccaccaccatccgcaccaccgccgaggaagcgttcgctcaacgcaagggcgtatgccaggattacgcgcacgtcatgctgtccgtgtgccggcacgtcggactcactgcccgatacatcgcgggattgctcggcggcgagggcgccacgcacgcatgggtcgaaatctaccatgatggacgttgggtcggtttggaccccacacacaaccgtatggtcgacgacaactacatcaccatcgcccatggccgcgattaccgcgactgcatgctcgacatcggcatcttctccggctgcgacgtcaagcaggaccagtgggtcaacgcttccgtgcacgagcagggatactgattccccgacgttttctcgatgccggattccgtatttcggcagatgcaaagcagataaacaaaaaaggccgaaacgccattgtttcaaccttcattgcatgcggataaggcgagattcgaactcgcggaggggttcgccctcacacgctttcgaggcgtgctccttagaccgctcggacacttatccattcgtcacctgaaaacaagcaacttgataattgtgccacagcggtggcgattgtcaaatcggactggctgcaacggtgtgatttccggcgtgtcttgctttgcgcccgactgtgcgtccttaggcgaacagcgcttcgtcgaaggaaggatagccccaatcaagcgccaattcgacacggtccgcaatcagaccggcaagcacgcccagggattgcgctcgcgaatccgtcgactgttttgcattggtgacgagtgactgggaatgatcgttcgcggcattggagcttccggcgattgccgttatctcgcttcgcgcgcagttcatttcgatggtggcgtcggtcggtgccgtaaggccggtggcggaatcgagcatcgtgtcggggtgggcgagcaaggcggtggcctcgtacgttttcctacgatcgtcaatggtgcccgagaaggatgcgaaccgttgcgatgtggtcttatgacgattgctgatatccagcgtcgcatggccgctgttgcgggccgccagcacttccatggcgaatccggcacggtcttcggcctgcgcggcggtggcaagggacttggaatcgacgtcaagcgattcgacatcgtcaaaacgcgacagcgtgatcggcgcgacggccaccgacagttgatcgcccagtgcgcgagccatatgacgtgcctgcgcgctgcgcaacgtgccttcggcaaaacgcgccggacattgcgccgcggtgttcgtccatgcggagaccgcctgctgcgccgagaaatagcggcggatgatgtgctgatgctggtcgtgtgcgatcttgttatcggcggtggcatcgaaataggccttctcgcacgggctttgccgttgttcggcttcagccctgcctgcgatcctgggcatggagcatgccgtcagcgccggcatgaggatagcggtgcaaagcaatgcgcagacgcgtttcgcgataaaagaaaccgagcggaaagaaggggtacgtgtctgcatgaatcattagactaatatctgactgtgaccattgggccatgcgctcggaataacttcatataggaggtcttggaaatatggaactggacctggcaggaatgcaccagctcgccgctgggcagggaattgatcccgagacgctggatgccgcactctcggaagcattgcgactggcatatctgaaaacccctcacgctgcgaagcacgctcgcgtcgagcttgatccgcgtgcgggaagcttcaccgtatgggcccaggacgagattcctggcgagccgactgaagacgatccccatcccgcgccgactctgggcgaggaatacgacgacactccgcacgatttcggccgactggccgctgcgaccgctcgtcaggtgatcagccagctgttccgcaaggccgaggatgacaaggtgttcggcgcgttctccggtcagaagggcaagctcatcaccggcatcgtgcagcaggacgtcaaggacacatccaacgtgcacgtggccgtcggcgacgtcgaagccctgctgccgcgccgcgagcaggtgcccggcgaacgctaccgtcacggcgaacgtatccgcgtgtacgtggtgaacgtggcccgtggtctgaagggcccggaaatcgtggtgtcccgttcccatccggagctggtccgccgcctgttcgaacgtgaggttccggaactggtttcgggagccgtgtcgattatggccatcgcccgcgaggcgggcgcccgcaccaagatcgccgtccgtgccaacaccgaaggcgtcaacccgaagggcgcgctgatcggccccggcggagcccgagtgcgcgccgtcatggagaacctcggtcctgagaaaatcgatatcgtcgactggtccgcggatccggcgaaattcgtcgccgcggcactgtctccggccgtcgccaccggtgtgcaggtgatcagcgagaagaacaagacggccatcgccttcatccacgatgaccagctgtccctggccatcggcaaggaaggccagaacgcacgtcttgcggccaagctgaccggctggaagatcggcatcgaatccgctgaggcgcatgccaagaagatggccgaatcggcggaccattccgatggggaaaccgaggaataaacaacacttccggtagacaacaagcccgtggacgtacaatccacgggcttgagtatgctggactcgacaatccaaagcgtgacggccatgccgtcatgcccagggaaaagacgaggtatcacgaacatggttgcacgatgagaaggaacaagctcgccgtgaatcagtagcggtcgcgcccgtatgcgcgcggcccaagataggagaattgagtgccgaaagcacgcgtatatgaacttgccaaggaacttggcgttgacagcaaaaccgttttaagcaaacttgaggcgatgggcgaattcgtgaagtccgcatcgtctaccgttgaacctcccgttgcacgcaagctgaggaacgcattcgcgtccagcggacagggcaacgcatctgattccaagaagccgggccatacggccaagaagcctgtcgaaccggcatctcattccatgccaaagccggccgctccgtcagcaccgaagccggctgcccccgcagcgccgaagccgcatcatgccgcttccaagtccgatgccccgaagccgggccatcgcgcgccgcgtccaggcgaatcccgccagcatggcaatcgtcctaacggcaacgccccgcgtccgcagggtggagaccgccgccagtccggtcgcccgacggccgttccgggagctcgcccccagcatggcaacgctccgcagggcggcaacaacgccaatggcgcgaagccgcacaccccgggaccgcgcccgggcaacaatccgttcagccgcaagcagggcatgcacaccccgactccgggtgatattccgcgtccgcatccgatgaaccgtccgagcgtcaacaatggcgaaggacgtcgtggtggccgtccgggtcagggcggtggccagcgtggcggcttccgtggtcgtccgggtcagggcggcgcgaagccaggccagtggggccagcatcgtccgggtcagggcggtggccagcgtcccgccggcggcggcaatcgtttcggtggcaatggcggcggtttccagggcggcaacagcgctccgagcaatggtccggcacgtggtggccgcggccgcggcggcgctgcaggcgcgttcggacgtcagggaggcaagtcctcgaaggcgcgtaagaaccgtctggcgaagcgtcaggaattccaggagatgaaggctccggtcatcggcggcgtgcgcattccgaccggcaacggacaggaagtccgtctgcgtcagggtgcgtccctcgccgatctggccgagaagatcaacgtcaatccggcggcgctggtcaccgtgctgttccaccttggtgaaatggccacggccacccagtccctggatgaggccacgttccagatcctcggcgaggaaatcggctggaacatcaagatcgtgtccgccgaagaggaagacaaggagctgctgcagcagttcgacatcaacctggacgaagaggaactgcaggaggacgaggatttgaagccgcgtccgccggtcgtcaccgtcatgggccatgtcgaccacggtaagacccgactgctcgacaccatccgccgcaccaacgtcatcgaaggcgaagccggcggcatcacccagcgcatcggcgcataccaggtgaccgtcaaccttgagggcgagccgcgcaagatcacgttccttgataccccgggccacgaagccttcaccgcaatgcgtgcccgtggcgccgaactcaccgacgtcgcgatcctcgtggtcgccgccgacgacggcgtcatgccgcagaccgtggaagccatcaaccacgcccaggccgcgcatgtgccgatcgtggtggccgtcaacaagatcgataagccgggcgccaacccggacaaggtccgcggccagcttaccgaatacggtctggttccggaagaatacggcggcaacaccatgttcgtcgacatctccgcgaagcagggcaccaacgtcgacaagctgctcgaagcggtgctgctcaccgccgacgccgagctcgacctgcgcgccaacccggatatggacgcccgtggcgccaccgtcgaagcccgacttgacaagggccgtggcgccgtggctaccgtgctggtgcagtccggtaccctccacatcggcgatgccatcgttgccggcacctcctacggtcgtgtccgcgccatgctcgacgaaaacggcaaccacatgcaggaagccggtccgtccaccccggtgcaggtgctgggtctgacctccgtgccgaccgcaggcgacctgttcctggtggcctccgacgaccgtaccgcacgtcagatcgccgagaagcgtcaggccaccgagcgtgcggcccagctggccaagcgccgcaaggtcgtttccctcgaaagcctcaaggagcagttcgccaagtccgaggtggatatgctcaacatcgtcatcaagggcgattcctccggttccgtcgaggctctggaagattccttgatgaagatcgaggtgtccgacgaggtcggcatccaggtgatccaccgcggcgtcggcgccatcacccagaacgacgtcaacctggccaccgtcgacaaggccgtcatcatcggcttcaacgtccgtccgaaccgccaggtggcggatctggccgaacgcgaaggtgtggagatcaagtactactcgatcatttacaaggccatcgaggacatcgaagcatccctcaagggcatgctcaagccggaatacgaagaggtcgtcacctcccactccgagatccgcgagatcttccgctcctccaagttcggcaacatcgccggcgtcatggttcaggacggcgaagtcaagcgtggtacgaagtgccgtatcctgcgcaacggcatcgccaccgtcaacgacctcgagatctcctcgctgcgtcgtttcaaggacgacgtcacctccgtcaaggaaggctacgaggctggcatcaacctcggcaccttcaacgacatcgagatcggcgatatcatcgagaccttcgaaatgcaggaaatcgagcgtaagtagccgagtgcttcgagcttcgcatcgataaccagttaaggaacgcccacagccggttcacgactgcgggcgttccgtgatacaacaagaacttttcaccaaaaggacagcaatggcaggaaccaatccccgcgccgcgcgcatcgcggcgttgattcagcgtgtgatcgcatcgtccatggaggcgcagctgcacgacaagcgactggccaacgtgaccatcaccgaagtgcgcgtcaccaacgatctgcagatcgcgaaagtctactggacccagctcggccatgaaggacacgagcagggcgaacgccgccgcgcgcagcaggccctgaaccaggccaaaggacgcctgcgttccctggtaggcaccaaggccggactgcgactcaccccgcaactggaattcatcttcgacgaagtgccgggcgaggcccatgagatcgaggacatcctcgcgctcgcacacaagcgcgacgaagaactcgccaagtcccgcgccaacgcgcaatacgccggcgacgccgatccgtacaagcacgacgagcccgatgatgacgacttcgacgatgatgacgatgtcgaggtcgaggattgggacgatgacgacgaagcctgacaactccggtctgctggtcatcgacaagccgcagggcgtcaccagccacgatgtggtcgcggcggtgcgtggcgccctgcacatgaaacgcgtcggccatgccggcacgctcgacccgatggccaccggcgtgctggtggtcggcttcggcaacgccacacgtctgctcaactacatcgtcgaccacgacaaaacctatctggccaccatcagactcggccagcgcaccaccacggacgacgccgacggcgaactgctgccggaggagggaactatcgccgaattcccttcacgacagaccgttgaagacgtcatcgcccatcatttcaccgggcgcatcgagcaggtgccgaactcctattcagccatcaaaatcaacggccagcgtgcctatgatctggcccgagaaggcaaggatgtggacctcaaggcccgtccggtgaccatctcggaattcagtgtttcggcagtgcgatacggctatgcttcgaccacatgcgcgggatcacctcttgccgatgccatcgaaatcgccccggaggaatcctggcatgccgaaaccgacgggcaaaacgaaccgaacatgcagccagtcatggaactcgacgtgaccgtgacctgctcggccggcacctacatccgcgcactcggccgcgatctgggctccgaactcggcctcggcggccatctgaccatgctgcgccgcatccgcgtcgggcgtttctcggtggacatgccgaacgtcatgaccgcccatacggaagctaagaccttcaccaaccgcgaaggcatcgaagtgacacgcaaccgtgcggtgcttgacgatgccgagcatgccgttgaccacgcactcgacctggtcgccagcgcggccgcttccatggacatgcttcccgtcaccgaacaggaggcgacggacctgcggttcggccgtagaatcgcccacgacatccatacgaccatggccgcgtacgttcccgaaaccaacgatctggtggcgatcgtggaacgcgccaaacgtggcgagaccaagccggtcgcggtcttcaactgaaacaatcaagaccggccggcacgcaatacgaacacgacaaacacacggacaatacgcaaagaaggacacatgaagacgatcacgcttacccccgatgccagcggcatggtggattggcccaccctgagcaacgacaagaagtccgtggtgaccatcggctcattcgacggcatgcatcagggacatcaggcggtcatccgccgtgtggccgaactcgccgaacaggagcaggcgttctccgtggtggtgctgttcgacccgcgtcccgcgctggtgcacgcttacgccgccaaacatgacggtcaggaaccgcccgcaggcacgcctgacacgcaggcgctgaccagtgtggacgaacggctgcgcgccatcgacgccatcggcgtggactacacgctcatcgtgcgctacaccatggcattctccgcgaaatcataccgcttcttccttggccagatggtcggcaaactcggcatgcgcacgctggtgctcggctccgacgccgccatgggtgcgaaccgcgccggaaacgtgaaggccattgagaatctggcgctcgccaccggcgtgttccagctggaggtcgtggacgatttcggtccggggctgacccgagtgccggtcaatgcgaagccggtgatgccgtccgaacccggcgagccttccgaccctctggagggggcttccaaggccgaacgacgcgcatggagcaagaagcatcaggccaaggaagtgcgcacgtggagctccaccaatgtgcgctatctgctgagccaaggccgtatcaaggacgcagacgcgatactcggccacgcgcatgccgtggaaggcaccgtggtgcatggcgaggaacgcggccgcaccatcggattcccgaccgccaatctgagcgagaacgtcgccggatacctgccggtggacggcgtgtacgccggctggctggtcgatttgggggagaagtccgccgacggtggcgaagaagccggggagaagccggccgacggcgtatcgcagcagtatgatgcttcgtccgtcaacgcgcgcgtggccatgcagtcgccacaccgctggccggcggccatctccatcggcaccaagccgacgttcaacgaggacggtgacgccgaacgcgtggtggaagcctacgccatcaccgatgactggttggacctgtacggccatcaggcgcgcgtggaattcgctggattcctgcgcccgcagatcaaattcgattcggccgacgatctggtggtcgagctgaaacgcaacgtcgaggagacgaagcgcctcaccgcttgagacggatcggttcgattggtttgattggttcgattgacgcgaatcattgacgccatccgtgttttgttacccaaacgggctttcccgggttgcaaaatgcggatggcgatgccgtttgggcatcggcgacctatcgcagaatcgcggccaacgcgtcctgcaacgtatccgcctgcaccacgcccattcccggcacggcgacgttcttgcgcagcgtcggcacaacggcggtggtgaaaccaagacgcgccgcctcacgaagccgatattccagtctcggcaccggacgcacctgtccggtcaacgaaatctcgccgatcgcgcacgtcgtgcggggaatcggtttcgatttcgcagcgctcgccaacgcggccacaatcgccagatcgcaacccggctcacgcgcctgaccgccggcgattgtggaaatgtacaggtcgttggccagcagattgatgccaccgtgacgatataacaccgccaccagcatggcgatacggttggagtccacaccgttcgccgcgcgacgtggcgtcggcagcaccgacctggtgaccagcgcctgcacttcaatcggcagactgcgatgcccatccaacgtgaacgtcacgcacgtgccatccacctgcgtcgccgcagaaccattgccggttgataggaacaggccggacggatcggtcacctcctcaatgccctcgccgctcatatcgaaacagccgacctcatcggtcggtccgaaacggttcttcactgcacgcagcatacgcaacgcggtttcggcatcgccttcgaactgacagaccacatccaccagatgctccaacgtacgcggacctgcgatcgaaccatccttggtgacatgccccaccaaaagcactgggatatcaagggttttggcggtgtcaatcagcgcgctcgccacttcgcgcacctgcgtggatccgccggagatgccatcgacgtcctgcgagacgatggtctgcgccgaatcgacgatggccaacgccggcttgaactgttcgataagccccaacaccgtggacagatccgtggtggaggcgagtagtagattcggctccatggcgccgatgcgcgacgcgcgcatgcggacctgcgcctgcgattcctcgccggaaatatacagtacggtattgcgctcggtggcgaacgccgtcagcctcgccacattgccggcggtttccagcagcaatgtcgatttgccgatgcccggctctcctgcgatcagcgtgaccgatcccggcacgatgccaccgccgagcacgcggtcgaattccgaaaatcctgtggcgattctggagatgttctccgtgcctatgtcggtgatcggcctcgccgcggacgatgcgaccggatgcgattgcgtgcgcgaggtccgtcccggagccgcggtacgcgagcctgccgcgggacgggcttcatggaattcctcaatggtgccccattgaccgcattcggggcagcggccgagccacttcgggccgctccagccgcattcggaacagaggaattgcgaggacgtctttgccatatcgccgacaatacggaggttttgggacaagacgttcgcgggtggcgtactcgttgcacagacattgcgctgaaaaccgtttcgggaactggattccatgactttgaggggatggttgcgcgtcttatggctgtgaaagaatgacaagcatgtctgatacgcagaattcctcttcgcatggcaaattgattgccgccgtcgtagcagccgcgcttgtggttgtgcttgctctgatttccgcatttgtgtggcctggttgggccttgaacaagaacggacaggccggacaggccggtcagacgagccagcaggcttccacttcgaacggtacggacggcgacaagacggagcccaccaaaccgtcgatcgatgccgtggcattgcccgacggggccagcgagctgctcaaggccatgccggattccgtattgaattacgcgcgtaccaaggctgacgccagcacgacgtggtccagcacctctcccgtcgaggaatacgcgttgacgtattccaccggcaagaaaggacaggacgtcacgctggaagtgggccagtggaacgacggcgacaaggcgaaatcccagtacgacacgctggctgaagccatgaccggcaaggagctgggaagcggcaacgtgaaggtctccggcaagacgaccggcgcctacagcgccaaagccgatccggacgacgataccaaggccgttgccgtgtggcgcaacgatacggtggttttctatgccaccggcgcgaagaacgacatccagcgtttctaccagcagttccccctgtaacgtcgacggaatcgtctcgatggcgaatcgcggccggctgatggaatatcacgcggaaaacgaaacgtgattttccaccatatgaatgcctgcgcgcgtattcgtccccgaagcagtgtagtattgggcaagttgcaaacttttaccctttgagtttaaggaacggaggctgagatgggctcggtcatcaagaagcgccgcaagcgcatgagcaagaagaagcatcgtaaactgcttcgtaagactcgccaccagcgcaagtagtcttcaggcgcgtgtgaagcgtccgctcaaacaaaatcccgcgattcctttcggagtcgcgggatttttgctatctgcgcggcggtgtcggccggtatattccacaccagccgacacgcccgcctgtcaagatctcacttgttggggttgtccatcacgcgcgggccgttcggatcgccgacgatgacctggtccaccatgttcaggaacaggccgtgctcgaccacgccgaccgtggtgatgaggtcctgcgcgagctcctgcgggtggtcgatgcgctcgaggtgcagatccaccacatagttgttctcatcggtgcgcaccggctcgccgttcgcgtcgagacgcagcaccggcttgtagcccttggcctcgaacttcttgacgacctggcctgcgccgaacggaatcacctcgaccggcagcgggaacttgccgatggtgtccacgaccttggactcgtccacgatccacacgatcttgttggagttggtggccacgatcttctcccacaggagagccgcaccgccgcccttgatgccgttgaagttcttgtccacctcgtcggcgccgtcgatggtcacgtcgatatggtcgacgtcatcgatgttgacgatcttgatgccgtagccttcggcctgctcctgggtgcggcgggaggtggtgacgcccgtgaactcgaggccttcctccttgacgcgacgaccgagctcgtcgaccaggaaacgcacggtcgagccggtgcccagacctgcgatcatgccgttctgaatcagctttgcagcctcgatgccggccgccttcttcagcgcgtcctgctgtgccttgtccatgatcctccttcgatatggggttaagaccgtctccatactatcggatgcgttgattttcaaggcgcgaatggtcggttgcgggagcaggtgtctgttttggactgcggaaaagttttcacggaatgtttcacggtcctgcgtgaggtggcgtgcaaaaaagccgcgcatgaaatgacatgtggggagcggcttgcgtaaagcggctccccacatgtctcgctcagctatgtttgaccgcgaacggcgcctcgtccaataccagcgtgccgtcacccatcacatagccttccacggcgatatacccacggatgagacgtggattgccgtcgaaggtcgggctggattccggtgggggagtgaaccgcaccgtacccgacaccgacaggcccgatgggcttggacgatgcggcagtttcggcagatcctgcgattgcgatgaagatgcctgttccggtgccgattcttcgtcgtcttgcgattcgctgtgcgattcgttcgcattctgcggtacggccgtgctgtccgtgtccgtgccgtccgcgttgcccgtcaccggcttgtcgttctcgtcgccttcacggggaaaatagtcgggtttgaccagcatctgcgcataggattgatgcggttcaccggattcgtccgttttcccggattcgtccggttctccggattcgtccggttcggctggaccgcccgcgtccgggaagctggattcgggtatgaccttcgtcgcttcggtctcaagcattgtggtggtttccgccggttcggtctcgagcacggtcgtttccaccgcatcatctgcgtcgtcatcggttgtctgtccgaaatccgcaaggtcgtgggaaacgccttccggctccgccagcatgctggcgatcgaacgcggcttcgtgctgttgctggaattggcggtatcggcactggaatcgccggtgccggtcgtggcggaatcgccttgtccgcgtcccatgtggtattcggcggcgctgatcgcaccatccatcagcatcctcgcatcctcgggaacatcggtgccacgcgaatactcggaagccagcagcgactgccatccttccaacggcagatagccttcgcgcacatgcgaacggcaatcgcccgcatacgtgcgtgccagctcgtccactttctcgttgcccgcgttgccggcatgacccttgacccacacgaatcgcaccgaccccgccctatgtgcgatctcattgtcgatggcgcggatcaaatcggcgttcttcaccggtttcttctgcgaattcttccagccgttgcgcttccaaccctgtacccacttggtggagcagttgatcgcatactgcgagtcggtctcgatcaccaggtcttcggaaccgggatgcgctcgcaacgcctccagcacggcgcataattcgccgatctggttggtgccgttcgtcgcgccgccggcatcgcaatcgccggcatgctcgtgccccggcttgccgcctgccgcgggctcgtggtcggcccaggcccaacccatcggaccattcggattgccaagcgcggaaccgtctgttgaaaccgtaatcgtcatgcttctaccctacgaaagccgcgcgactcgccgtttgcccgtcataccgcatcgtccgccatgcggtatcgcctatcgataccgcatggcaacggcatatgcgattagtcgccgagacacagcatgacggaggcgcggaacatgccgtcgctgtgctcgaaggaggccgtgccatggtgccgttcggccgtctctcgtacggtggcggtgcccagccccgtgccaccatgtttggtcgagacgagatcgccgtcgatctgttcgatgctggtatcggcttcgccgtacgtgttgtccaccgtgatgaacagggccgccggagggccggaacgataccggatgcgcactttgagccgcctctcgccctgcgtttgctgggtgatggcctccgtggcgttctccagcagattgccgaccatggagcataattccgcgttgttgatgttgatgtattgcggcaccgccgctttgacgtccacatccgcacccaaatgccggacccaatcgcaatagtagacaagcaccgcgttcagcgacgcatgctcgcaatactgcattggtgccgtttgcagcagccggtgtttggacatctcatccagatatgagcggatgccatccatgtcttcagccgcggccaacgcctgcagtgagtggatgtggtgacgcacgttgtgcttgatctgacgcgcctcacggatccgctcgttcatgtgttgcagctgcaacgtctgcaaagcctcataatgctgtcgcctgcgggccgcgagcagacggtccgactgctgaatcatgtaccagatgaggaaatacgccaacaccatgaaacaggaatagaccaccgccacagtgaacgcgatttccagcatatgcgagtccagcagcgtggaattgtccgccggcatgcaccacaccacaatcgcggacgaaacgaacggaaacagccagataagctgccagaagcctttgctgatggatggggaatcgaatgtggctggaatcgaatcatgcagcggatgccaaagcgagaccagtgcgacgacgtcaagcagcagcagattgaccagtcccggccagccgacgcggagattggttgaatccgcgccaagaacggccacatcgatgacgagcgacagatagtagacgatcgccaccatgtaggaagccgtggccacaatcagcaacagttgccgccatggcagttcggtcagccatcgcaggaccagcagcacaagcggcgcggtcggaatgaccgtccacagtgatgggatgcccagagtgccgcacagcacgccgcatagcaggaaccagaccagtccgatggacatgaacagtgtgccgttacggcgtggattgtccatgtgactccatgccatgatgaggcacaatgccaggccggacaacgcgttgagctgctctccgatggcgaagaacagacctgacggggtggtttgggcgatgccgttccggataatttcgccgagtggtgcgaacatgtcagtcctccgtacgcatgcgggtgaacgtgtattccgcgtatgcgcggcaggtggtggtcaccgccgttttcgtgatgggaatgcgtttgccgcctttcatgacgaactgcgcgttggtgatgccggacacgtagtcgaagttgacgagcacgcctcgcgcggtgcggtagaagttgtcgaacacggtgagccgtcggtccacatcggagaaattggtgcggattttggtctgggtgccgtccgcgaacgtaaattccacgtagtgcgcgttggacagggcgtatgcgatgagccgccggtccatggtcacggccggattgccgaacgccacatgccagctggaatccaccgtgccgggcgactgcgcctttgccagatgggtgaccggcggttttgccttcagctgctcctcgacgcgttccatggtggcttcgaaggttttgcgattgacgggcttgagcagataaccgctcgcctgcacctcgtagccgagcaccgcgaaatcggtgctggacgtgatgaagacgatcgcgcagtcgtcgttctgattgcgcagcagccgcgctatgtccaatccggtggtggcatgcggcagattctcgtcgctgagataacagtcgagcagcagcaggtcgtaacggctgttcttccagctttcgatgaacgatttcgcgtcggggaaaacgtcacagatcgtttgcatggcattcctgccggcggttgcgccgacgttccggccgttgaagtattccgcgcacatggtggcgatcagttcgcgttcggcagggtgatcctcgacgatggcgatgcgcacgttccctccttgctgtgccgtgattgcgcggatgacgttccggctctgcttccaagcgtaccgggagagggaaatacggggtgccgcggagcttgcgtttcatgccagaaaagcacgtttcgtgccatacggcggatatcgacaacgaaaaagacccgctccatacggaacgggtcttttcgcgctacgccttgattacttggcggaacgccgtatcactcggccagagccttgtccacgacctcggtggcctcggcgagcaccttgtccagagcctcaggggattcgaagctctcggcgtacaccttgtagatgttctcggtgccggacggacgggcggcgaaccagttgtccttggtggtgaccttcagaccgccgatcttggcgtggttgcccggagcctcggtgagcttggcggtgatgtcctcgccggccagctgggtggcctcgacgtcgtcgccggtgagcttggcgaacttctgcttctgctcgagggtggtcggggtgtcgacgcgcttgtaccagctttcgccgaaacgctccacctgctcctggtgcagctgggccgggttcttgccggtcttcgcggtgatctcagcggccagcaggtccggaatcaggccgtccttgtcggtggtccacacgcgtccgtccttacgcaggaaggacatgccggagctttcctcgccgccgaacgcgacctcgcccttgaacagcgggtccacgaaccacttgaagccgaccggaacctcaacgagcttggcgtcgatggaagcggccacgcggtcgatcagggaggaggagaccagcgtcttgccgatgccggcgccttccggccagcccggacgattgccgccgaacagatactccacgcacacggcgatgtagtggttcgggttcatgacgccccagttcgggcagacgatgccgtggcggtcggcatccggatcggtgccgccgaccagatcgtacttgtcccaagcgccgttgttgagggaatcgaccagacccttcatcgcgtacggggagctcggatccatgcggatcttgccatcatggtcgatggtcatgaagctccaggtcgggtcgacctgcggacgcaccacgtcgatggtcaggttgtacttctcgttcatcagcggccagtagttgaccgaagcgccgccgagcgggtcgatgcccaggcgcacgccggaggagcggatcacgtcgaagtcgatgacgttctccagatcggccacatagtgctcacggaagtcgaaacgctcgaccagatcggacttgacggcctgctcgaacggcacgcgcttgacgttcctgaaatcgccgagcagctcgttggcgcggtcggcgatggcgttggtgacgtcggccggagccgggccgccggtgaccggatcgtacttgaagccgccatcggtcggcgggttgtgggacggggtcacgacgatgccgtcggccaggccttcgccggtgaaacgctgggtgccgtcggcggcgcggttgtgggtcaggatggcctgggacacgaccggggtcggggtgaagtcgtcacgggagtcgatgcgcacggtcacgccgttggcgacgagcacttcgatggcggtcttccaagccggctcggacagggcgtgggtgtcgcggccgatgtacagcgggccggtgacgccggccttcttgcggtattcggcgatggcctgcgtgatggccacgatgtgggcctcgttgaatgaggtcttcagggacgaaccacggtgtccggaagtgccgaaggagacgcgctgctccggaacgttcgggtcggggacgacgtcatagtactttccaatgacctcgtcgacattgatcagatctgctggggtggcgggcattcccgcattttttgcaaccataccttcattgtgccacgagtttgcgcggaacgcggaaagccatcccacaatgtgcgatgaatacgttttctttttgacgtctcggcgtgtctccagtatggaattggggtttcagtgtcccgatgcccgacgatttgcgcatcgcacgccgatagtgtattgtttctaacgaattcgactcatgcagggttgcaagtcaacatttttagacgcaagacctggaatgtggcattggtttgccatgttccgggtcttttttgttgcaaaaaagccgcgctgcgtcatcgaatcccatcggaaggaaatagaaaggaatcaggatggctgactctctcgcatcgcagatcatcactgcgatcggcggacctgaaaacgttcgcagtctgacgcattgcgccacccgactgcgcttcgagctggcggacgcgtccaaggtggaccagaacgccctcgaacatatgaagggcgtgcttggcgcggtcccgcaaagcggtgaccgtttccaggtcgtcatcggcggcggcgtggccaccgtatacgaaaacatcatgcatctgcccgaaatggcgaacgccggtgccgcctccgcatccggcgaaggccagaagagcaacgccgacgtcaaggccgaggcccgttccaaggcacgcggcaaggtggcatggctggactccttcttcgagtatctcgccgactccttccgcccgatcctgggcgtgctgctcggcgcctccatcatcatcgccctggtcaacctgctcatctcactgaacgtcattccgaatgacgaggcctccgccggctgggtgttcgtcaaggccatctggaagggtgtgttctacttcctgccgatcatggtcgcctacaacgccgccaagaagctcaaggtcgatccgtggctgggcggcgccatcatggccatcctcatgaccccgcagttcaccagcctgatggacgccaagaccaccacgtgcgtggagaacgcggctctgggcaccaagtcctgcaccgccaacatcttcggcattccgatggcgttgagcgactacagcggcaacgtgttcgtgccgctgctcatggccgccgtgctcgccctcgtctaccacggattgaagaagatcattcccgaaagcgtccagctggtgttcgtgccgttcttctgcatgatcatcgtcggcgcactgaccgccttcatcatcggcccgatcggcgtgtgggtcggcaacggcctcggcgtcggcctggcttggatgaacacccatgcaccgttcatcttcgccatcatcatcccgctgctgtacccgttcctcgtgccgctcggcctgcactggccgctcaacgccctgatgctcatgaacatccagacgctcggctacgacttcatccagggcccgatgggcgtgtggaacttcgcctgcttcggcgccaccgccggcgtgctcttcatcgccgtgcgtgacaaggacaaggacatgcgccagaccgctctcggcgcgctcgcagccggcctgcttggtggtgtttccgaaccgtccctgtacggcatccacctgcgttacaagctggtctacaagcgcatgctcgtgggctgcggccttggtggcgtcgtcattgccgtcctcggctggctcttcccgtccgtcaccgccgccggccagaccgtgcatggtgtgaccaccaccgccttcgccttcacctcgctgctgaccattccggtcttcgaccagatgtgggtgtacgcggtgtccatcgcggtctccttcctgacctccttcttcctgatcatcaccttcgactaccgcaccccggaacagaaggctgaagtgctggcccgcgccgccgccgatcagaaggccgccgctccggcggtcgaagccaaggaagccgctccggctgccaccaccgccaccgcgactgctaccgccaccaagaccgaagctccggccgctgccgccgccgcgaccaccgtggtgaacgctccggtcgccggccacgtgatcgccctggacgaaaccggcgatccggtgttcgcctcccgcgcgctcggcgaaggcgtcggcatccagccgaccgacagcgaggtcgtggccccggtctccggcgtgctgcagaccgtcgccgaaaccggccacgccttcggcatcaaaaccgatgacggtgtggaagtgctcgtgcacgtcggcatcgacaccgtgaagatgaacggcgagggctttgccgtcaaggtcaaggccgatgagcgcgtgaatgccggcgatccgctggtttccgtcgactttgctaaagtgaaggacgctggatacagcaccaccacgctgatgacggtgctcaacaccgccgccctcacctccgtcacgccgaagaccggcatcgacgtcaaggcaggggacgaggtgatcgacatccagcgctaacctgtcacacagaggcgaaaaaggggtcgacgtggacgttcttcgcgtattcaacaacaatgtcgtattggctagagacggtgatcgtgaggtgattctcacaggccgtggaataggcttccaagccaaaccgggacaacatgtggatgacgcgaagatcgtccgtcggttcatccccgtcgatggcaaggatcccgaccacatggcgcaacaagtggccgggatcccgcccgaaatcatcagactcgtcacggacgccatgaaccgtacgggactgaaagaacaggcagacaagcagccaaccctggtcatggcgctcgccgaccacatctgcggcgcgatacaacgcgcgcaaagaaaacagaacatcgaatatccgctcgaagcggaagtacgttccctatacgccgacgaatacgccaaaggcgtggcgatggtcgacgcgatgaacacgtatttgggtggcgcgttgccccgcagtgaggcggtggcgctcgccttgcatttggtgaatgccggattctccggcggcgacctgtccgccacctacaccatgaccggcatcatccagcagatgatcgccgtcatcgaaggcgcgtacggcatcacgcttgcgcaggacagcgtcaatgtggcgcgattcatcacgcatttgcgttacctgttcgtacgcatccaccagcatgagcagctcgacgatgagccgcaaccaatcatcgaatcaatcaaaacctcatatccgaaggcttgccagtgcgcaaggcagcttgccgtggtggtgaagatgcgtcttggttccgaccttacggaagccgaaatcgcctatcttgccctgcatgtggcgcgcgtgaccaacggagtgaatcggcaggacgactgagtttccggtatcttccgatattcagcagcccgttccgcgcattcctgacggttcctaatcgttcgactgttcggccggctgcccgcttgcctgttcggtcggctgcggtttcgttggcgtagccgacatattcgcgttcaacgccagtatgccggtatcttcggaagtggcctccggcacgcgcacgcatagggcctgacgttccacgctgaaacggatgtgcttcgtttcaggcagcatatcgccatccacctgcgccaaaacaggcctctccaaagtgatttccgcgctgacgccctgcacctggtcgacggtggagttcgtggacagcggactctgctgagctttgccggtgatggtctggtgcagcacgtcgccgaacagattcgcccaaccgatcaggccgccggacgtgtcgatgatctcgtagtcgaggatgccatcgtcataggaagcttcgggcatcagcgaaaacatggggatctggccgcaattgcccgccatgaacgtgcggaacgtgagaccacgcgtggaatgcgtgctgccgtcggcgctggtgatggtcacattgcccttgtacttcggggcgaacagattcttcacgcccgacacgaaatacgccagccagctgatgttcttcttcaattccggattggtgtcgtcgatcatcagtgcgtcgaaaccgatgccggcgatgatgaggaacgcatgcccgtggtcggtggtctcatcatccagaagggtcagacggcccacatccaccagacgggagccgtgcgacgtggccacggtgagcgccgcatcgatatcgtccacgggaatgcccatattgcgggcgaacagattgccggtgccgatcggcacgatgcccagcgcatgcccggtacccgacagcgcgctcgcgacggtacgcaccgtgccatcgccgccgacagccaccaccacatcggcaccatggtccaacgcttcgaacgcgcaggcgcgaccgtccttgtcgagctgcgtttcgatgaattcgatctgggtgagatgcttcgcctcgcagaactccttgatatgctgcttgcgctgttccgcctggggctttgaaggattgactatgaacgcgtaatgcacttggtcatcgtcacgcttgtcaagcttctccgcgagcgtacggtgcttgtacgcgcggtatccgaagaaggcggccgcgcatacggcgaccacggcgatgatgacgagcaggacgataactggcataggcatgcctctattgtctatgcgattgcgcaaaaagacgaattcgacatgaaaaattcggcgttccctcacgttatatccaaaaatgagaacgatggcgtcagtgtctgctttcggcactaggctgggaagcatgcttgatattcaattcattcgtgaacatgctgacgttgtcaaggaatcccagcgtaagcgtggcgaatcggtcgaactggtcgacgaggtgctgcgctccgacgaggttcgccgttcctctctgaaggaattcgaagctgcccgcgcgcagcagaaggagatcggcaagaaggtcgccgccgcccccgccgacgaaaaggccaagctgatcgccgcaaccaaggaactctcccagaaggtctccgaatacaaggccgcagccgacgccgcagccgaggaatacaccactgccatgtggaagctgtccaacatcgtcgagccggaagctccggaaggtggcgaggacgactacgtcgtggtcaagaaggtcggccagatccgtgatttcgcagccgaaggcttcgagccgaaggaccacctgacgctcggccgcggcgtggccggtatcgatatggagcgcggcgtgaaggtcggcggctcccgcttctacttcctgcgcggccaggtggcccgcatgcagatcgccatgctcaccatggccgtcgaccaggccgaggaacatggcttcaccctggccatcaccccgacgctggtgcgtccggaagtaatgcgcggcaccggcttcctcaactcccacgccgacgaaatctaccgcctgcgcgagccggacgaccagtatttggtcggcacctccgaagtggcgctcgccggcatgcacgagaacgagatcctgaaccttgagaacggcccgctgcgctactgcggctggagctcctgctaccgccgtgaagccggcgcagcaggcaaggacacctccggcatcatccgcgtgcaccagttcgacaaggtggagatgttcgtctacgccaagcaggaggactcctacaaggagcatgagcacctgttggccatggagcaggaaatgctcggcaaggtcgaggtgccgtaccgcatcatcgataccgccgccggcgatctgggctcctccgcggcacgtaagttcgactgcgaggcttgggtgccgacccagggccgttaccgtgagctgacctccacctccaactgcaccgagtatcaggcccgtcgtctgaacatccgcgaacgtatggaggatggcaacacccgcgccgtctccacgctgaacggcacgctggccaccacccgttggctggtcgccattctcgagaaccaccagcagaaggacggctccatcgaaattccgaaggccatgcgtccgtacatgggcggcaaggaagtcatcgagccgaccaagtgggaagcctgattttccaagacgttcgcgtctgatatgaatccgtgaaagcggcgttggcatttgtgccggcgccgcttttcgtatgttggacggtcccagtgccgtttgtgtcgttctgggcagatgcgtgtgcggttttctgttggaagcgacggggatggaggctgtgccaggtgtcgcacttccgcgcactgtggtatattggcgtttcgtgcgtagcagcgatgttaggcgcaaagggtagatgtctgagcggtctaaagagacggtcttgaaaaccgttgaggtgcaagcctccgcgagttcgaatctcgctctgcccgcatcaatcaagggcttaccgaaggatttttcggtaagcccttttccatgccgtttatggcgattgtcgttgtcgtggcggcaacgtcacacgatccgtcgatccgcggcccaacgggtgagctcggaacggttcgacagctgcagtttgcgcagcaccgagctcatatgggtctccacggtcttgatggagatgaacagttccgaagccacctccttgtacgtgtagccgcgcgcgatcagccgcatgacctcctgctcgcgattggacagccggtccagctcgtcatcgtggatcgggccgccgaacgcgccgttcgcgctcgggccgttctggaaggcggacagcacgaatcccgccaatttcggcgagaacacggcgtagccctcatgcacctgcttgatggaggacaccaggtcgtcgccggaaatagtcttcgtcacatatccctgcgcaccggcgcggatcacggaaccgacatcctgcggagaatccgacacggacagcgcgaggaagacggtatcgggggagtatgcgcgcgatttcgtgaggatttcggtgccgccgccgccctcgccgcccggcacatgcacatccagcagcaccacgtccggtttggtctgcgcgatcatcgccaccgatccttccacatccgcggcctgtccgaccacgtcgaaatgcggctgcaacgtggcgatcacgcccgcacggaacatctcatggtcgtccacgacggcgattctgatgcgctgttcccgctcgctcattcctgctccttggttcgattgattcattgccgcacctgctgcatgtgccgtgttcattgcgccgattgcacgcccgtatcgccgtccgctgtggtggtcgtagcgctgtccgcatcctccgccgctcctgaaatcggcatgtgcatgcgcacctccgtgccccagccgggcctcgacacaatctccactgtaccgccgcggcgcttgatacgtccgatgatggactcgcggatgcccaggcgattcgctggaatggcgtcgacgtcgaagccgtcgccatggtcgcgtacgaacacctccaccagcttgtcgccggcctcgcagtagacggacaccggttcgccgccatgcgtcacggcgttgacgagcgcctgctgcgtggcatccaacaacgcgtcggtctgcgcgctcggccgcgcgtcgcccaccgtcaccacctcgatcggcttgccatgcgtgtcctccacatgcgctgcgatctgcttcaaaccggcgttgacggaacgatccgacgtggtgcgctcctgatatagccattcgcgcaactcgcgttcctgctgcctcgccagtgaaaacacggtctgctggtcatcggcatgcaactggatcagcgccagcgtctgcagcacgccgtcgtgcaggtgggcggtcatgtcggcgcgttcctcctcgcgctccttcagcgcgcgctccgtgcccaaatcccggatcatcgccacgatccatggcacgatcgccagcagcacgccgacaagcatcgccaggccggcgaccagcatggtgagcgtggcatgccgtgcggactgcataatgcgcacgtgggtggcgatgtagatcgcgtacgcgacgaaaatgaccgcgatgccgccgagcatcgtccataattggccgtccttcgcgttgaaccgcagccaggagacgccgacgccgaccacgccgagcagcaacggcacaatcagcgtgccttcaatgcctttcgccgccatcgccacgcataggcccagcataagcagtcccgccatggccagcagcgcgggtctcggcgcgttggcgaacatctgttccaggctttcggacgattgtgctccgctgccggattgcatgccgtccgcgttgccgtcgctgtcttgcgattgcgcgccgccgtttccgacgttccttaggtttcttacgttcctcacgttgccgtgggacagcggcgcgttctcgacgggctggctgccggcgatgacgtacgcctgctggaccgggtctccgacgggtacggtgatccacagaaaaatataggcgatcgcgcccgcaccgaagaaaaacgtggtgaccacgaaaatgaaacggatgagatgaacggacacgcccagatgcatgctgacggccttggccacgccagcgacctcgcggccgtacgtcgggcgcagcaacggcagtcgcgccggcttggacggcacgggacggccttcgcgcagggcctgcacgtagcaccagcgcatgtagaccgcgctggcctggtcgtactgttcctgcgtgtatcgcggtttggctaaggacttcatgcttccattgtgccctgtcggggatgccgattcagggctttcagctggtgttcagggcagattcagggtgttccccgatacgtatgacggctgcggattgctgtaatggagatatgagcaacgcaaacaacaatccgcaaggcggcagtgccgctggttctgctgaaccgcaatcgcagccacggccgccgatgtatcagctgcagccgaatcgcgcggtctcaaccttggcaaggttgcgctttaccaactaagctatgtccgcatgtctccagcagattcactgcgtgagcacgagtatctactataaccacattcgtgtaatttgcaagtcagcgtgtcgcggtttggtttattcgtattcaccgatggctgaagcgcgtgtcacaccacccgttttcggtatacattaaaagcatgtgtgaggagagcgcaatgcccaagacgatacttatcgccgcattcgaaggatggaacgatgcaagccaagcggccacgaacgtcgtccgtcatttggtgtcccggtatgagtcgcaggaagtgcgccatattgacaacgaaggtttctacgactatcaggtggcccggcccatgatctgctccgtgcaggggcgtaagcgcatcatctggccgcaaacgactttctatgacattgccgtctcccccatgctgcacctgcttgcgcagatcgcacccgaacccaattaccggtgggaggaatactgcaggcagacgctacgtgtcgcagaagactatgacgtaagtgatgtcatcacgcttggctccatgttcgatgaatgcccgcacacacggccattgccgcttgacatctccaaaagcggctgcgaatgcgaatccgacagggaatacaacggtccggtgggcatccccaacatccttgacgccttcgccgccgaagcgggctttccgacaacatccatatgggtatccgtaccgcattactgtgccaataccgaatgcatgcaaggcactttggagctgctgcgcgccttgtctttaataatcgagtatccgcttattgaaggagatttgaccagaaaggccatgcaatggcgttccgacgccgatggattggtgtcagacatgcatgccggcgactatttggctcgtctggaacatgattacgatttggacgcgagagcgaagcgaatcgcctcgaatggcatgcctgcctgcgaggaactgcttcgtgaggccgaatcacttctacgcaacggcgtctgagtcgttcccctccaggaggaggtcgcagacgaaaaaaatcccggccaccttacggatggccgggattcgctttatttacgccgaatcacgcttacgcggcggcaacgacttccgtcgggtgcagcacgccgcagatcagcagcagagccacgacaacggccagcgcgatgcggtagatggcgaacgccttgtacgagaaggtggacacgaacttcaggaagccgatgatcaccacatagccgaccacgaacgccacgatggtggccgcgatggtcgcaccccagcccgggaacattcccgcattgcctgcggccacatccttgaccgcggaaacggcttcgaggatgcccgcgccgaacacggccggaatggccatcaggaagctcacgcgcactgcagcctcacgggtataacccatcgcacggccgaaggtgatggtgccgccggaacgggaaacgccaggaatcagcgccagcatctgaccgatgccgaagatcagcgcatccttccaggtcatctcatccatggtcttgacctgcttggcgcgggcgtcgaccacccacagcagaataccgaagataatcagcacggtaacggtgatccacagattacgcagcgtgctttcgatggcgtccttgaacaacagaccggcaatcagaatcggcagcgtgccgatgatgatgaaccaacccatctgcgtgtcgcggttatgcgcgcccatacggctcttgaagtccttgccctccttgccgaacaaggagccgaaccacgcgccgagaatgcggatgatgtcatgacggaaatacaggatcacggcaagctcggtgccgatctggatgatggcggtgaacgcggcacccggatcggagcccagcatcaaatcgccgatgatacggatatgggcgctggaagagaccggcaagtattcggtcaacgcctgcaccaggccaaggaaaatcgcttggaagaaattcatgaaccctctttatgttcgtagaaatatggtttcgtctgcttttccgtgaccaagagtagcgagaggggtctagttttcaaggcatcccggcatagttgtctcaaaccatgcacacaatggagccaaaagtacgccggcatgtccggcatgggagaaaggctcatcggcatgggcaaataccgcaaaagcagggcattcagccccgaaggtttctttgaatgcgagggacgcggcctcaaatggctcggcgaggcgcaatcgcagggcggcccacgcgtggtcgacgtatacgactggggcaaggattatctcgacattgaacgcgtgaacgcctgcggtccgaccatccaagccgcgcgcgatttcggtgttgcgctagctcatatgcatgatgccggtgccgaacattttggctccgctccaactggatacgacggcacctgctatttcgggccgttgcaggatcccgtcccgatggataccggtgcctgggatgatgtggccacctatctggcggacggcagattgcgtccgatggtacgactcggcatgaaacgtcgcgaactgaccgactatgacatggaactgactgaagccgttatcgacgccttgcccgacatcctaggcaaggccgccaacgacaagcccgcacgcgtgcatggcgacctgtggagcggcaacgtcatgtggactgctgattccggtgacgtcgaagccgtgcttattgaccctgcggctcacggtgggcaccgtgaggaagaccttgccatgctcgacctgttcggcatgtcatatcttacggacatcctcgaaggctatcagtcggcgcatccgcttaaggccggatggcaggaccgcatcacattatggcagctctaccccattgcaggacattgcgtgttcttcggtggaggatatgtgagccagtatcgcaccatgtgcaggtcgctgctcaaataggcgggaatcacccgccacgccagatgtgaaagaagtccgtatcccaaggttatgagttgggatacggacttctttcacatgtcccgtattcgattggattgcgaaaactagcgcagcgcgtccttcagcttggagaagaaccccttcttcgcgccggacgacggacgggacttcacgacaacatgctgggcgtccgtgtcgtgcatctcgccgaaccgctcaatcagctcccgctcgtcatcggacagcttcttaggaatctccaccactacgtgcgccaccaaatcgccgcgctcgttcttgtcgtcgagatgcgtgacgccgaggttcttcaacgtcacggtatcgtcctgctggctgccggctgggatatccagcgtctgcctgccgtcgaaggtgtcgatttcgacttcgtgccccaatacggcccaactcatcggcaccttgatccaacaatgcaaatcgtcgtcatcacgagtgaacatgtcatccggcttgatgcggatatccacatacaaatcgcccgcgacgccgccattttcgccgacctcaccctgattagcgagacgcagacgggtgttgttcgccacgccggccggcaccgcgacgccgacattgcgggtgacgcgcacgcggccatggccgaggcaggacgggcacggcttctcgatgaccgttccatggccttcgcagcgttcgcatggcgcggtggtcatcatctggccgagcatggtgcgtaccacgcgctgcgcatatccctgaccgtggcagtcgggacattgtgtgggctgtgtgccgttctggcagccggtgccgccgcattcctggcacaggccgaacgtgttgaccttgacgtgcgtggtgtcgccgaacaccgccgtcttcaaatcgatggtcgcggaaacaagcgcgtcacgccccggctgggtgcgcggagtcggtccaccgccggtgccaccgaatccgccaccggtgaacatgctgaagatgtcccccatatcgccgaatccgccaccgaatccgccaccgtgcatgccgcccgcattcggatcgttcggatcgacgccggcatcgtacatctgccgtttcttaggatccgacagcacatcgtacgcgttgttgacttccttgaacttgtcttcgaattccggacctgcgatgtcgggatggtatttgcggctcatctttcgatacgcctttttgatctcgtcgtcgcttgccgaacggtcgacgcccagcacttcgtaatagtccgtcacgattattctttctccctgttggttctgcgtgtcattgtgccataaggcggggtcagtcggccggctgaccttcatcgtgggcgaggaacgccgtcagatatctggcgaccgccctcacggcggccatggtcgccgcgtagtccatatgcgtcggcccgatcgatccgacgaatgcgaccggttcgcccgcctgctgcgtatcatcaccgctttgattttccgtctgtgatgatgcggccgcatgcgtcgcgccgtccgtggcggccgcggaggtacgcccgtagccactggttaccactgaggcgtgcagcaaaccgggcgtgtgcgtttcggaaccgatcgccactccgacgccgtcggattgcgtggtttcgctcagcgagctcatcaacttcatgagcaccacctgctcctccaacgcgtcgaacagcggggccaggtcggccaccgtgcgttgatgcgcaagccgtgaagtgcccgccatgtacaattcgctcgcgcgttcgtcatccgccatgccatcaaaggcctgcgcaagcgtttccgcaagcgtgctgatcgcatggtattccttgcgcgctcccatctgtcgtacgcaatcggccgtgcgggtcagcgaaacgccggagcattgcgtgttgatctcgttggtcagatgagtgagcgtcgtcacgtccggcaatttcgtgacgttgaggatatgctgcgcgacacggccggtatcggtgatcactacggcaagcagcgtattaatggacactggcacgatttcgatatgccgcaatgtcgacttcgacagtgacggcgcggccacgacggcgacctgtccggtgatctgcgccagcagccgggcggcccgctgcagcgtgtcctgcagattgaccgatccggacagaaagctgttgatgccgcggcgctgggcctccgatagcggaacgaccgtcgccaaacggtcgacgaagtaacggtaccctttttcggtcggtaccctgccggccgaagtgtgcggctgaataagatagccttcatcttccaaggccgccatgtcgttgcgcacggtggcggagctgacgccgaggtcatgatcccgggtcagtgtggtggaacccaccggttcctgagaacggatgtaatcctcgaccacggcacgcaacaccagcatgcgtcttgattgcgccatgcgcgcctccttatgcataggtgtgtgccggtacgccttatgtttgacggtgctgatgagacgtacccggaaaacttcttttaatgttttagcactccggcacccggagtgctaattcgttcgcttccagagtagtttccttcatgcggcaaaggcttgcggcgactggcattgggagatatatcgacaaacgaacatctgaagttcacgcgaatgttaattgtgagcgctaacagcacacaaactaccaaaacacgccaaaatttcaccacaacgtcacctcacatcgctactatgggaaacgcaatgtgagggcgtcgagcgctcggcacaagccggatacgcggcccgaccaattggaaggaaagtaatccatgaccgaattcaaggagaccgagctggacgaacgcgccatcaagatggccaaggtcctgtcggccgacgcggttgagcgtgcgggacacggccacccgggttcccccgtctccctggcgcctatcgcctacaccctgtaccagcacttcatcaagcatgatccgaacgaccccaactgggaaggccgcgatcgcttcattctttccggtggccacgcctccctcacccagtacgtccagctgtacttctccggctacggcctgaccctggacgatctgaagaacttccgtggcggcgccgacacccgtaccccgggtcatccggaatacggcctgaccccgggcatcgaaatgaccaccggtccgctgggccagggcttcgcctccgccatcggcttcgcctatggccagcgtttccagcgtggcctgctcgatccggaagctccggaaggcgagtccccgttcgaccacaacatctgggtcatctgcggtgaaggcgatatcgaagagggcatctccggcgaagccgcctccctcgccgccaaccagcagctcggtaacctgaccgtgatcttcgatgccaaccgcatccagatcgaaggcgacaccaacctggtgctggccgaggacgtgctcaagcgcttccaggcatacggctggtacaccgacgagttcagcttcatccagcctgacggctcctacaaggaggacgtcgaaggcctggccgacaccatcgccaaggcccgcgccgccgccccgaaccagccgaagctcatcaaggtcgacaccctgatcgcatggccgaccccgggcaagaccaacgacccgtcctcccacggctccaagctgggcgccgaggccgtcgccggcctcaagaagctcctcggctacgacccggaggagtccttccacgttgacgaagaggccctcgcccacgcccgcaaggtcgccgagcgcggtctcgaagcccacaaggaatgggacgagaagtacgacgcatggcgcaaggccaacccggacaaggctgccctgtacgaccgcatcaaggccggcgagcttccggaaggcttcgacaaggccatcgacgacctcgaggccactttcgaagtcggcaagaacgtcgccacccgtggcgcttccggctccactctgaacgccatcgcagccgtcatgccggaactctggggcggctccgccgacctcggcggctccaacaagaccgacctcaagggcgctgagaccttcgccccggctgagtgcgccaccaagcagtggccgaactgcagcaagtacggccgtcagctccacttcggcgtgcgcgagttcaccatgggcaccatcaccaacggcatcctgctgggctcccacacccgtccgtacggcggcaccttcttcatgttctccgattacgagcgttccgccgtgcgtctggccgccctcatgcagattccgaacctgtacgtgtggtcccacgactccgtcgcagtcggcgaagatggcccgacccaccagccggtggagcatctggcttccttccgcgccatcccgcagctcgaggtcgctcgtccggccgacgcttacgagaccgctgaagcctaccgttacttcttcgagaagaagaacaccctgccgaccgctatggttctgacccgtcagggcgtcccggttctcgccgagaccgctgagaaggccaaggacggcgtgaagaagggcgcttacgtgctcgtcgacaccgagggcaccccggacgtcatcatcatggccaccggttccgaagtccagtgggctgtgtccgctgccaagaccctggccggcgagggcatcaaggcccgcgtcgtgtccgtgccgtgcgtggaatggttcgaggagcaggacgccgaatacaaggaggccgtgcttccggccgccgtcaaggcccgcgtctccgtcgaggccggcgttgccatgccgtggtacaagtacctcggctcctacggcaagccggtgtccatcgagcagttcggcctgcagggtgatggcgctcagaacatgatcgatctgggcatcaccgccgagcacgttgtggaagccgccaaggcctccatcgcggaagtcgaagccgccaagtgatgatacggggagggacacgacagcatgcgcccctcccctttcaccgataaacaagatttgatccaaaaaggtatcaaggagaaaaaacaatgactgaagcaactcagcgcacctctgactccggtgtctcgatctggctggatgacctgtcccgctcccgcatcgagtctggctctctgcaggatctcatcgccaacaagaacgttgtcggcgtgaccaccaacccgtccatcttccagaaggctctgcacgaggtcggcccgtacgatccgcagctgaaggaactgggcaaggtcgacgttgagaccgccgtgcgcgagctcaccaccaccgacgtgcgcaacgccaccgacatcttccgtgaggttgccgagaagtccgatttcgttgacggccgcgtctccatcgaagtggatccgcgtctggctcacgagaccgaggccaccgagaagcaggccgaggaactctgggccaaggtgaaccgtccgaacgccatgatcaagattccggccaccctcgaaggcctgccggcaatcaccgccaccctggccaagggcatctccgtgaacgtcaccctgatcttctccctggagcgttacgagcaggtcatcgacgcctacatcgagggcatcgcccaggctgacgccaacggccacgacctgaagcacatcggctccgtcgcttccttcttcgtctcccgcgtggacaccgctgtggacaagctgctggaagccaacggctccgacgaagccaaggctctcgagggcaaggccgctgtggccaacgctcgcctggcttacgagctgttcgagaacaagttcgccaacgatccgcgttgggctgctcttgaagccaagggtgccaagaagcagcgtccgctgtgggcctccaccggcaccaagaacgccgcctactccgactgcaagtacgtcgacgagctcgttgctccgttcgtcgtcaacaccatgccggagaagaccctgaacgctctcgccgatcacggcaatggcgctccgtccatcaagggcacctacgaagagtcccacgccatcatgaacaagctcgccgatctgggcatcaacatcaaggatgtcaccgacaagctggaagctgacggcgtcgcagccttcatcaagtcctgggacaccgtcctcgccgacgtccaggctggcatcgaccgcgtcaacggctgaatcattcgctgatacagcaccgttaaacggataaaagccgagaggtctccatcttttgatggagacctctttttcgtatgccgaaataatacgcgcagaagacatacggaaagacaaaaaggccgcgatatcaaatcgcggccataatcgaaagaaaagcgaaccgaaaatcaagcctgccaatacgtgctgaagaagtcgccgatttcgccgatggtctccttcaacatgctgatgcgaggcagatagaccacacggaagtggtccggttcctgccagttgaacgcaccgccgtggctgatgaggatatgcttgtcatgcagcaggtcaagcgcgaactgctcatcggaatggatgttgaacttcttcacatcgatcttcgggaagatgtagaacgccgctttcggtttgaccgcggtgatgcctggaatatcgttgagcatgttgtacaccaactcgcgctgatcgtagatgcggccgccgggcaccagataatccttgacgctttgatggccgcccaatgcggtctgcaccaccgactgcgcaggcacgttcgagcacatacgcatgttggccagcatgttcagaccctcgatgtaatccttggcgagacgcttgttgccgctcagcaccatccagccgacacgccagccggcgatcatatgggacttcgacaatccggagaacgtcacgcagaacaggtcaggcgcaagggacgcgatggagatgtgctccaacccatccatgaccagacggtcgtagatctcatccgagaagatcatgagctggtgctctcgcgcaagatcgacaatctgctgaagcacttccttcggatacagcgcgccggtcggattgttcggattgatgatgacgatcgccttggtcttgtcggtaatcttggaacgcatgtcgtcgatgtccggataccattcggaatcctcatcgcagacgtaatgcaccgcggttccgccggccagattcacgcaagctgtccacagcggataatccggcgacggcacgagtacctcgtcgccgttgtccagcaacgcggataaggacaggttgataagttcgctgacgccgttgccggtgtagatgtcgtcgatggacacgttggggatgttcttcagctgcgcatactgcatgatggctttgcgcgcggagaacaggcccttcgacggcgaatagccttccgtgtcgggcagctgctgcgacatgtcgtagaccacttcatccggcgtgcggaagccgaacggtgccggattgccgatattgagtttcaggatgtgcgtgccggcggcctccatgcgcgcggcctcgtcggcgaccggtccacggacgtcgtacagcacgttgtcgagcttgtgggatttcgtaaaagtgcgcatggttcttccttctgtcggttgctcggatgcatcgtcaacatggtcgggctgttcaccggcaaaatccggcaaaatcgcggcatgctcttccatgggaacatccttgcccatcagccaatcctcgttgacccgcagatacgcggcaaggaaatgcgcgatatcggcacggggaacggttttgccactgacgtattggctcatatggcttttgccgagcttgatattgaacttttccgcagcatgaacgaaatcaatctgtttaagctcgcgtaatgccatggcatcattcaatctggtcgagaatgattccgtcatgcctatccttccagttcaatttaaacaaaagctagttcaaagaatagcacgacagggcaccaagaaagacaaagagttcaattttggtagatgtgtttcatgccgctgcatgaatgagttcaattccgtgaaaagactccatgtgggggggggcggtcaaagcagattgttctcaacccattgggccacgccgtcatcattgttcgaagggcagatctcatcggcgattttcaacacgtcggggttcgcgttggccacggccactcccctgccggattcacgaagcatggcgatgtccaccaaatcgtcgccgaatgagacggtccgtgacaacggcgtcgacatgcgatcggcgaggatgctcaatgcatgctccttattggcctgcggattcatcagcatccacagcgagccttcggagatatgcacgtcgaaatcgtcggggatgagccgtcccacacgcttccactgctcctcgttcgggaacaggatcagcttgtccgcggtgccgtccggaacgtcatcgaaatccgtgtatcgccaggtctgcgtcttccagtatttcgtgacgtcgaaattcgtgtacctgacatcatccatgacgatgcccacttccatgccaggcagttcctccagcaggtacttgcagacctcgcaggcccttttcgaagagaatccgatcttctgcagatgtccgtccttcggcagtgtcggtgaggtgagcatatcgtaatcggacgagacggggttgaaatccaacagcgccccgttgagataggcgacggcgtcaaccggaagcttctgcacgaacgagtagccggtgctgaccggtcgcgcggtctccaccacgaatttgatgccggcgtcgtgcatgcggttgatgctgtcaatggatcgttgcgtcaggaaacggtcctcgaaagtctttccgtcgtgcagcagtgtgccgtccagatcggcgacgaccatggtcacgtcatcataggtgttgtttgtcgaagtcatttgaatcctttgcgggagcaatctagccggagacaagtttggcccatgaccgtgaagccggtcatgggccaaaccaaattacgtcaatcagatgaggttgaatttcgtcatcagaccgagggcgatgatgatggccacccacagcagggcgatgatgacggtccaacggttcaggttcttttccgcgacaccggaggaacccgcgttctgggtgagtccgccgccgaacatgtcggacaagccgccgcctttacccttgtgcataaggataagcaaggtgagcaagaggctgaggatgacaagaagaatctgcagcacaagcttgacagtagccatagcggacacgggtgaacctccagttcgtaaacactgtttctgataatagcgcatggtgttgaaaaaatcgagcgtcaaaccatgctttttaaaagttttcaggcggttgtttccaatgtcagcttgcagatgcgtgtgagttcatcgaccttcaacgcggagccgccgatcaggaagccgtccacatccggctcgttgatcagttccaccgcgtttttcgaggacaccgaaccgccgtacaggattcgcaccgtttcgccgaccagtgttccgaacgtatcggacaggtcgtttcggatcgccctggccgcgtcctgtgccgactgaggcgtagccaccatgccggtgccgatcgcccataccggctcgtacgccacaatcagcttcgcggcctcctcatcggacaggtcccgcgtcacgtcgtgcacctggccgaccgcgaaatcgagctctatgcctttgcgccgttcctcgtagctttctccgacgcaaagtatcggctgcatgccggcagcaagcacggccctcacctggtcgacgatgttcgcgtcgtcttcgggatggtatttgcgtcgttccgaatggccgacgatcacgtacgagcagccgagatgggcgatcatatcggcggagacgtcgccggtgaacgctccctgcgaggtgactgagacggcttgggccccgtagcggattttcagattgtccgattcgacggcgacctgcacgctgcggagtgaggtgaatgacggcatcaatgcgatttcgcaacgtttgtagtcgaaatggacggcccgaagattccatgcaagctgctgtacgaaatacgtcgcttcaagatgatcgaaattcatcttccagtttccggccaccaaaggaatccgtttcggccccataatattcgtcgtctcccgtccgtgctcgtcaaagcgaaaggtcgttcttgtgacattgtatgcgaaatacgcaaaaggtgctcccccacccactgatgaggaagcaccccttcatgattctgagatcagtcgagcaccttcaggcccggcagttccttgccctcgaggaactcgagggaggcgccgccaccggtggagatgtgcgagaagccatcctccgggaagccgaggttgcgcactgcggaagcggaatcgccaccaccgacgatggtgaatgcgccggcagcagtggcatcgacgagagcctgggccacggccttggtgccttcagcgaaggtcgggacctcgaacacgcccatcgggccgttccacacgacggtcttggaatcgacgatcttatcgtggaagagcttctgggattccggaccgatgtccagacccatcttgtcggccggaatggcatcggcggccacgacttccggagcaatgtcctcatcggatttcgggaagaccgggttgatgacgacatcggtcggcagcacgagttcgacgccgttcttctcggcgcgctccatgtagcccttgacggtttcgatctggtcctcttccagcagggaggtgccgacctcgtagcccttggccttgaggaaggtgtacgccatgccaccgccgatgaccagacggttggccttgtccagcaggttgtcgatcacgccgagtttgtcggagaccttggagccgccgagcacgacggtcagcggacgctccgggttcacggtggcgcgggacagtgccctgacttccttctcgaccagcaggccagcggcggccggcagatcggcggcgacatcatagttggagccctgggcgcggtgcacgacaccgaagccgtcggagacgaagacctcaccgagagcggcgatcttcttggcgtatgcggcacgctcctccggatccttgctggtctcctccgggttgaaacgcacgttctgcagcagcacgacgtcgccatcgttcatagcggcgaccttggcctgggcgtcctcaccataggtgtcggcagccagcggaacggtgatgccgagcagctcgccgagacgggcggcgaccggagccagggacagttccggaacgaccttgcccttcggacggccgagatgagccatcagaatgaccttcgcaccctgttcgcgcagagccttgatggtcggcagggcggccttgatacgaccatcatcggtgatcgtggtgccgtccagcggaacgttgaaatcggcgcgaaccagaacgcgcttgcccttgagatctccaagatccttgagtgtcttcatgtatatcctttcctagccgcttgtaagcgtggaatggccatattgccacttacgcataatacaagcccaaacgaacaaaaaacaccatacgacggaaaagtcgcatggtgttttgtttccggaaacgaaaatcaggccgcttgacggcgtgccttctccgttttctcagccaattgcagcagtcgacggatacgtccggcgatcgcgtccttggtgattggcgggtcggcgagacggcccagctgctcaagggacgcgtcggcatggtcgagtcggagctggccggcggatttaagattgtccggaacgtcgtcgccgaggatttcaaaggcctggcggaccttatcgcaggcttccgcggcggccttggcgctacggcgcatgttggcgtcatcgaagttcgccagacggttcgccttgcctcgggcctctccgtcggaacgctttccggtccattcgcgggcggaatgaggggcgcccatgaggatgagcatgcgttcgatggcatcggggtcgcgcaacgtcacacgttcggagctgcgcagcttacgcggcttggcggtgatgccgagacgacgcgcggtggagaccagcgccagcgcggcctcatgattcggacatacgatttcgagatagctggccttgcccgggtcggacaggtgtccgcctgcgaggaacgcgccacgccaggcggccttgatctgggcgatcttgccgttgatgatgtcgcccggcagacccagcaccatgtttttggtgtaacggctgtacaggccggtctgcagcaccagagccgcgctgcccttggggacgcggactatgaagcgctgcaccacgccggtcggcgtctgcctggaaacgggggtaagcgtggcttcgtggccgtacagatttctgatggtgtcctgcagccatatggccgcgtcttgggaatcaagctgcgcctgcacgagaatgtggtgatccaccgagtgcaaaccattgccgaatcgaatcatcgcagtcgcctgtgcctttttggcgatgggcaactcgttgtcgattgcggccagctcgcttttgacgtcatccagaagagccaagagccaacctcctactttcctgttcttccctataatttcaggcgagtcgcggactcgacccgcactgctaccggcttactgtgataccgaataacttggacaaagccggcagcttttctttgtatttggatactgtcttctcacaatgcggtcatcaatcggccgaacgcttgtccagctcgcgggccgatacggagaccgtgagaccacgtgcacgcaggcgcttggccaaggcctcgctcatggccacggaacggtgctggccgccggtgcatccgaacgcgatggtcacatagtgcttgtcttcctgcgcataaccttcgatggcgatggcgatggctttctcgtaggcgtcaaggaactcctccgcgccctcgctggagagcacgtagtcgctgaccggtttgtccttgcccgtcagcgaacgaagctccggcacccagaacgggttgggaaggaaccggacgtccgccacgaaatcggcgtctatcggaatgccgtatttgaatccgaaactgaagatatgcacggaaaccgtggtcggtccggaaccaagcagaccctcgtacagtttcgtggacagctgatggatgctcaatgccgaggtgttgatgacgatgtcggcgtgctctttgaggttcttcagcaggtcgcgttcctcaaggatgccgtcgatcagacgattgccctgctgcagcggatggggcctgcgcacggattcgtagcgcttgatgagcacctcgttgctggcgtcgaggaacaggatgcgggtcttcaccccaagatcgtccagatggctcagcacggcggacaggtcgtcgaaatagtcacgtgacctcacgtcgatgaccgcggcgagtttgtggatgttcgaaccggagctggtcatcatgtccaccagcgggacaagcagtttcggcggcatgttgtcgaccacataccagcccatgtcctcgatgctgttggccgcgtgggaccggcccgcgccgctcatgccggtgatgagcagcacttcgaagcctgcggccggagaaggcgcgctcgtatgtctgcctgcctggttgacggcgttgttcttttcgttcatcacagggcctccttaagcgcggagcgcatggcatgctccaatgcttcgactttctgatggctggtgggctcggtcggcggatcgttgtcccatatgccggtcatcagccagacttgaatcatggcttggtacagcagcatctcctcgccgccgatggcggtgccgccgcatgacctccaggcctgcatgagcttggtcgggcggggatcatagaccacgtcgagtagcgtgccgttcgtgactatgccggctgaggcaaacgcctcggcgatcggatcggcggcaaggccggggatggtgttgatgacgacgtccgcatgggacagcagattcgccgcatggtccatggcgacgatgcttatggagccgacgcccatatggctttccgccaatggttcaagcgcctcgttcttatcgggatggcgtgccacgacggtgacatgtccaatgtggggcatctcggtgcaggccgccaaagccgaggtggcggtgttgccattgccgatgatcaccgcctcgccgtcttgtccagaatccatccgcatgccacgtgcccgatacgagtgctcgaaggcgagctcaattcccttcacatccgtgttgtagagcctgatcgcagggatggcggcgttcttatcgttcgcgccagaccagtcgaagacggcggtgttggccaccttcagctctttcgcccacgcgttgcatggcacgccatatggctggatggtcttcttcaacggcatggtcaggctcagtcccgcccagctggaatcaagcgactccaaaaaatcctcaagctccgtctcgccgatctcgtgcctgccatacgaccagctgtcaagtcctagagctcgataggccgcattatgcaatacaggggaaagcgaatgcgcgatgggtttgccaaggaccgcgcaccgatggtccacctcggtcatgttccctcccttactctcaccattcatcatgctagcaacgcagaagcgattgctcgttacagattctatttcttttcatctttcggactgtttccatccgatttcactgttcggagggcatcctccgccttcggagcaatgtcaacggacgaatgcaatgcctggtaaatgttctcggccttggcatggccgatgcctttgacctgttcgaaatcctccacgctcgcctcacgcatggcgcgtacggagccgaaatggttgagaagccgtttctgataggcttcgccgatgccgggaatgtcgtccaaagcggaacgcaaagctcctttgcgtctggtctgacgatggtaggtgatggcgaaacgatgcgattcgtcacgcacccgctgcagcagatacatgccttcggattgtcgcttgaggatgatcggatagtcgtcatccggcacccaaacctcctcaagacgcttcgccaatccgcagacggccacatcgtccacgccgcagtcggcaagcgcctcggccgccgccatcacctgcggtttgccgccatcgaccacgaccagattcggcttataggcgaaatggcgacggttagtgttctgctgcacggcatccgtttcaggaccattcgtgccatccgacctatcattttgcgtggccatccgacgctcgttgtccatgctttccccggaatcgccggcgatgttgccatggcggaaacgacgggtcaacgtctcatacaatgcgctcaaatcatccaacgcgccctgcccgtccgcacctcggatggcgaaacggcggtactccgactttttcgcgatcgcgtcttcgaacaccaccatggacgctacctggaatgcgccgccgactgtgttggaaatgtcgtagcattcaatgcgcaacggcgcctgttcaagcccaagagccttcgccacatcgttcatcgcatcggaacgtgcgcccatatcgctgatacggctcatcttgctgcgtgccaacgcctgcttggcattgtcgttggcacggtccataagctgtttcttgtcgcctctgctggctacacggatggtgacggccgctccacgcaatccgcttagccattgctcaagccctgcgctgcgcgacggttcgattggaacgatcacctcacggggaacaggcgcgattggagccagcaggtcggcacgtcccgtctgctcctgacgttcgttgcgttccttcgtggcctgcgcacgggcgatagcatccgttgcggtcacgatctgtgtcgaaccgatcgcattgcgctgctcggtcacgacggtcgaatcggagacggccgcgctctcccccgtggtttccgaatatacctgagtgatcagatcggcgatcaactccgcgtcgctcacatcttcgactcgctccacactccagttacgttcgccgcgaattgatccggaccgcacgaagaacgcgtgcacgctggcttcaagctcgtcggacgcgatgccgaacacgtcggcgtcgacatccgaatcgaacacgacggcgttctgctggaccacggtcccgagcattttgatctgatcgcgcagccgggccgccttctcgaattccagttcggcgctcgcctgcttcatgtcgcgggtcagttgggcgatatacgatttgccgattcggccggtcatcacgccgacaagctgctcgcacatcctgcgatgctcgtcagcgccgatacggttcacgcatggagcggagcatttgccgatcgatgccaacaggcatggacggcccgtcaactgcgccttgtggaacacgttcttcgagcatgtgcgcacgggaaacgtcttcagcaacgcgtcgaggctgtgccgaagatcccataccttggcgtacgggccgaaatatctggtatcgcgacgtttgcggctgcgagtcacccatacgcgtgggatgcgttcgcctgatgagatggccagatacgggtaggtcttgtcatcgcggaacaccacgttgaatcgtgggtcgaactccttgatccacgtgtattcgagtgtgagcgactccagttccgtacccactaccgtccattcgaggctgcgagccgtcaacaccatggtctgggtgcgtggatgcagctggtagagcggctggaagtagttcgtcagccggttgcgcaggttcttggccttgccaacgtagatgacgcgcccctcgccgtcacgccacttgtatacgcccggctgcgcgggaatgtcggaggttttcggacggaacaggtcgcgagtatcccccaacaggggcgcgccgttcttgttcactcccctgccgtcggattgggtgccggcgtccgatactgcggtttcccgtaacgcatccgccgttttgcgccacacgtccggactgtgtcgttcgaaatcagtcacagcatatccctaaggaacttgcccgtccacgactgttcgcatcgcgcgacctgctccggcgtgccttcggtgacgatggtgccgccgccgtcaccgccttccggccccagatcgatgatccaatccgcggatttgaccacgtcgagattgtgctcgatgacgatgacggcgttgcccttgtccaccaatccctgcaatacgagcagcagtttgcgcacgtcctcgaaatgcaggccggtggtcggctcgtcgaggatgtacacggttttgccggtggaacgccgttggagttccgtcgcgagtttcacgcgctgcgattcgccgccggacagcgtcggcgccggctggccgagccggatatagccgagaccgacctgcaccagggtgtccaggtaacgcgagatggacgggtacgccttgaagaactgcgcggcctcctcgatgggcatgttcagcacgtcggcgaccgatttgccgttgtacttcacttcgagagtctcgcgattgtagcgctggccgtggcattcctcgcagtccacgtacacgtccggcaggaagttcatttcgattttcaatgtgccgtcgccgtggcatgcctcgcagcggcctcccttgacgttgaacgagaaccgtccgggaccatagccgcgcacctgcgcttcgggcgtcttggcgaacagcatgcggattttgtcccatactcccgtataggtggcgggattggaacgcggagtgcggccgatcggattctggtcgacgtggatcaccttgtcgcactggtccacgccttccacgcgcgtgtgcttgccgggcacgatgcgcgcgccgttcagcttgtccgcaagcaccggataaaggatctggttgaccagcgtggatttgccggaaccggacacgcccgtcacgcaggtgaacacgcccagcgggaaattgacgttcaggttcttgaggttgttctcgcgggctccgaccacgcgcagctgcttggtcttatgcgtcttgcggcgtgcggcgggcacttcgatcttccgtcggccggcgatgtagtcgccggtgatggagcgtggcgcttcggtgatttttctggcggggccggaatacacgacctcgccgccatgttcgccggcgcccggaccgatgtcgatgacccagtccgcgtttctgatggtgtcctcgtcatgttcgacgacgatcagcgtgttgccgaggtcgcgcaaatgatgcaatgtgccgatcagccgttcgttgtcacgctgatgcaggccgatggatggttcgtccagcacatacatgacgcccaccaggccggagccgatctgggtggccagtcggatgcgctgcgcctcgccgcccgacagggtcttcgccgcacgcgacaacgtcagatagttcaggccgacatcgttgaggaagccgagtcgtgcgcggatctccttgacgacttcgccggctatctgcgcggccgagccttcgagttctaggccgttgatccatgcgaggctccgttcggcggacatgtcgcacacgtccgcgatggactcgtcgcccacggtgacggcaagcacttccggacgcagacgccgcccatggcacgcctggcatggcacctcgcgcatgtacgactcgtaatactgcttcatctggtcggaatcggtctcgtcatgccggcgcatcaacgtgcgcaccacgccttcgaaaccggtggaatactcgcgcatgcgaccccaacggttgcggtacgagacctgcaccttgaaatcacggccatacatgatggcgtcgcgcgcgtccttgggcagatccttccaaggcgtgtccaggtcgaagcccatctcatcgccgagtccctcaagcacatggcggtagtattcgccggtgcctttggtcatgccccacggttcgatggcgttctcgttcagcgtcttgtccggatcgggaatgaccagttcggggtcgatttccagcttgtatccgatacccgtgcattcagggcaggcgccatacggcgcgttgaaggagaaggtgcgcggttcgatctcgtcgagttccagctgatggccgttcgggcaggcgcgtttctcggagaacggcttgcgacggtccggatccttctcgtccaaatcgacgaaatcggcgacgaccacgcctttggaaagcttcaacgccgtttcgatggaatcggtcagacgctggcggataccgtccttgaccaccagacgatccaccaccacttcgatggtgtgcttcttctgcttggcgagcttgatgtcatcggacaattgccgcatctcaccgtcgatcagcgcacgcgcgtaaccatcgccacgcagcagttcgagcagatcctcgaattcgcccttgcggccgcgcacgaccggcgcgagaatctggaaacgcgtgcgttccggatacttcagcaacgtgtccaccatctgctgcggtgtttgcgcgcttaccagggcgccgcattccggacaatgcggaatgccggtgcgggcgaacagcagtcgcagataatcatagatctcggtgattgtgccgaccgtcgaacgcggattgcggttcgtggtcttctggtcgatcgaaaccgcggggctcagcccctcgatgaagtcgacgtccggcttgtccatctgccccagaaactggcgcgcgtacgccgacagcgattcgacatacctgcgctggccctcggcgaacagcgtatcgaacgccaacgaggatttgcccgaacccgacaggccggtgaacaccaccatgcggttgcgaggaaactccaagtccacgttcttgagattgtgctcgcgagcgccttggatggtgattttgaggtcgttgggtaggtgggtgaggtctgctatgagtgagtcgcctgttgttttcatgggggcttttttgatttcgcgtgtgaggaatgcgtcgctggtgagtacgcgttcgaccacgacttcgttgtgtgtcgtgttgttgcgtttggttgtcatggtgttcttccgcttggtgttgcctgttctgttgtataggatagcgtatttttgttgtggtttcgaacaggtgttctatttggtgttgttgtttggtatgtcgttgccgggtatgtcgattggccagtggtgttggtcgtgcaggatggttgtggcgtcgcgtatggggatgcgttcctgttcgatgcgtaggtattggatgtctgttcctgtgcagagtgtttcgtagagtttgcgttcttcggtggtgagtccgggtgtgggttgtggggtttgtgtggtgaggggtttgtttttggcgtcgaattgggtgccgtattgttcgtatgtccggtatgcggtggtgtccatcagtatggatgtgcatgggatgccggtggcgcgtagtttggagaggatgtcgagtccgttggcgtccatgtcgccccagtagatgatgttggggatggtggtgagccatggcaggagtgttgtgatgtgtgatgttgcggcgtatccgttgccgaggatgcagatggcgtgttcgacggtgggcatggcctggtaggtgtctttgttttcgatgatgatggcgtgttcgatgtcggttggctggttgcggacccatggttgggtgacgatgaggtcgggttggtcgtggtgttcggcgtccatgaggcgtagtcggagttcgttcgggcgttcctggaaggtgaggttgtcttgtccggtgagctggcatatcgctttgcggcgttgggagttgggtgtgccgagccatttggcgctgaatcctgggatgggcgccatgcgtggggtcatggtgtggcagtcgtggtttgcgaagtagtgggcggcttggatgacgaggtggaagtcggtgtcgtcgtggtctttgagggttttggcgacgttcatggcgttcgccggttcgaggccgaattctttggcgagcgcgctcatgcggtcgtgttcgcgtaggtagcgttcgcgggtttgtttggtggcgatgcggagggcggtgtcgaggtcgggtatggtcacggagtcgatgagcgggcttttttgttgaatgagtccgctggagacgattttggttttctcgctggtttcgcagtggtgttgccgcgcccagtcgcggatggtttcgttttgggcgcggatttggttgtagcgctgctccagttcggcttgtttgggcagtcggatggttttgcgcagcggccaggattcgtcggtgtcgtacatgtgcctggtgaggtgggcgtcgacgtattcgtcgagtttccggcggatgtccgtttcgcctgtggtgtttctggccgctgccatattatgcctccgtcgcgggttgcgtctgctcgacggtggcgtcttgtgtttcggcttgcgttgccggctcgcggtcgagcttctgcaggtacgagttgccggttgcgggatccttgtatgccacgtacgccttgtctgcgatgctgaggatctcggcggttttgctttccggcgcggatacgatgacctggaagccgaggcgcggcagcacggtcagcgcgcgtttcgtgtagcgtccgtcggctttgatgagggcttcgtccaggaacagtgtggtgtaggtgggcttgccggtcaggtcgccgccgagcaggtagatcagggcagcgccgtagacgaacgaggtgagttcctgcaacgcgccgccggacttgccgccggtggagctgatgcgctcgtcgggcagatcgttatggtgcacgatcgcgtagaacgagctgcgcacgcgtggatcgaggttgcgcgcaccgtattccttgatgccgttcgtgtcgcggatctggccgagttccgcctggagcctgccgatgaacgtttcgcagcctgcgaacgccttgcgcgtctccatgggattgctgcgcgcgttgcgtgtccaatcgtcgagcttcgacatgatgcggcccaacgaggatttgaactgccggtcgatcgggtggaagtccacgtggagcgagagtctgccgccgcgggggccgaactgttggcctttgagcatgccgttgatgcggtcgagctgctccctgacgttctcctcgtcggtgttgaacgcgcggttgagctgttggaagctcatatacagcttttcgacgctgttcgcatactcctcgtcggtcgcggcgcgggtgacgagcatgttgaggttcttgagctcgtcaaggaaatacggatagtcctccacgctcgccatgacggtgtcgccctccgtggaatggtgcttcagatagtcgcccatggcgcgttccgtgtcggcgcgcaattggacggcacgctcgtcgatctgctggagtctcgcacgcacggtgttgccgattctgcgcagcacgcgcacgtcgaacggcgccgtcccctcacggtcgaaaccgccggcgatgcgctgcggccgttcctgcggacgcgacgtgtcgaaacaggtctcatacgtgtcggccagcagattcgacaccatgtcggacaatgcggcatcgtcgaaatcggagtcgccatgcatgtcgagccatgcctgttcggcatggacggcatgctgcgcgttttccaattccgcttcggcacggtacctgttcttgccctcgtcgtccttctgccgtagcagctgtttcaactcgtcctgcaattgtgccagttccggatcgctttcgatccgttcgatctgcagacggatccgttccgccttcgtctcgagcccgtccacgtcgatcttgccccatggcagatccgcgacggtcaatgcgagctcatgctcgtcctgcagcagagtcatggcgttggccatctgcctgccgcggcggtcggcgtcctccaacgcccgttccgccccgtcaagctggcgttccaattcggccagataccgttcgttcacgaagccgatgacctgacgcaggcctttgacgccatggaagccacggtcgccggatttgatctgcccgtcgacctgcacctgccgttcggcccggtccatgtcgtcgatcgcctccacgcaacgcgcgtcgaaccgttgcgacgcggtctgctccttcaaccatccgacgaacggcgaatcctccttgtaccgcagcttcgacgacatccacccctcgttgcaggccgaatcgtattgcgcgtcggtatcgacgaaacgccaggcacgccgcgtcatacgcgtcggatcgatcgcgctgaccttcgcggcgaacccctgctcatgccgcttgtccacgagaatggtctgcgcgatgggcgcgtacgtgacgtccatcgccagacgccattgctcgtccccctcgtccacgtccatcagttcggccacgtacggcagttccgtctcgtccaagcccgtcgcccgtgcgatgagcgtgcgcgcatggtccatgtcgtcgctgatgcgcgtcctgtgttcgatcttgcgccggtaatcctgcctcaacaggtcgcgttcgccctgccgggcgtgacgttccaccaccatccgctggtattcggatcgcgcgtcttccaaacgcttgtcgtacgtgtcgagcgacaaggcgagcgcggcgcgtttggcgttccatgtctgctcgtcggcggggagtctgccttcgacgcgttcgaaccgttcggcgatggcgtgccgttgtctgcgcgcctcgtcggcgtcctggcgtgcgcgttcgaagtccttgccgagttgctgcaggctgccgccgtcgatgccgttcatgcgttctttgacggcttcgatttgcgtgtcgagttcgtcgatgcgctgctgagaccggtcgatggcgtcctgggattccttggctttgcgttgcgccgatggcagtccggcgcgtacttcgctggccatgcgcgaccatgtccatgcggcgagcgtcgtctcgccttgctcgcggtcggggtcgatgggcgtgtattcgcggcgttcgctggcttgtttggcgtattcgccgtagcgggcttgtatgtcctgcaggatggcgacgcgttccattttgtcttccatgctgtggaagttctcgctgaaccggttgtagtcgtcgacggtttcgcgggcgagccggatggattcgggcacgtcgagcacaccctgtttgaagatgtcgtcgagtttggagggcgcgtcggcggattggatcttgtgcaggagcctgcatgcttcggcgcttaggcccatgtcctgccagatggaggcgtggaacgcctgcgcgttgacgtgcgtcgtgcatcctgggtaggtctgttccatcagtcctcgcgtgaatgacgtgtcgcggtgccggtccatgaggcgcgggtcgatggtctggttccaggtgacgtattggcggcgcagtccgtccggcccgtcgcctgcggtcaggtagaggaattttgcgcaggacaacagtccgccgtcgctgcggttcgcgtatgtgtcgacgatcgcgccccagatgttctgcggggtgccgtccgcgtccctgccgcgcaggaagatcggggtctcaccgttttcgccgtcgctgatgccgatcatgccgcgcaggtacgtgtagtcgttgcgttccgaacgtcccgaattcgacgccttattgtagggggtgccggatgggtagagcagcgagatctgcgcgtcgacgagcgtggatttgcccgattcgctcgcgccggcgagcagggtcaccggcatcgcatcgtccatggacgggcggaacacgtggtagccgccgtaggagccccagttgacgatctgccggctttgcagcatccaacggtcggaaacgattttcatgccgtcttccatcagtgttcccccccatcaaaagcgtcatcggccgaatcgaaatcgaacgcgtcctgctcgacgccggatgaaaccgtcccggtcgaatcggaagtatcgccaccatccgcgccgatggacgaatcgtcataaccatcgccatccgcgtctttcataccatcgccgtccgtatcatcggagccgagccaccggtcggcgagcttctggtcgagcaccatcggcaccaatggcgtgagcacgtacatgttctcgtcccccgtttccgcgagatacccgtaggtgcgcatgcgcgagatgacggacgtgatcttcttcgccgtgccctcctcgtcgttgctggccgtgaggaagcccgctcccgtggcgagcagcgcgcggatgtcgtcgaagctgatgagccagtcgcccggcttcgtcttctggttctcgtactccagcaccttgatgcgcaaggccgcgagcgtggcggcctcctcgcgggtgaggctcacacgcgtcttcaacgagcggatgttcgtctccgcgtccgtgaccggcgacgcgtacatgatccggtatttcgtgttgtcgaccagtctgagcatgtcgttgttcaacgaccgttccacggcctcacggtactggcacgccctgtcgtacaggctgccgtcgatgtagcgttcgcgtttcagcgcgatcgcggccatacgcgcctcaagaggcatgtctcccgtatccccgtcgaacaatgccggcctgtccctcgtcatatccggcccttcggacggcatgccggatttcgggcctgtctcctcttcgatgccgatgccagtgtcgaatccgtcggtgttgtccgtcatgctcatccctcctcgatgatctcgtcaagcgccgcctcggtggtgaggatcggcctggtgcgccacacgcgctcgcctccgtcgatggatacgcaatgccatgccacggttgccggtccgtcctgcgtgcgtagggcgcttaggaagccgatcagctcgctttcgcgccgttcctcccggggcagccggttgaagctcgccgcgaaatccacgaacctgccgtccgccgttttgaccggatcgcgcctgatgagtccgatcatgtgcgtcagccgcgggccgcacatctcgaccatggccttcaggtccggcgcgtcgacgttcgtcgaaggcgcgtcgtccaatccggccgtggccgcgcgcgccatcgatttcgcgggcctggacggcaatgcctggaattgcgccgtgccggtgtccgtacggtatgggcgttcgtccgagccggggtgcgtcttcgcgtcgtcgctggcccgcacgaacagtctgtggagcttgtcgagcatggtgcggtaatgcgtgtcggtctgctggcgcaccagacggctcaccgcctcgtcggatatgcggatctgccggcgcacgtcctcgatgccctcgtagatgcgtttgagttcggcgcgtacctgggcgagcaggatgccgggctcgccctcgagatacgggttctgggcgatgtctcgcaccgcctcgtcgatttcgcggcgtccctcgtcggtgacgatcacctggaacgcgtcctcgaaacgccggccgctgtcggattcgtggaacgacctgtggtattcgtcatggtaggtgccgagcgcctgctccacgctgatggagcccgactgcatgcttcggcgcagattgtcgccgttgtcgcgttcctcgagcgccagttcgcgcaggtcgatcggcacgccgcgcagcgtgttgtggatgacgccgatgatgtcgcccacctgttgggaggtgagcttgtccaacgtgtcgctgtgcttcaattcgtcgatctgcttttgccgctcctcgatgtcgcgttcgagcaggcggatgcgttcgcgggggtcggcggtcagctgcatgcgcgcatgctcgatctccatgatgatgctgttggcctgcgcgccggacagcgctttcgtggtgtcctcgagccggtcgagcgcctcgatcgcacggtgggcgcgcgccgtgagacggtacaggtagcggtgggctgcgacgtcgagcgaattggcgagccaggcgtagtcgccttcgccttccttcgtcagctgctgcaggatcgtgtgcgcgacttccgcggacgtctgcccttccttgggcgtgtaatcgcccgtttccgcaagtcgggtcagactgcgggagaaccgttcctcgacgatctcgcgtggcagctcgccggtgagcgggtcgaacgtggagcgcagcagcgcgacgtacagcatggaattgccgcgcagcagcaatcgcagcaccccggtctcatacacgggccggagccgttccatttcccgtcttacatccgccaacggcgtcccgtccttcccttagccacaagtttcccgatgcgcatccattgtaagatagcatgtccgttttcccgtgatcgcggcgggaaaaccgtccggcgcgaacgtcatttgaagatgacgtagcggcacagcaggaagccccagaccgcctgcatgcccatggtgacgatcttgaccgccatggtgggccagccgagcagtccggggatccaggccatcatcaggttggagaacagcaggttccagcagtacatggccacgaacatggctatcgaacgcgcgtagttcgacgaggatttgaatgtgacgttgcggttcatgacgtagttgaatgagccggagcagaagacggccacggcattcgccagacggaacggcaggccagccagctgaagcacggcgaacacgccgaattccacgaaggtctgcatggccgaaacgccgccatagctgaacaattgtctaacgatgccgtttttcggttttccgtccgtcggcatgcggtctcctcccggtcgtctcaaacgctacggctggaaagcatagtcacacatgtggctacggacgcgccggaggcgtttcggcccggcggaatgaaaaaacggaaggacgcctcttccggagtttccggaagaggcgtcccccacgttttcggatcgtgtccgctcagatgctcatcgccatgagctgggccgcatactcctccacaagctcgctgtcgcgctccgtccaggaatggctggcggaatcgtccggcacgaaagtggtgtcgatgtcgatgttctcgttcatttccttaatacctccgttcgtcccacttgcccccggcgacattgccgactttcatggaacaggcaaaagtctggaccataaacgcgttcgatgcaagagcgtgttcacatcgtggtcaaacgtttttcctccacgcgtacatgccgtgtctccggcgtgaagacgatacgatgggggcatccctgccaccaaccaaaggaggacgatgatgagcgacgaacgcgatgaggccgaaccgatcgaactgggatacatcgaggacctcggggacatgatttccgttcaggagggggccaccgtgtcccgcaccgtcatgcagaaggccggaggcaacgtggtgctgttctccttcgacacgggcgaggagctcggcgagcatacggccgcgatgccggtgttcgtgcagacgctgaagggacggcttaaggtgacgggcaacggcaggaccgtggagcttgttccaggaggcctggcctactttcccacccgcatcccgcacgcgatatacgccgaggagccgtccgtcatgatgctgacgatggtcacgccggcacgcgacaacatcggcgactgaaaaaacaagaccgccggcatcggattccattggattcgccggtgccggcgactgccggaaatacaagaaaagctccctcccgggagctttcgttttgtggagcggacaacgggactcggacccgcggtctcaaccttggcaaggttgcgcttcgcggtctcaaccttggcaaggttgcgctttaccaactaagctatgtccgcatgtttttcaccttggtgggcaacgagttgaaaatatacaggagcgtccgccattgcgcaagcccggcgtgtcgcgtttttgcggcgccggactcgcggcagctccgcacgacggtcagacatagtcgtacggcatgcgctttttaacgcgccagaacacgataagcgcgatgtcgaagagcagcgcgtagaagccacggtccgtccacaatccgtagaccgcgcaatacaacaccaacgcgcgtaacgtatagaacacgatcctgcgcatgccggaacgctccctggtctccaccgtcatgcgcgtgaaaccgccgcccaacgtgcggccggcgcgcctccacggaatgatcccttcgaacaggacgaacatgacgatggtggccacggcggagacggccgcattgacgttgttcgcgcggttcacatcgaacagcacgccaaccagatagataagcgccgtgacggacagcgacgccgtttcgacaaggaacaggtcgatcgcgagcgccacgcagcggcgcacgaagcctggctcggtggtgatggcgtcttcgtcgatgcgctgttggggtaggaagtgggtgacaatgcttcccatggcgtagccgagtatgccgccgagggtgttggtgatgaggtcgtcgacgtcgaataggcggtaggcgcatggatagatgccccagatgccggtcagctgggtggtttcgatgagcagcgaggtgaggaacatggccggcaacgccgtgacgaatttccagcggaagacgcgtttcatgaagtagccgagcggtaggaagaacacgacgttcatggccagttgcatgacgcctgtgatgccgtcggttcggatgtcgtggatgaattcgaatgggttgagttgtggcctgagatggtgggcggcgcagtaggtggccgggttttctggcattgggtacatggtgaagcatgcgagcgcgatgaggtagagcaccacgagatatgcggtcagtgcggaggtgaagcgtagccggttatcgcggtggtagagcagtgcgagcacgggcagggtgagcaggagtgagaggaatggccagattgcgatggcgagcgcgaatggcttgctgaagtagaggacgtatgacatggccggtttcctttgctgggcgtgtgggatgcgcgtggtgtgtgcgtgggtttcgtttccgttgttggtttcaacggtagtacggctggtcgtgtccgtggcatcgtccgtcgtattcattccttggcgtaaatgttggggtgactcatcctctggtatgagatggcccggcgtgtttcttcgtgtctttttcctcttgctttttccgttggattgcttggcgtctgatccgcgcggaaccgatttcggacatcgtcttcgccgtcaccgcgggaatcctgttcatggcgttcacgccgaaactgctcagcgaataacggaagctcccgccttccacgcggaaggcgggagctcttatgggaagactaaggcggattttaaatccgaggaatagtcacctttttggcaccggtcatgtaatgccagaaatcttccgtccccggaataaggtcatgcagaacgcctgatgttttttcgaccgctacgctcggtgtgcccggcaccggatggtcatctgttgaagacgcgaaatcgagtccgatgattcacgcatcggcactctccgcggcaccaatcgccttcattccaggatattcggcgagaacgagattgatggcatcggccaatatcatctgaccctccttgcagcattccagtactgattcgtcggattcggctttatacgctttatacgcgtcaaaacgtcaccgtccatattcaaataccatgagtcgtttgccgatctcgtttgcggagcgggggaatcattccgcctgtttgacgcgttccatcgtagtatccgttgaagggcgttcttgttggtcttggtatccattcctcttatcacgtttccgctgtatgctttagggaaagctgttatgtgggaggatcatgcggaccacgaaaagcaagaaacccatcaccgtcgtatcggtatgcgtcgccgccgtggcatgcgctgtcggcgcgtaccggttcgtctacctgccactccggcctgccgatgtcagtcatgctcggatcagcatcaacgcgacgggcaagttcgacgaatcccagatcgacggcgcggtaaaagcggatcttgccaggctgaaatcctggaacgggtgccgcgtggatgccgtccgatatgacgcaaagcgttcggccacgctgcttgcagccgaacgcgacgtcacggcttccggtggcagttcttcgatttccacggccattgacgaatacgggatggacaatgtgatttacctgtccaatgacatctcttgccgtgcgggctcgcagaactcgtcccaagatggctggggaagctggtacgcgtggaatcccggttccgcgcgggcggaacacggatggatcttcatcgacgagggatattaaagttcaacggaataccgtgcaccatgccatgatgtcgaaaccatacgatgacgattggctttagtacagcattgataaaaagcgggcctacgcgtcctgatcacgcggaacgcaaacccgctttcgatggcatagtcatcgcttggcttatctggctacttggtcgaggaaccactcgtcatgactggccaccaccaatgctcccggatagtcggcaagacatcttgccagagccaccttggactctaagtcaagatagttcgtcggctcgtccatgacaatcaactgaggccggtcaagaatgcccaagcacaacatgagcttgcgcagttcgcccggagacggcgcttcgttagaaagcagcttatccggatcggcgttgagctgggcgaaggcggccagcacctgcgagcgttccttaccctgcaatgcggcgagtcgtctcatggtttgagaaagcgcggcttctcccgtttgctgctggacgatcagatgcggcaagtcttccggcatgctgtccagcaatgcgttcatcacggttgttttgccgagtccgttggcaccggtcagtccgatatggtcttgctgtccgatgctgagttttggtatggcgacgcctggcatccgtggtttttcaccactcatccctggattatgcgcgaccttccattgatgtccgtcggcatgcagtatggattgtgttggcgttctcgcggcatcgttcgagctggtcatcctgccgctgccgaatatgataataccttccgtgagatgcaggagctcctttctgttgcttggccgtatgtcgatccagatgtcgccgtcgtagcgtttggccgctacggttagtgaatctagtgtgcgctgtgctcgttcaagacgcttgttcatttgtcggtatgcggcgcccgaagcggtatcggtctgtttttcgatccatttgtggtgatcgagggcgctgtgatctttgcggtcgattttccacccgttgcgtttgcgagcatatgcgctttgcatggcttgatgtcgctgtgcttgtgcggaccgcagtcgtgtgacttcctgccgtgccgcacggattgactcctcgtctccacgcagtctggacgtcatcagctcatgcgcttgcgtatatccgccatcatatgtgctgatggcggtgatgttacgcccactgatgtgccgtcgttcgaatatgacgcatcgtgcgcatgtagcgtcaaccagtgcgacatcgtgggatattacgatgcctatgccctggtattggcgcatgacttcgactatggctttccgtgtttcaccatcaacgtggttggtgggttcgtcaagcacgagcacatcgggacgcgctgtgattgcgcaagcgacctgcaatcgtttcgtttcgcctccggaaagcgtttcataacggtagggccagtcatcgccgatgtgtaacgcgttgcgtacacgcatggttccgggcgaccaatccgtggcgaagtcgtcgaggttcttaggcctcaccatgttgtcttgcgggcaggtagcgatagtgagtccatgcgggtccgggttgatgctgccggtatcggcgggcaacattccgatggcgatgttcagtagagtcgttttgccgagtccgttgtcgccgagcacggcggtccatccttgttggaaagatgcggacacgtgttcgaacagtggttcagacatggacgggtatgtgtaagagatgccagtaagcgtgagcattgttgtccgggccatgtatggggcttctttctcatacaggcgcactgcgaggtcttgattgtgaaaaaacgaacggatacggaaccgtgaaatgtgcatacgagcaagctacgcggcagtgcgcttcaacgcgcacggttctgccgacggtatccgccgcccgttagatacgcaatgtccgtttctctttcccgaaaaccctcttggcatatgggaggatttaaatacactcaacatatttcatcatagcatatggtcattcgccgattctgctcggtctgccggatgcggaaatcctgtcattcgacgaaaacggcgtccatccctgcgattatgaggatacggacagctatcaaatcaccagggtcttcatcaaccaccgcgaatcactgctccggcatctgcttggaaatgaaacgtgagatgaggtgaaacggttgcgggtgttcgctatgatgttcgattggcgtttgaaggaacacgaaagactagaggtatcacggcatggcgattgaggcgcagggacttgagattcagatcggcgcgcgcacgttgctgcatcccaccaacttccacgttgccaagggagacaagatcggtctggtcggccgcaacggcgccggcaagaccacgctgacccgtgtgatcaccggcgatatgctgccgaccgccggcaaggtacgtgtctccggcaaactcggctatctgccacaggacacgcatgccgcagacccggagcagaccgcactggaccgcatgatgagcgcgcgcgacatcgcttcgatcatcaaacgcatacgcaaggccgaaaaggaaatgaccgatccggatccggatgtcatgaccaaggcgatgaaccgctacgacaaggccatgcaggatttcgaaaaggccggcggctatgccgcacagtccgaagcgaccgccatggcggccagtctcggcctgccacaggaagtgatgggccagcagctgggtacgctttccggcggtcaacgccgtcgtatcgaactggcccgcatcctgttctccgacgcggacacgctgatccttgacgagccgaccaaccatttggacgcggattccatcgaatggctgcgcggctatctgaaaaaatacgagggcggtttcctggtcatctcccactccaccgaactgcttgacgaagtggtgaacaaggtctggcatttggatgcgcagctcggtcagatcgacatgtactcgctcggttggaaggcatacctgcaccagcgcgtggtcgacgaggaacgtcgccgccgcgaacgcgaggtcgccgagaagaaggccgaacgtctgatgcagcagggcatccgtctgcacgcgaaggccaccaaggccgtggccgcgcagaacatgatgcgtcgcgcggagaaactgctggagaacacgtccgaggcgcagaagaaggagaaggttgctgacatccgcttccccgagccggcaccttgcggacgtacgccgatcatggcaaaggacatctccaaagcgtatggttcgaacatcgtgttcgccggcgtgaacctagccatcgacaagggctcccgcgtggtcatcctcggatacaacggcgcgggcaagaccaccaccctgcgtctgctcgcccacctggaggatcccgacaccggatccgtggagtacgggcacggctgcaaaatcggctatttcgcacaggaacacgacacattggaccttgacgccaccgtgttgcagaatctgattcacgtggcaccggaactggacgacacacaggcacgttccatcctgggctcgttcctgttctccggcgacgacgcgctgaaaccggcacgcgtactgtccggcggcgagaagacccgtctagcgttggccacgctggtgacgagccgcgcgaacgtgctactgcttgatgaaccgaccaacaatctggatccggcgtcccgcgacgagattctgaaggccatcgccaaatacgagggcgcgatcgtgctggtcacccacgacgagggcgcggtcgaggcgttgaatccggaacgcgtgctgctcatgcccgacggcgacgaggacctgtggaacgactcctacctggatctggtggccgaggaataatcccacttccaccatttccgacacgcatatgggaaagcccggacgaatcagatcgtccgggctttcccatattgaacggttcctgttacgcgggaaccggttacgcgtgcacgtgtttggcgctgtagatgtccggctcgacgtagatctcgaaattgtaccagggcaacgcggtgcgcacggccttctcgatcttgtcgacggtttccacgtcatagtcgcggtcgagcttgctggtctgcactttgacgcacaggaggatgtcgtcctccgacatgtgcacggtctgcatgttcagcaatcgttcgacgcccggcgtggtggcaaccgcctcgacgatcttcccgcgcgtatcggaatccacggcctcgccgatgagcagcgaaccggatttgaacgcgagaaacagcgaaccgacgatcagcaccagaccgaccatgagaccacccaacgcatcaaaaatctcatcgtcgagcagaatcgcaagaccaatgccgagacctgcgaacgccaaaccgatcaaagcgagcgtatcctccataatcaccgaagccaattcggcggacttggtgtgcctccagaaacggaacacgcccatacgcggcgtgttcgtgcgttccatacgctcgttggcctccttgatgctctgatgcagtccatatccttcgaggcatgcgctgatgacgaccacgatgaacgcgacgagcagttccattcggttcacgtcacgtagcgtagggtcgccggcgatcgcaataagcttcttcacggcctcggacgtcgagaagaatccaccgacaaagaacagcagcgtggccacgacgaacgaagcaagatatttggcgcgatacaggccgaacggatggtcgccgtccgtcttgcgcttggagaaacgtccacccaccatcaatacgatttcgttggagcaatccgcgatggaatgtaccgactcggaaagcatggcagacgatccggtgaagaacgccgcgagcagcttcgcgatggcgacaccaatgttcgcgcccaacgccgccttgacggccgcgccctgatgttcggcttcccgcacctcccccatgttgttcgtggtcgtactgtcgcctgcgggatcgcgcgattcgctcattgccttccattctcgaatgtgtaacggataacatcatccattcaagcacgaatactggccgagaagccgtgtgcgcccgtgtttcgggacgtgcgtgtaaccttcactaggtatttgtcgctttcccaaaaaaaggggtattcaatggtatactcgcataacgcgccgttccgcgccgacgtggtcggctcctatctccgcccggccgagctcaaggccgcgcgtgaggatttcgccgccggcaaaatcgatgccgcagcgctcaaggcggtcgaggacaaggccatcaccgaactcgtcgccaagcagaaggccgccggcctgcatgtgatcaccgacggcgaattccgccgcggctggtggcatttcgacttcatgtggggcttcaacggcgtggaccatgccgccgcagcccaccgcgtcgccttccacgacgaggtgaccccggccgacaccgccaccgtgaccggaagaatctccggcgagaaccatccgttcgtcgaacatttcaagttcgtcaagcagttcgaggacgagaacaccgtggcccgccagaccatgccctcccccgcgcagacccgcttcgtgctcaccggcaacgcggccgcctacccgtatgacgagttctacaagaacgacgacgagctgaccgccgacatcgtcgccgcctaccgccaggtcatcgccgacctgtatgccgccggctgccgcaacgtgcagttcgacgactgcacctggacccgcctgtgcgatgcgagcgtacgcgaacgtctcggctggagcgacgaggacgcgctacgcctgcagcaggagaacctcgacgtcatcaacgccgtgatcgccgaccagccggacgacctggtcatcaacacccacgtgtgccgcggcaacttccactccacctggctttcctccggaggctacgcgccggtcgcggccaaactgttcggcgaggagaacgtggacgcctactacctcgagttcgacgacgaccgttccggcgatttcgcgccgctcgccgaagtctccggcgacaagaaggtcgtgctcggcctgatcacctccaagaagcccgaccttgaggatccggacaccatcaaggcccgcatccaggaagccgcccagtacattccgctcgaccgcctgtgcctgtccacccagtgcggcttcgcctccacccaggaaggcaacaagctcaccgaagaccagcagtgggccaagatcgcactcgtccaatccatcgccaaggacgtgtggggcgagtaaacacagcacgccatccacaatcagctataaggaagggctatccgtcttgttcggcggatagccctttgtttgtttgccggcgtttttaacgggcaggtcagcccttcacagcctcatcgatgcaacgaatcgcgttcaacgtacgcggatagccgatatacggcatgcactgcgagaccaccgcgattagaaacgccttctcattgccgacgaccatattcgccttggcatgcgccgtaagctgcggttcgcaaccaccctgcgcggccaggaaacacaacgtgaccatttcgcgctcgcgggtgtcgagtccgccgcgagtgtagtagtcgccgaagcagttgtcggccagccacttgttgatgtgccgggtctcctccggtccggattgcgcgaatccgcgcatgttctcgccgaagatctcgacctgcttgtcctctccggcctgcgcgcgggtctccgacgtggtcgtgccctgcggctccagcggcagatgcacgttcgcggctccaaggaaaacgttgagcttcttcaggaacggcagggttctcccgaatccgcagtatgcggtggcttggtagatcatctccttgatggccacggacgtcagtcctgtctcgtaggcgaccggcagcatcatttcgaacgcgtcgagaccctggcagccgaccagagccgcgaggatcgccagggagcgggtctggtcgtccagatcgggatggttcgcgcccggctcgttcaccacttccccgtaagcgaagtcggaaaacagcttgacatattccggatcggtctgcgacagcgtcctgtcgttgttccagaacgcgttcatcttcctatgcagttcctcgaacatggcttcctttccattcgatgtcttcgcgccgcatgccgcgttcattctatcgtcggaaatgttgcgtgcggatagcggccatcgtcgtctgaatgttcagcgtgcgatcgcacccttgccgggctgtttcttgacgttttcgatgacgtctttgttttcctcgagaattcggttggcctcatcctcgtgtccttcggcgatggcgcgccaatagagcgatttgagcgacacgtacgcctgctggatgcgcagggcctcggctttcgcggccagacgcagcgattgcgcgtcgagcagttcgatctgccgtcgggcgccttccggaccgtcgaaacggttcttcaggtattcgcgcatcgattcaagcggcatgcccgtcgccgccaggcatgcgatggtggtcagcgattcgatgtccttgtccgaatagactcggtggcctgaactcggatcgcgggcgatcggatcgatgatgccgatctgctcgtaataacgcaacgtcgattcgggcagtccggaaatcatggacgcctcacggatcgaatgccaggtggtcgtcgtattgctcataccccgcactctaaaaacttaaagtgctcgaagtccatattccggcgtgtcgtattggtccgacgtcaaacggcattgagcgggcaatggaagagccggtatccgaaaagtggatctgtcgcacgactccattttcatgtccttttcggcaatcgtgcggctttttcgtccgtctgtatgggaaccgacggacgaaaaagcccacgcatgctcaggcggcggtgatcagctccgaggaatccatgtcgaaatcggccatcgcgtaggagcggatggcgggatcatcatacgtgttcatgtagtacgtgttggtcttggacgaatatccgctggtgaacagcgtgcgttcgaactggccgttgcccatcttcgccatgccgtcaaccatctgcacggaaccaagggtgtggaacaggcgggacacgttggccgcctcgccttcctgctgcggataatgcgtgttggcataagccacacgcacgaaacgcgacggggagctcacatcgcccggaatgccatgcatgctcacacccgcgccccaagcggacagggacgctttgccccacgtggccggctcggccatctcgttgccgacgcacatgtagttgcgcagattctccatatggaaaccgaacgtcggctggttggtcagcacgtctacgtcgtcatggtgcacatgcatgccgtccgccatctgttcgacgacgatgctgcgctcgctgtcgccgatgatccaatgcagcagcgactcctgctggccgggcacgatctgggagacgagggtcacgttcttcaacgcctcctcgacttcgtcgacggaatcgaaattgcgtgccacccacagcgggaattcgaaggtcgcgacgttgtcggtgccttcgaccggctcatgcacgaactccgcgtagccggggaaattcaatcccgcgatggccagaccatgctcgttggcgcagtcgaaatacatcggacggtcggccatgaccacgcccacgccgatcaccgcgttcggcgtggctttgccgctcgcgccgaacacgttgtcgtagtggtagccgcgtggagtggccaggatgctttcgccgtatgagaagctccagtcgaggttgcggccgaaatacatgtttccctcttcgtcggagaaacgaacgccagtgcacatgatggacttccttcctttgtttgattgacccggtgcgttcatcatacgcatggacggctggacgagccacggcttcagccgacggataaacatgaagggtggccaaaaatgccaagagtcgttgaaaatgaaaaaatccccttgtttccaaggggatttttcgaatggctcctgcgactgggcttgaaccagtgaccgtccgattaacagtcggatgctctgcgccgcttcaaacgtatcgggcctcccggtcgagcctttggctcccgggaggcccttttttcatgctctctttccgggcttcccggcgggcgtcgctccgggaaccccttttttgttccttgcgtggccttccggccgggcccccctggctccttggaaggcccttttttatacccgacgaacctcgatcatgcgtggaaccatgtcccagccgtcaacccgaaaaaatccggaccagcaatcgggatgcggtccggattttcgttttcctttcgttcaaacgccgggttcccttggaaggagcggcctaccaagggaccccgtccgtgggaatcatctccggctgttggtgcatggccataccttcggttcgggttcccggagcgccatgattcgttcgggggtacgcttcctagcgtgcgctccttgcggttttgcggcgcgcgtacgctccggccgccgttcccgcgccggcgagcagcgtcagcgcgacggccaatgccatgacgtcggatccggtcctcgcggtcgtgtcgggagctgtggcggccttttcgccgtcaggggagacggattgtttcttggccgtgacactggtggatggagtgtcagcggccttgtccgtggccttgactttgagaccgtcgatcgcggtgccaagttgttccgcggccgtggtgacgagaccgttctgttcgctgctgaatgtggtgttgttctgcaacgagagggcctcttcgtaggcttcggtgagcgtcatggttgtatcgtcggtgtacttgccggattcggcgagcttgcccttcgcctgggagagcggggcggctagcatgctcttgtcgagggccgacgcttccggatacatggaccggtatccggagatgaaccgcttggcgagctggtcgtacatcttggagtacaggcgtgcgttgaagttctccacgcggaagccggaggaccgcagatccatgctcctgtattcgaggttgtccggatcgtaggctccctccgcgaaggtcatgtcggccgactcggtctcggacgctcccttgccggtcccgctggtgtcgatggcgctgcccgtcgcatagtcgaaaacggtgccgttcttgtcgttccaggagtcgatgattaggctggaggtccggaacgggtcatgcccgacgcccatgtagttatatcctgccacgtccttgccggaggagatcgtgtcgccgttgtcgtcgacggaatagattggctcgccgtccgcgtcgagcggatagccgtccggaccccagacgttgtcggtgaccacggccagtccgtcgcggtcggtgtaactgcccatgcggctctcgcggtaccaggcgttgccggtggtggccgtcgggtgcagcagcagctcggcgccggaggccgcgtagtagcgggcgagctcgggatagaaatgaccgtcgcggcagatgtcgacgcccgccttaagcgggttgccgtcggcgtccttccattcgggcatctcgaacatgagtggcttgctgcccggtgttgaccatgcggtctcctcggagccggcgcggtgcatcttctggaaggagtcggtatggccgtcggggaacgcgaccgcggcggagttgtagaccttcctcacgccgtcggagtcggtgaccggtcctccgtcgggcatctcgggaagaccgaacaccacgtacatgccgtacttcttggcggcggccgcgatcttctgcacgtgctcgccacgggtcgtcgtgtcgccgtccgcgcccctcaccttctcggcgaggacgacctgcatgtagtcgtcgctggccgcgagcagcttgttgacctcggggtcagaggtgtgcgcgtcatccttccccttgggttcggtactgtcgtagccggtgaggatggtctcggggaagacgatcacgtcgacgcccttcgaatacgcctcgtcgatgtatttgagcatcatgtcggtgttcgcgtccttgtcgccccatactccgctcacgttcgcgacggcggtggtcggcgcgtccttggagccgtagcggtacgaaagcgtctggccggattcctgcttgtcggctagttccgcgtaccatttggcgtaatagtccggatggaagtcgttctcgaccttggtggtgctgccgacggagaccttaaggtcggcgtcgttcgtgagcgaaccctccttggcggtgaggatggttccgtcggagttcagtccggcgtagtatttgcacgagctgaagccgccctgcagtatcacgctgcctccggggaaatcgtatggctgcctgccgtcggcgtcggcgtttccgtcgttgccgacgaggtccgcgctggcgatggtcagcccgtcgcgggacgcgatggattcgaggcggttcctgtagtaccattcccagcccttggcgtccttcgccccgtcgccgtcgatgtcggtatagctcctggacgtggccgtcgggttaatcagtagtcccacgccctgcgccgcgtagtatcgttcgatctcgggttgcgcgtaggtgtcgtagcatatgctcagaccgatcattccccattcggtctgtaggatgacgggcgtgctgcccggcgtggcccacgagccctcgaccggcgctatcttctggtaggctgacaccttcccgtcgggagagatcgcgaacgccgagttgtaggcgtggccggtgtctccggggatcttctctggggttccgtagattacccacatcccgttcctctccgcggcctcggcaagttcgcgggtgacggggctttcggtggtctccgcctgcgagacagccatcctgtaggcgtcggattccggatcgctggaggagacgtagcctgtgagcgccatctcggggaagactatcatcttcacgccttcctggtgcgcctcttcgatgtacttgagcatggcggtcttgttggactgcttgtctccccacttcggatggaagttcaccacggagagctgtccggccgggatggtgccggaggtggtggtggacgcgctggcgaccacggtgcttgaataggtgtccgcgtacgcgtcgggcgcgccggcgaacgccatggtggcgcacagggacaaagcgccaaccgcggcgatggccgcggtgaagcggcggccggacatggacgctcctgtcccggacgggctgtgtcccgtcggctgttccatatcggaatggtttggtttggtcatgatgcctttcctctctgtcgccgtccgccgcgtccggagtccggacgcggcgtgtaatgccgtcgtatggcacggcgatggttgtggattgtcgtcctcctggttttccggatgtggtccgtatgatttcctgccgcgcacatccgtgttgcggaatgttttccatgcccgtcagggtttgtgtcgtgtttttcctccggtgttagaatgccgtccccgacggcgcggatgtcgggaagttgtggcgatttggtttatctctcaccgtgactggtcgaaaaagaagaaataaagataaggattcccgtaccaacggttcgggaccttccgccgaaggatccacggaaggaaaaccggggcccggagaggatcgcatggactgcgcttccgattgcgggattggtgagaatgcaggctggtgatcggacaacggtccgccttcattccgccggatgcctcggtttcgtccggacgtcttggacggcttcctcgatggagtccgggacccgaactgccccatgctttttcgacgatgatggcatgccggtggctctgcgaccttcgcccggattagcgatgccgccaccgccaagcatttaaatatttcgatgaatccttcgttccgcaaacggacgttttcggagcgtaaaccggactgggggagttgtctccgacactccggcggaaagtgtctcaaaacccgtcccgtaatcaacgttccgaaactccatgcctttgacgggtaatggtacggtcggtcaaattgcggtgatgatgggcgttgggcaatccactgtatatcggtatctgaatgaagcggatggcaagcgctgaacagtcgtttcctaaaaatatgttcatatgtcgccggcatttggcgaaggatcggccgtgcggaccattgtgaccatggatggggacggcaggctcgccatagacctgcgtcaccaaggtgagggcattggcgcgatgctgctgaagggcgccgcggaataagcctgacctccattccgcaaaccggccgggtcgccgcgcgacgttttaccgttaatctgtagaatcgtcggaatcggcgtttgatgcagtcgcgcggtcagaacagtgccgctcggtatccggaaaagtgcggaaatcgggtaaaactgtttttcaaaaagtgcggaaatcgggaaaccagggatgacggccatgttttgacggggtgcgcaatgccatgctcggatgagggggggtgatttcatggcggaatggcgccgttttttaaggggtacatagggtgcgcaggtggccatggaagggcggctctccctcatgaaatgttacggaagggcaaaaactcgctcataaaagtgtgagatgaggatgccggatgtttcagagaaaacgatgacaaggtcagccatggccacatcgccgtatcgccattcgtcacagcagctcgtctctcttaagcgctccgaacgggtcttcctccgtctgatattccactgcatggtctttgaacacgtttgatatacaaaacatatttgttgcggactgcaagtgaggaaccgggcttatagagacaaagtgcgagagtattggacggttcgttgtcggacgggtcgtattagagaggtagttcccgatagaccaaatcgtcacggacagcaaacccctgatgctcccagaaatcgttgccggcatcgttgtctgcgggcacaccgacggcgacttttggcaggccgatcgcacgaagcgcttcaaccactcggcccaccaaaagcgagccaatgcccataccgcgcgcgtcgggatcgaccgccgtgtggtagatgcgcgaccgtctgccgtcgtgaccggcaagaatcgctccaataatccttccgccatcgtcttcggctacgaaacaggtgtcgggattgcgtttgaggaacgtttttatcgcatcctcggaatcgtcgatgtccctcatggtgaaaccggtgcatcgcgtccacaacccgtataccagcggataatcctcaattttcatacgacggatggttggtgcaggcccagtcatatttcctccttttctcgttgaacgttagtttcgattttcgtatcgttcgcggtattcctgcgcgcgtatgccgtatttgcgttgcacggccgtctgcagcgcgcgcgtatcggggaaaccgcattcccttgcgatgctggctatcgacgcagaggaacctgacagttttctgcaggcgtcgtccaatcgcaggtcggtcagaaattctttgaacgttttgccggtcgccttgcggaataggcggcagaaatgttccctgccgtatccgaattcccgtgcgacgtcggtcgcttcgagatgctgtttgcggtgcgatgtcatgtatccgatgatctgcatggtgatgtttcttccggatctgaccaattccggccgccgtaccccggaaacgaacctcgaatacagcagcgatagcaattcgtacagcagcatattgagcttgaatccacgaatggcctcatcggactgtccaatacattgtagccaatccattttcattgaaaacgaaatttccgacattgatggcaattacgcttccaaacatgataaactcgttactaaacacgtttagttgctgaatttccaaggaggtaggtttccatggccacgatcagggagatcgcggaaaaggcgggcttctcccaggcgaccgtatcgagaatactcaatgacgacccctcgttctcggtgaaggaggccacccgtcagaagattctgagcaccagcattgagatggggtacgagaacgtcccccgctaccaacgtgtcaccattccgcaagacatcgcgttgctgaacaactccatccacgacaaggggcttcaggacgcctattttgacgagcttgaagtttcattacgtcgccatgccaaggacgagcgcatgagagtgacggaatacaacgatgtcaaatccctgatgaaggacgcgtccaaatacgccggattcatctcaataggtccggcgccgttcaaaaggaacatgttgaagcgtctgcacgcggtccttccgcatggagtgttcatcgacatcaatcccgcgccgagcctgttcgattcggtgcagccggatctggagcagaccattctggacgccttggacgaattgatggacgccggcaacaagcgaatcgggttcatcggagggttcggcaacatcatgggcgaccatgagtatcccgaggatccgcgtgcgttcgcgttccgcaactggaccgtccgtctcggtcttgacgtcgacggcctggtgttcgatgaggggcctttcaccgtggagaacggccgtgccttgggagagaggttcgtggccgaatgtggcgacaggctcccggatgctctgattgtggcggcggaccccatcgcagtaggcgtcttgcaggcgttcgcggcggccggcattctggttccacgcgacatgcgactggtgagcatcaacaaccaggagatcgcgaattacacttcgccgacgctttcgtcgtatgacatcaacaaggacgaattggccaaggccgcggtattcatgctgtcggaggccatttccatggggcgctccgtcaaccagcatatgaggatttcaaccaagctggtcgcccgggacagtttcaccccgaaagccaggtagggtttaagaagaaagggttcagtcctcgttgacacgcgtaatacgtgccaacgaggaccgaaccctttttttgcatctgtgaggtgttttcgaaggaaagtctgtcaagccctgttcccgatatggaaacgagggcacggcacggggaaaacatggaagacgtgccgtaccctttcaaggcgccgtctccggtttgatgtcaaggtccacccttgacgacggcaccgtcctttcgccatacgtttccgcgtatggcgaaaggaaagccaagtcccggttttcgccggggcgcgccggtcagatcaggtcgaggtcgacgtcgaggctgatcggctggtccgccgggatatggtactgggggtggaccggggacatccaggagtcatctcctccgacacccatctgctcggcaagcacacgcaggaacatgtgcttcggggcggggagctcgtcctgatgctgggcttcctcaagcatgaagctggagtacggctgcaggctcatcgcgaacggttcggcgccttcggcgcggcttatgcgaaggccatggcccttctcgtccgtgatctcggcccaacgcacgtcctcatggttgccggtttcctgcggcatgagatacggggcgtggtccttgaacgcgtcggtgctccacacaccgagcttggcatgcttgcgatcctggtaggtctcctccggaccagcgccgaagaaacgcaggttcgagtactggaccggaagggtccattcgatgccgaacgcggggatggtgggcaggtcgcccggctcgcccgggtattcgacgtgcagattcactcgtccggtggtgtcggcggtgtagctgacggtcaccttggtgcgctgcggggtggcgagctcgtacgtgtaggaggccttgacggtgttctcgtcgatctgttcgatctcgttgccgatgcagcgggcgtaacggcctgctcccagccactgggcgcgttcgaagccgtggcctgcgccgcgatcgttgtcggtcagcgcgcggaacgtggtgaccgccggacggcgcagcacgaattctcgattgttgaacgtgtaggagaccagtccgccttgggtgcgggaaagcagtacctcgcggccggatccctgcacgccgacgttccaacggccaacggtgacgatgccgtcgaccggcttcaccggagcagaggccttcttggagccggcgacgacggtctggccgaatgccagctcatagccggctaccgcccaattggtcgccttggcgagacgctgggatacctccagcaccagttcggacgcgccgtcgcggtacagatccaacggccagtcgacatcgagcttctccgtcgaaccggccggcacgtcgaaacggcgttcggactgccataccggttcgccatccgcaaggacacgcaacacgaacgtgtattcgccagtggaggtgaacagattatcgttcttgatggtcacggaatcctcggcgacatcgatatgcacgttggaatacagctgcttgacctcctgggccttcggcgtgggcttacggtccgcaaacaccaggccgttgccggagaactcgtagtcgctcggcctgtcgccgaagtcgccgccatagcgaaggctcgtggttccatcgggctgggtggcgtagatcgcctggtcgatgaagtcccagatgaagccgccctggtacttcggatagcgttcgagcgcggtgtattcgtccatgttgccgcacgaattgcccatggcgtgcatgtactcgcaggagatgtaaggcttctgcggatcattcttcaggtattcctcgatggcgtcggcgtgcgcatacatgcgggtctcgatgtcggtcacgtcgtcgtagtcgcggttgtgggtcacgccctcatagtgcacgggacggttcgggtcgatgtcgtgcacgcgcttgtacatggcgcggaacacgtcgcccgtgtaggattcgttgccgagagaccagatcaggacgctcggatggttgtagtcgcggcgcaccatgctgttgacacggtcgacgcacgcgccctcccaatgcgccttgcttcccgggacggcggtctcctcggtgaggacgtcaccgggcaggcaccagctgccatgggtttcgaggttggtctcgtcgatcaggtagatgccgtactcgtcgcacagctcgtaccagcgctcctggttcggatagtgggaggtcctgatggcgttgaggttgtgcctcttgcagaagaccacatcgtcgatcatgtcctgctcggtgatcgcgcggccgcgcttgggatcgaactcgtggcggtcggcgcccttgaatacgatgcgcttgccattaatcgtcatgatgccgtcctcgatgcggaagcggcggaatccgaccttctggacggcgacctcggcgatgttgccggcatggtcgatgaccgtgacctcgaactcgtagaggaccggatcctccgcgctccacgggcggatgccgttcaacgatccggtggagatggaggtatcggggtcagcgcagttcgcggtctcccagacgacgttaccatcggaattcttcaacgtcgccgagatcgtggccgcgtcggctgcgttgcgcacggtgagcgccgcgtccaaagaggcgctgccggattccggatcccaatcggattcgatctgcatgttctcgatatgcacatgcggctgcgcggccagctcgaccgagcggaacagtccgtgcagacgccagaagtcctggtcctcgagccatgaggcgctggagtattcgtagcatgcgacggcaacgacgttctcgccgtcgtgcagcatctcggtgatgtcgaattcgttgggggtgaagccgtcctcgccatagccgacgaacatgccgttgacccacacgtagattgcggtggccatgccgtggaacacgatggagacggttccgccggcgttcttggtgtcggccagacggttcgccatcgtgaaggtcttacggtagagggcgacatggttgttctccggaatattcggttccgccggattctcgtggccatcccacgggtattgaatgttcacgtacttgttgttcatcaatcccgccatctgcaggtgtccgggaacctggatgcgttcgaaggcggaatcgtcgaagttctcccttacgaagggctcctcgttgaattcgatgtcggatgcctgaacgacctcgaccctccattcgccgtcgaggctctgcctcagatcggaccattcgttggtctgcgaatcgtgcgcgtagcatttgtggtcggaatgcgccgggacgcggttgacctcgaatacggtcgaatcggcgagccaggtctcggatgcgtgttcgatgcgggtttcgtttgccatgttttcctgctttcgttcattacatctttgtgaatgatggagagaagatgaacttcctttaccagataataaacgttgtttacaaaaaaagcaaatcggttttacttgacgtcttaattccttcgtatcaacggtatatgttgtaacgtatcaggcatctgattgataccgatatgacagtgctgatacacggtttacctaattcaacacgccgccaaaccctatattttgctaatggtttttactttttcttataaagagcgtatactcgacatgcaagatcaatgggtgatcttcaactccggaatcttaaggagaagaaagaatgagcaacgaaacgacaaccgcggacggtggcgtccgcaagaagggcaagctcggccagcgtatcgcctacgcctgcggcaacctcggtcagtccgccttctacaacgcgatgagcacatatttcatcgtctacgtcaccggctgcctgttctcgggcgttgacaaggcgcttgcggccaagcttatcggtgtcatcaccagcctcgtggtgatcatccgtatcgccgagatcttcatcgacccgctgctgggcaacctcatcgacaacaccaacaccaagtggggacgcttccgcccatggcagttcttcggcggcctgatctccgccgtcctgctcgccgtgatcttcagcggcatgttcggcctggtgaacgtcaacaccacgctgttcatcgtgctgttcgtcatcaccttcgtcgtgctcgacgtgttctactccctgcgtgacatctcctactggggcatgatcccggcgctgtcctccgactcccacgagcgctccacctacaccgccctcggctccttcaccggctccatcggctacaacggcatcaccgtcgtggtcatcccgatcgtcagctacttcacttggacgctcaccggtgccaagggcgaaggacaggccggctggacctccttcggcatcatcgtcggactcctcggcatcctgaccgcatggaccgtcgcgttcggcaccaaggaaagcaccaacgcactgcgcgccaaggcccagaagaacggcaacccgctcgaggcattcaaggccctgttccagaacgaccagctcctgtgggtcgccctgtcctacctgctgtacgccatcgccaacgtggccaccaccggcgtagaacacgtcggccttgccggtgacgacgttggtggtcacatcggtctgcagcttgttggacaggatctggatgtcaagcttgttgtccgccttgcactgttcggcgcccttgttgacttcctcctcctgtgtggtgccggtctgcaccgcgatcttcaatccgcacaggtcggacgtgtcgatcttgcccgggttgcccttcttgaccacccacgtggagccggccttgaacatgctgacgaagtcgacggccttcatgcgttccggggtaatggtgaacgacgagacgccgatatcgtacttcgaaccgatcgacggaatgatcgaatcgaaattcgacgtctgcggatccgcctcgaggccgaacgttttcgccaacgccttgacgatgtccacgtcgaagccgaccggcgtcttgccgtccgcggccaggaactcggccggcgcgtacgacgtatccatgccgacggtcagcttgccgtccttggtgacggaggacggcagcatcttggcgatcttctcgtccttcttcacgccggacacgtcgtaaccggtggtcgacgacgaattcgaatcgtcggaagcttgggaatccgttttgtcggaggttccgcaggctcccatcgagacgaccatcgccgcgctcaacgcgagcgccgcccaacctttcaggttcctcatcatggcaagtcctctcttcaacccagccaaatcaaccagccaaacgcggctatggcataacctaagagcggattgctacgagcgtattaacggacgcaaaagttccgaaacattcactcgttggtgccgggggtgttgatctccggcttgctgatggcaccgtcctgaacaccccagtacttgaggatcttcatgtaggtgccgtcgtcgatgagcttctgcagggccttctgcagggcctcgtccatctgctggtcgcccttcttgacgacgatgccttccggggcgatgccttcggtcttgccaagcgtttcgagttcgccgtcggtctgcgcgatcgcgtagccggcgaccggcgaatcggcgtagaacacgtcggccttgccggtgacgacgttggtggtagagcgccgccctgtcacggcggaggtcaccggttcaagtccggccgtggtcgccaccaaaccccagcccaatccgctggggttttcttttaccctcaccctcccctcccacgccaattcacgcttcccaaccgtcaagacataacttgcccacaaaaacgaggcgccccacaaaaatcaaaaaacgcaacttacccacagaacgaagcaacatcgcaacctgccaataaaaacgcggtggaggccggcatatgcgttgcaaggccgcaagctcggccgaacggccttgagtgtgccttgcaacgcatatgccggcctccaccggacaccccgcaatcgcaacatcgcaaaaacgccgtatattcaatcccaccaaacaccgcaacatcagaaaaatcgcaacttcacaacacagccagcccccccccaaaaaaaatcgcaataaatcgcaaaaaacaaaagcggcacgcttgaaaccatcaagcatgccgcaatcgcaataaaaaatcagttctgcaactgctgttcgacccaatcgacgatatatggcgccacctcttcgatttggtcgatcgccacttcgaattcgcgtggaccaccgtaccacgggtccaccaggtcgatgctgtcctcacgtcccgcggccggcttcggcagattcggatcgaagctgcggtacatgtgcacttcgctgcgcttggcttgcggcagctgacggagcagcgcgcgcatgtgcgaggcggtcatcggcaggaacaggtcggtgcgttcgatttcgtcgcgcgtgatgcggtgcgcgaaatggtgcgccggtagctcgtagccgcgttccttaagtaccttgacggcacggcggtcgatcggattgccgtattcctcgtcgctgacgccgctggattcgacgttgaccttgtcagccaagccgcggcgctcgaattcggcgcgcagaatgatttcagccatgggtgaacggcagatgttgcccgtgcacacggtcatcacggtatacatgaaaagttactcctcgtggtttctttcgtacgtcacgaaacggaagccttcgacttggtcgtttcctttccgcgccttctgccacgtgccttcctcggccacgcgccatgctccggattccaccaatgcgtggatatcgggcgcgtaggtgtcggcgttcacgtgcatgctgatctgcgtcacatatgccttgtcggcgaatggcatcgcttcctcgaatactttggctccgccgatgacccagatttcactgcggtccaagccgtcatccggaatggcctcctgacgggccagatccaacgcgtcatccagcgaatccaccacggtggcgcccggcgcgaaataggacgggtcatgcgagatgacgatgttgtcgcggttgggcagcggacggaacttcgggcttagcgactcccacgtcttgcggcccatgataaccggatgggagacggtcagctccgtgaaatgcctcatatcctcaggcagatgccatggcatgccgccttcgaatccaatggcaccgtcgtgaccttccttgtcacaggcctgtgcccaaatcagattcacagagaaggttttggggaaatcgtcgccccaatcctcctcgtcttcacgcccggcaagtccgggctcgggttcgtgatagccactgcggctactatcgtgctccatttcactcactccttgaagtcggaactagggtcagtagtctaccgtctggcgcagacgcgccagacggcggcaacaacctcagaccgccaccggtgccttgatggtcggatgatgctggtaattcacgatttcgaaatcgctgtaatcgtagtcgaacagcgaatcggccttcctgatgcggatctgcggatacgggtacggcgtacggctcagctgttccaacacctggtcgatgtggttgtcgtagacgtggcagtcgccgccggtccaaacgaattcgccgggctcgagtcccgtctgctgggccatcatgagggtgagcagcgaataggaggcgatgttgaacggcacgccgaggaacatgtcgcaggaacgctggtacagctggcagctcaggcggccgtcggccacgtagaactggaatagggcgtggcatggcggcaaggccatgttctccacttccgccgggttccatgcggaaaccaccatgcggcgcgaatcggggtggttacggatcaggtcgagcacgttggagatctggtcgatggtgcggttcggatcgtccggcgtcggcgccggccagctacgccactgcgcgccgtagaccggccccaaatcgccgttctcgtcggcccattcgtcccaaatgtgcacgttgtgctcctgcagccaacgtacgttcgtggagcctttgaggaaccacagcagctcgtaggcgagtcctttgaagaacaccgtcttcgtggtgagcagtgggaagctgtctttgagattgaaacgcatctgctggccgaacagggagactgtgcccgtgcccgtgcggtcggatttcagtgtgccttccgtaaggattttgcgtaccagatcctcgtaaggcatgggaatgtccgtttccggacgtgcgggaatacgagtacggatgtctgcgagttgttcggaagtcaaagccataataggcaagtttagccggtggcgtggaggcggacggccgggatgcgcgttgtaaggccgtaagcttggccgaacggccttgagtgtgccgccaacgcgcatcccggccgtccgccggcctccagcgcaatcgcaacgaatcacaaaaccgtatcgcttcatcttgcggaacgcactcccccacgtccgtttcgatgcgctagattggtatcacggattggcgcgaacggcgcgccacaggacatgaggagtttccatgggcaagaggctgtgggtagagcgcaacaaggacggttcctgggacgcgttcagcgaggatggcgcgcacatcaaattcggcaagggccgtggccagttcacgccgggcgatctgatgaaggtcgcgctggccggttgcgccgcgttgtccagccagttcgccgtcgagcatacgttgggcgatggcaagggcgcgaagatcgtggtggacggcacgtatgatgccgataccgacgcctacatcggtttcgacgagcaggtggtcatcgacgccaccgacgccggtttgagcgacgaggacgccgaaaagctcgccgatcgcgtcagccgtcatatcgagaagggctgcacggtcaagcatacgtacgtcgagccgacgccagtgcgtatgaacgtcaccgtcaagcactgagcgcacgtaccgcacatagttagagggtggctgcgattcgttggaatcgcagccaccctcttctatgcggtttttatatcgatttcagtcgatttgccgtaccgtcactgacggtccggatcgatcttcgtttcgatggcttcgaccacttccggcttggccttgtcgaccggcacttcctcgacgcccttgatgtcgtcgatcgccttcggcgtgacgtcggcaggcgagctcggcacggtgtcgagacgggtctccgcggcttccacatacttgcgcggcaccacgtagaccggtccgaccgcatgctgcagcagaccctggctggtggagccaagcagcagaccggtgaagccgccacgaccacgggagccgaccacgacgacgtcatgatcgtagctggccttggtcagtgcgccggctgcggggccgggcacgatctgcttgttgatcttgaggttcgggtacgcctcttcaagcggcttgatgcgcacgtccagatcctcctggaaggacgccatgacgccttcatcctcggagcccttcatgttcggcacggcggagatgacatccagctcggcgccccacgaatcggcgaacgcggccgcgatctccaacgccttcagaccccacttggattcgtcggagccgactgccaccttggtgatggtgttgttcaagtgcatcaggttgccttcgtcgtcggtgtacggcaccacgacgatcgggcagtacgcgtatgccggcaggctggagctggtggtgccgagcagtcgttcggccagaccacccttgccacggttgccaatgacgatgaggttgtagttgcgcgacagttcgacgaacacggatgcgggatctccggtgacgatcaacgtcgatgcctcgacgccctgctcgtcggcgatggccttggccttcgacagaatctcctgcgcatcgttgtgcgcggcattgtcatcgcccatggccgtatacgtggcatcgaacgacactgccgcatagcttggcagcgaatatgcgcagacgatctgcagggtcagtcccgcatgcttcgcgtaatttgctgcccaccatgtcgccttgtagctggcgtgggatccatcgacacctacgaggattgccttgtcattgatcatgagcgacctcccttgaatcaggttgcggcaacgcgactatgcgttgcacctgacttccaccataccgcgcgacatgcggttttcaagtaacgacgcggaaaataacaaagcaaaagggcgtattcctcacggaaatacgcccttagctcaatgtcaaagcttcagaagattcgacgaatgctgtagctgctggggaacacccatgcgatgggatcgtagcgggtgccgttcagctgggagttgatgaccatgccgttgccgacatagatcgcggcatgctgcgcattggcgatgatgtctcccggctgcgcgtcggcgaggctgccaaccgcgcgacccacagtcgcctgagcaccggagtaatgcggcagggaaacgcccatctggccgtagacatactgcacgaaaccggagcaatcccaaccggacggggtattgccgccggacacatacggaaccttgccgacgaactggttcgcgaacgtcagcaggctggacacgctggccccatcaggcggcgtcacggtgaaggaaccgctgctgctgaggtcgcttcgagcggcggaacgagaagcggcttgggcctgtgcttgagcctgggcctgctgctgacgctgctgttccgctgccgctgcggcggcttcgacgtctttttcggcttgagatttggtttggggaacgttcaggctttccacaccgccccaatcggaatcggattcgacctgggtggacgatgcctccgcgaggatgttcttcttcacggcgttggtcttcgggaacgaacgggtagcaacgacagcatcttgcgtggcgccatcattggctgccagcgcggcaggtgccaccccggcgaaagtaagagcggccgcggcgagcgcagcaatcacggaacaatgcttaatatgcttcatcgaatccttagcttacagcatccctcttacaagaaaaggggcacggtcgtcggtagggaaactcagtagtgaatatactggaaatcgcccacgttcgtgagcgtgcgggaatacgtgccgccattgagggaggcgccggattcagaggtcacgatcgagccgtcgtcgttgattttctcaacgatggcgacgtggccgtaatacgagtcggaaccttcctggcctgcggcgaacacgatgatatcgccgacatggcgcggcgtgttatcaacccaatagcccaaggcgcgggccgaatcggcccactggcaaccgttgcccatgtgggagcctgcaggcagaccgagctgatggcggcgcacatacacccaccacgtgcactggctgaactcgtaggcgttgccgacgtctccggtggcatggttcggattgaagttagccggtaaggcgctgctgtcttggtccatcaggacggcgacgttcggattgtcggcgatggacttggacatcaggctggcgtccatggaggcgctggtgtctcccagctgccaaccgccgttgttgctggtggaagccagttccttaagggcggtacgtccttcggaacgggatgccgctccatcggacacacgtttgatctgggacgtttcggtaccgtcgtccgcaagcaccagtcgggatgcgttctgctggctgaacgccaacgcggtcgccgcggtgccgacaagcgccgccaacgaagcggaggtcaccaacgcggatttgcgggaagcggctttggcggcctcacgcatggcacggcggctcattggagccacttcattcagtttatccacgacttccggagcgagtccgactacggcgccgccttccgccagctgtgccattcgcacggccttagcggtatgggagccccggttcgccgtgaacaacgccttggataggctgaattgcgcgtgcgaaaccttggcagctttatgcgccgcatgcctcatatatcaatcactccttgcggattgcgaaaccgtcgcagcttatgaccgcgcacggttacagaaccgtcacaagggtaagggtacaccgacatagggattatcatcaagaccccgtccttgcgcaaataattcgccacgggtggaggaacgtccggaaaacggccatatcaacgcgcaatccgaccttctgactacccttggatgacatgacgaacactgtgaacattcctaccaacatgcttccggaggatggacgtttcggctcggggccgagcaaaatccgtccggagcaggtccaggcgctcgacgcgggcgcgcgcaatcttctgggcacctcgcaccgccagaccccggtcaagcaggtggtcggctccatccgcgaaggcctgtcgaatttcttccagattcccgacggctatgaggtcgtgctgggcaacggcggcgccagcgcgttctgggacatcgcctgcgcgtcgcttatcacccgcaaggcggcgttcggcacgtacggctccttcagcgcgaaattcgccaagtccgcgcaatccgcgccgttccttgaggatccggagatcttcgcgggcaaaccgggcacgtatcgcctgccggagctcaccgaatatgtggacgcttactgctgggcgcacaacgaaacgtccactggcgtggcggccccggtcaaacgtgtcgaaggttccaaggagcagggcgcgctgactctgatcgatgccacgagcggcgccggcgcgctgaacgtggatatcagccagaccgacgcctactacttctccccgcagaaggcgttcggctccgacggcggcctgtggatcgccgtgctttccccggctgcgatcgaccgcgcctacggcatcgctaaaagcgtcagtctgccgggcgcgcgacgctggattcctccgttcctgtccctgacctccgccatcgagaactcccgtaaggaccagacgctgaacacgcccgccgtggccacgctggtcatgctggagaaccaggtgcgctggcttaacgacaatggcggcctcgcctgggccacggcgcgttgcgcacgttccgcgtcgctgctgtaccagtgggcggagaggtccgattacgcgcagccgttcgtttccgacgaaaacgcacgttccaacgccgtggtcactatcgaccttgacgagagcatcaacgcttcccaagtggtcgccgcgttgcgcgagaacggcattgtggacaccaacggctaccgcaagctcggccgcaaccagctgcgcatcggcgtgtttccgtccgtggagccgagcgacgtcgaggcgcttacgaagtgcgtcgattacgtggccgagcacctgtgacgcgcgcaccgaggtaaagtaacggtatgaaatttgctccgattatcgacccaagcgtgcgcaaaccctcccccaaaccggtgcgcgtcgacctgcggaaggtgttcacgttcggcaccgcattatgggccatcgccttggtgatctgcatgattctgctggccttcggcatcaatgtcgaacgattgcagaccatgtgcgccgccggcacggtgatcggcgtgctcatgctggtttgggagcatttcgaccggtgggactaccgccgtcttggcgaataacccgaccggcggttcagccaatcgcgaaataaccggtaacaacattgggccgcttccgcaccaacctgcggaagcggccctttgccgtatatggcgtgtcccaacgctctgcaatcgccgctaatttctggcgaccggcagctccaacgtaaacgtgctgccctgtcccggagcgctccacaccgaagcggagccatggtgggtcaacgccacatgcttgacgatggcaagacccaaaccgatgccttcctcggaatgcccattctggttgccgccacggtagaaccgttcgaaaatacggctttgctccttctgtgcaatgccgcaaccacggtcaagcacgctgagcagcactttggtgccgtcctcgttcggcttgacggatacggttatgcccttgccgtccggtgaataggcgatggcgttttcgagcagctttgcgaccgcggcctgaatctgctcgccttccccgttgatgtccagtgattcgtcgccatcgatttcaatgtcgatgccgcgccgttgcgccatgtcgcgatgcgcgccgacgacggttttcacctgttccatgacgttgatacggttgctcgccgtcggcagaatcggttcctgcgccttgataagcagcagcaggtcggacaccatatgttccatgcgagcgcaggattggcgcagttttacggtgttcccctcaatcgcggccttattgtccgagtcatgttccaacgcgtccgcaagctcctccagcgactgcgtcggcttgaggagctgctccgaaacgttggtgatgaaggaatcacggatctgggagaaacggacggtttcgctcacgtcggaaactagcaccaccacaaagcgttcgttgagcctgcctacgatcaccttcagccagttcgggcgggacaccgtggtcaccggcttgtccggcgattggccgatcaacgcctgtttggcaacctcccgcatggttggcttccctgctttcggagccttcttcggctcatgcaacgtggtcgtggtcaggctgaactgcttcttgccgccgtgggcacggacctcgtgcaccgcgcttgccacggtgtcatcggcgatggcgtcgtcccgcaccacgccaagggcgtaggcgtccggatgcgcgcgtatcacctcgtcatgctcgtcgaccacgatggaggccagcggcagtatggacagcaacgtgttcgtcgcgtcgtccaaagtatcatcattgttgcgatcgtcaccatggcgatgtgtcagattgcgccaccacgtgcctacggattcaaacatgtcttcattctcgcacaccctgacgttccccgatgaatggtcgtggcgcgattttcgtgaacgcagggtgaacgtgccggtgaacattggcggaacaacacgtccgtcacgtgcgaatccgccacttccctaatacacttgggagaggttatatccgaacccgatattgacatacgtgaagcatttgaaaggcaagcatatgcgcgttatcttcaatgaagagctcaaggcagtagccgatgacctcgaccgcatggcgcaagacgttcgcaaggcaatcaatggtgccggcgacgcgttgctgaaccagaatcttgaagccgcccaggccgtcatcgacggcgacatcgaaatcgatgccctcgaatccagcgtcatcgaccagtgcgtgaagctgctggccaagcagaacccggtggccaccgatctgcgcgtggtcgtctccaccctgcgtctggccgcgacgttcgagcgcatgggcgatctggcccgtcacatcgccgaagcggcccgccgcacctatcctgcttccccgctgccggccgatgcccagccgctgttcgccgaaatgcaggcgttccttgacaatgtggccgaccaggtggtttccatgcttaccgaccgcgacaccaagaccgccgagcagatcattctcaacgacgacaagctcgacgccctgcacaagaagaccttcgaactggcccagtccgaggattggaagggcaccaaccagcagctcatcgacgtggtcctgatcggccgcttcatggagcgtctcggcgatcacgccgtttccgcggcccgccgcgtgatgttcatcgtctccggtttcgacccgtccaaggagccgacccgcgacgaaggcaccgacatcgactgagggttcctcacctcttcttgcattttccttgacgagatgggtggtttccgtttggaagccatccatctcgcttatatgtggcagatgacctcggccaaaaacatcataagggggtaaaaatcccgcccccgaacatccttttccaaaagaaatctgccacatataggcaaaatcactttcgcatgcaggcgcaatccgccacctataagcgaaattcctccgatagtcgtaaaaactagacatcgcgtccagttcatgcccgtatacttgtgtcccacgacgcggcacaatagtgcccagcggcatccaaaggaggaagtcatgtactattccaacggcaattacgaagcattcgcccggccaaagaagcccgaggggatcgatagcaagaacgcctacatcatcggcacgggtcttgcagcgctgtccgccgcctgctatctggtgcgtgacgcgcagatgcccggcgaccacatccacgtattcgagaaggacccggttccgggcggtgcctgcgatggcgcgaacattcctggcgtcggctatgtgatgcgtggcggacgcgagatggacaaccatttcgaggtgatgtgggatctgttccgttccattccgtccatcgagacggatggagtgtccgtattggacgaatactactggctcaacaaggaggatccgaactattcgctatgccgctccactaaggcgcgtggcgtggacggcggcacgaacggcaagttcgcgctgtccgacaaggcgtcgatggagatcatgaagctgttcttcacaccgaacgaggaactatacggcaagaagatctccgacttcttcgacgatgaggtgttcgatacgaacttctggatgtactggcgcaccatgttcgccttcgagaactggcatagcgcgttggagatgaagctgtacatccgccgctacatccaccatatcggcggactgccggacttcagcgcgttgcggttcacccgctacaaccagtacgagtcgatgattctgccgatgatcaagtatctggaaggcttcggcgtgcagttccactacaacgtgaaggtggagaacgtcgatttcgcgattggcggcggcatgggtcccgtacgccagcgcaccggcactgggcaggatacgattttgaggaagcaggccgaatacggcgcgtatccgcgcaatccgttcagctcgccgaccaagaagttggccacacgcatcgacctgaccgaggcggatggcacgacccgcagcatcgatttgggtgaaaacgatctggtgttcatcaccaatggcggctgcgtagagaactcctcgatgggttcgcagaccgagccggccgcgtgggctccggacatcaagcccggcggtggatgggacatgtggcgtcgcatcgcggcgcaggatccgagcttcggtcatccggacgtgttctgctccgacccggagcattcgaagtggatgagcgccaccgtcaccacgttggacgacgagattccgccgtacatccagaagatctgcaagcgcgacccgttctccggacgtgtggtgaccggcggcatcgtcaccgttgaggattccaattggctgatgagctggacgctgaatcgccagcagcagttccgagaccagccgaaggaccagctgtgcgtatgggtgtatggtctgttccccgacaagcccggcaactatgtgaagaagccgatgcaggattgcaccggcgaggagatctgcgaggaatggctgtaccacatgggcgtgccgaccgacaagatcgccgacttggcgaagaaccacgccaacacggttccggtgatgatgccgtacatcgatgcgttcttcatgccgcgttccgccggcgaccgccccgatgtggtgccggatggcgcggtgaatttcgcgttcctcggccaattcgcggagacgccgcgcgacacgattttcaccaccgaatattcgatgcgcaccggcatggaggccgtgtacacgctgtgcgacgtggaccgcggcgtgccggaggtgtggggttcggtctacgacgtgcgcaacctgctcaacgccacggtgatgctgcgagacggcaaaccaatcaccgatatgaagctcaaccccatcgaaaggggcgtgttgaaacagatcgtgaagaagctggattccactgatattccgacattgctcaaggaatacggcgtgatctgacgttcttgcgattccgttttgtccgccttgcctgcaccgcacggcacccgccgagccgcgcaggcaaggcgacatcagcaaaacgcagatacaacgtgaaaaagacttaccgacaaaggcgccggcaataacgaaaggtgggaacctacggtatgcaggttcccaccttttcgtatgtgtttcgtgcgatcagccgcgactattcacgcacccaatcgcaacaaactcacttctggccctgagcggcgacggcggcagcgccggcagcggcggcttccggatccaggtactcgccacgcggcttgatcggcttgaagttctcgtccagctcgtacagcagcggcattgcggtcgggatgttgaccttggcgatctcctcttcggagaggttgtccagcatcttcacgatggcgcgcagggagttgccgtgagcggcgatcagaacggtcttgccagccttcagctccggctcgatgtcggacttgaagtacggctcaacgcgcttgaccacgtcggccaggcactcggcttccggaaccggatcgccggtgtagcgcggatcgttgttctgcgcgtactcgtcgttcggatcgatctccggcggcggtgtggcgtaggaacgacgccacagcatgaacttctcgtcaccgtactcctgacggatctcggtcttgttcttgccctgcagggcgccgtagtgacgctcgttcagacgccagctgcgcttgaccggaatccacaggcgatcggcctcgtccagcgccacgttggcggtgttgatggcgcgacgcagcatcgaggtgaagacgatgtcaggcaggacgttcttctccttgagcaggcggccaccgttcttggcttcctcgacaccctgctcggtcagcgggacgtcgacccagccggtgaactgattggttttattccatgcgctctgtccgtgacggagcagtactagtttgtaagtcatgcttgcaagtctaccgcttggcacacccaaaacaagccgtttccgacgattgacgccccacgttttgcaacaattttcatttcgttgcactgtcgttgcagcgctaggcaaacaccacgcaacacacgtacgttgcggcgagcgccagtgaggagaacgtgcacagcggcagcgcctcgccgtatttttttcttgcgatcgcgacggcggcggcagcgcacatcgcgcacgtgaccgccagtattgcgattgtcggcatcgcaggcgtcgacagcagcagtatataagcggcgagcaacagcacggcgacggacagcagcgcaatcgcaaaaaccgtgccgttgcgccggcccaaagcggtcatccatgtgtgcttgccgtgcgtgcggtcggtttcgacgtcgcgtaggttgttgacgcacaggaccgcggcggcgatgaggccgacgttggcgccgccgagcatgccttcggtcgagattgtgccggccagggcgaacatcgtgccgcaggcggcgacgagcccgaaaaagatgaaaacgaatatctcacccaaatagtggtagccataggggtgtttgccgccgacgtagcaccagccggccacgagacaggcgataccgaccaggatgaaccaccagtagccggtcaatgtaacgacagccagaccgcacaggcaggcgatcagcgcgttgattccggccgcggcaagtactttctttggactcacgccggacgcgacgagacgggcggggccatgctggggctgcgatgccggaagcatttccggagtcgaagtcgattccgcggatggtgtttttgcaaatgaccgtgcggaatcgacggcacgcccctcgtcggtgccacgtatgccgtcggaatagtcgttcgcgaaattcgcggcgacctgcaggaacaacgccacgcaaccgcacagtaccgccaccaagatgaaccagcctgcggaacgctggcattcgccgaccagcgagccgaatttcaattcgctcaagtcatgctgcccgccgaagaacggacacggctcatgccatatatcgccaccctgcgagtagagaaacacgccccgccacgacagcgcggccccgataaccactggggcgatcgccagcggcagggttttcaggcgagcgccgcgaatccaagtcgatatttccatgaatctcatgttagatgttgggcgtgcgagagtgtgcgagggtatgcaaaagggcgctcccgtattgggaacgccctttagtaattgctcttttattttttaaggatggctccggcggcacggaagcccacagggcttcctcttcggccgcctcgcgtgaagccgaatattgaactgaggctccgcctcagttcagcggcttcacaagcgggaaggtgatggtctcgcggatggtggcgccggtcagtgcgatgagcagtcggtcgatgcccattcccatgccgcctgccggaggcatgcccacgccgagggcctccaggaagtcctcgtcgatgtcgcaggcctcctcgtcgccggcgagcgcgtccttggcctgggccacgaagcgttcgcgctgcacgaccgggtcgttgagctcggagtagccggtggccagttcgaagccgcgcacgtacagatcccacttctcgaccacgccggccttggaacggtggcccttgaccagcggggaggtctcgaccgggaagtcgcgcacgaaggtcggctcgtacagcttgtcctcgtagaagtgctcccacaggtgttcgacgagcttgccgtggttctccacgtcgtcgcgttccacgccgagcttgtcggcgatctcgcccaggtgctccacggaggtgccggggttgtccggaccgccgttcggcacgatttcctcgcccagggcctcggaaagggagtcgtacatgctgatggtcttccattcgccgccgaaatcgtattcggtgccgtccagcagcgtcaccttgtggctgccgaacacgtccatggcggtgtcctgcacgagctgcttgacgagcgcgccgatggtgtcgtagttgccgtaggcctggtatgcctcgaccatggtgaattccggggcgtgggtggcgtcgacgccctcgttgcggaagtcgcggttgatttcgaacacgcggtcgatgccaccgacgaggcaacgcttcaggaacagttccggcgcgatgcgcaggtacaggtccaagtcgaaggcgttcatatgcgtggtgaacggacgggccgcggcgccgccgtgcacggtctgcagcatcggggtctcgacctcgaggaagtcatggtcggcgaaggtcttgcgcagggaggcgacggccttggaacggttgcgcaccatgttgcggatcttctcgtccgcgatcatgccgatgtacggcttgcgggtgcgagtgtcctcgttcaggtccttgtgcagcgccggcagcggctgcagcgccttggcggcgattgcccattcggtggcgaacacggacagttcgccggtcttggaggcgatcactcggcccttgatgaacaggtggtcgcccaagtcgaccagctgcttgaactgcttcagagagtcggcgccaatctccttcttggagatcatgccctggatcttggtgccatcgccggcggacagctgcacgaagcacaggccgcccgcgttgcgcaggaacagcacacggccggcgatgccgaccacgtcctcggtctcgtcgcccgcttcgagcttgccgtcgtacttggcgcggacctcttcgatggtggcggtgacgtcgagggtcaccgggtacggctgaatgccttccttgagcatcatggcgcgcttggccacacgcatctgcacctgctccgggtgggccagcgggccgaattccttgttggacgggtccacggcctcgtccaaagtggcgccgtcgttgatcttggcgcgaatcgcagcatcctgctgcagcagcatttcggcgcgttccaccgtggtcatagtggggaccgcagcctcgtcctcattctggttttcttgggattcattggtctcagtcataagccaacagtgtaccgagaagccactacacaacacgcgacacgccgtatttgcaagcaccgcgcaatcgtgtaacataaccaactgttgccaaacgggctgtagcgcagcttggtagcgcgcttcgttcgggacgaagaggccgcgggttcaaatcccgccagcccgacaactaaggcggaacttcggttccgcctttttctttgcctttccatcaaaccgatgcttggcaccgtctcaccgtcggtttcgcgggaatcgcaatatcgaaccgacggctggaggacgctcagcgtcggtttggcggaaaggtgcggcgaaaccgacgggtttccacatatccacaggtggattgtggaggggattattgcgattttcccctgatttcgtattgttttacggcacgggagcattggctcgcggcgcaggaattgcgatcgttccgcggattccccatgattccgtgttttccgcgccacgcacgccgaatacgactagagtggcgtaccgtgcgaagcattgtgaaacgaattctcgtcacctgcgcggcgactaccgcgctggcgcttcttctgaccatggtcctatgcgcgctcggcaatgcgatggcgccgaaatggcaggtcgagccgttcacggaccatatcacgctcaccacgaccaataccgctatccaggccgttgacccggccacaggtgccgtgctcaaaaccccgcaggagggcgcgtaccgcaccaaggaaacgcatatcacggtcgcgttggacggcggcaaaaccgtgaatgccatcgttcgcgagccgctcgacgcgccggcagatcgtcccgcatgcctgttcctgcacggttcgggcaccggcaaatcgtcggaggcgttcggcgacgtggcgaacgcgatggcgtcggccggcatcaccactctcgtgccggacaagcggctcgacaactacaccatgctgcaccgcgactacgtgtccagcgcgcacgactatgcgaaatcgctggaaatcctgagaaaatggccgggcgtgagcagatcggaaacctgcatctacgccgaatcggaaggcacatggatcgccaccgtgctgacgcaacagcatccggatcttgccttcgccatcctcacctctcccccggtcgtttcgggccgtcagcagatgacgctcgcagccaccaattatctgaccgccgcgggcgcacccgatgccgtcaagcagcttattccgcgcatcaccagccttggcacacaacgcatgggactcgcctatgcggatttcgacgcggccaaataccgcagatcgctcaccatgccgctactcatcaactatggcgtcaaggacacagccatgccggtcgaacagggcgcgcggctgctgatcaaagccgcaaaccaggctggcaatacgaatgtgacgctgcggtattatgacgcgaaccattagcttcgaaccggttcgaatcagacggttccgggactgccgttggaaccgcattacacgcacgatctggaggattggatcaacgcggtgacgagcggcacgggtgcgaacggctgggcaacgccgatgatcgccggaacgcagccgaatcagacggtcacggcaccgctgaagaccccgcccgcgctggtgaagtcgatgggtgtgattatcggcgcaatcgcggtttgcctgctctgcgcgctgctggcgatgtgcggcgcgccaattctgctcatcgccggctgggtgcgcgagcgccgtgcgtcacggcgggtatcgcacgattcggcttcgacggaaccggcggagccaacggattcgacttcaatgttttcaacggatgcgaccacaccgacaggtccgtccacacaaccgaatgcggcacgtccaatcgcaataaccgaccatcgattcccggtcggcatgcgcgtcgcactggcgctcaacaccctccttgccgtcggcacgaccggcgtgttcctggcgtatctggtcaccgtcatcattgatgcgatctcgttgaccgacaattcggcggtgcttgccaagaactggcatgccatcgtcatgctcacatggctgaaccttgtcgcgttcgcctggctgttggcggaaatcatcgtggacgcgtgccgtcgtcatgctaggaatcgcgcgattgcaagcatagatgacgatgcggatatgaataatggccacgatgccgcagccggaagccgatgcgatataggaaaagatggaaaagcatgcatcggatccggccatgtcatcgtggccacgtgtgtggtggtgtcggcggcgctatcgttggcgctgctggctttctggggactgttctgctgactggcgttcccgtcggcgcagacgcaccgcggcgacgacggcccagaccacggaaatgatgagcagcagcgcgccgagaccgccgaccacgtagaagaacagcgtcgagggattcggcatccaccgccatgcgccgatgggcagcaggcacagcatggacatcaggccgatcaggcagaagaacacgcccagcacgatggttccggtgcttggtccggacgggcggattaccagctcgccgtccgttttgccgatgcgcacttgcttggaggggtcgaccggctcggctgatttggctggatcagccgatttgacggaaccggtcggacgtgccgaacggcccgcaaagcttccgcgcatgtcttgtccggaggtttccagcgattcggcctcgtcctgcgattcgaacttcctctgcgcttccggaccgccgtcgaacggcttctggaacgattcggtcttcgcctcgcccggatcgtcgacggccggcagggtttccgtgggctcgtccgagacctccgcgattcccatgacgtcggccaacggcacttcacgggttttctcgtcactcatttcgtttcctttccgctggcgcttttcccgacgttctttccatcgacgctgccatgcgattggccgcccgtcgttcccactggcagcttgctgtcggacgtgtactgcatggtgacactgccgccgaccgttccatcgacgttgacatacagatccggttcctccggagccttgtccgaatcgatcgacggccaataccacttgttctcgtagatcgttttgaatgccttgtcgagatccgtgccggcgtataccgaatcctgcgaatcgttctccgtatccgaaccggcatcgcccgcatcatcatcgccggaatcgtcgaaatcggtggtgccgttgagcgccggaacgcccttgttcacgccatgatggccgagtcccgaatcatcgttctcatcgagggacaggcccatgaagcccgtgccgttgaagaacgtaatcccgtccggccctcctatgtaatccgtgacgttggtgtagccgtcgtccggatcgctgaccgaccactggcatccgtccggcagcgtgaccaccacctgggcgttcaccaccaccagattcagcttccctgtcggacatgagctttcgccgtacgtgccgtcgttgagcttgaccttgtgcttgccatgcgctgccggatatccgctcaaatcgatgtcgagcacatcgttggcgtagttcttgccgaccaccaccagtccctgttcgtatcgtttcatctgggcgtcgctggtgtcgctccatgtcacgatgccggagaccgtcgtgcggtggtagtcattcgacatcatccaatcacggctttcccatgccaccgcactcgtgcagaacgtcatcaccacggccatgaacgccgcgcaccatgccagcggatgcaggccgccggtgcgacggcccatgcaaccaagcacgacgatcaccacgccgattcccaggcagatgccgccgcagcacagtgtggcgagacgcagcacgcgcaaggcgtaatcccaatcaaccggcatcgtaatggcgtaccagccagatccggcgatcgccagcaatgccaagccaagcgtcaccagtaccagcagcggtccggctggcttgcggcgggcgcgtttcgactgcggcgccgccaccgtcggcggagcggtgaaggtcggcggcacattggccgtggcaaacgctgcaggcgggttcaccggctgctgaaacgtctggtatggcgattggacgggacgcgcgtaccgctggtagccggaaggcgcgggacacgtcggctgcggcatcggctggcctggcgtgccgggcatgtttgcagtggtggccgtgttcgtggacatcggctgcggcatatattgcgattgcgcaggccgcaccggctgtcccggctgaacgggctgagcaggctgcccaggccacgatccgccctgctgcggcggctgccagctcgccgcatacgactggcggttcaccagcagccagaacaccagcacggccacgccgaacgccagccatccggcgccgggcaggcacagcgccaccgcggcgcataccagcgcgcccgcgcagttccaatcccaatggccgttgaccagctcctcgcacaggatccggccatccgtctcgtccggtagcaggaaccaggccaatgcgtagaacgccgctccggcgccgaacagtagcgaggtgagaatcaccagcgcgcggaccagggtggcgttccatcccaagcggcgcgccacgccgtcgcacacgcctgcgatccaccggttgcggccgcgcgtgatccggctggagcggatccatgcgaagaatcgattgccgcgattcggctgcagctgatacatcggcggccgtggctgcgattgcggttcagcagcctgttcacgacacactcaaggccgttcggccaagcttacggtcgtgaacaggacgcccgccctcccactcgtttttttgttatgttgcgttgggttgtggctacttttcgcaataaaaaagaggaagaagggaggggaagggtcagcggaaggcgccgcggaggtatggcggctggtagggggcttcctcgaccggcacgtccagtttgtgggcggcacggagcggccaatacgggtcgcgcagggcggcgcggccgatttccacggcgtcggcggcgcccgacttcagaatcttcttcgcctgcttcggcttggtgatgagcccgactgcggtggtgggaatgcccgcgcgactgcgcacctgttcggcgaacggcacttggtagtcgggcttcaccggaatggtcacgtcgggaatcaatccgccggtggacacgtcgatcaggtccacgccgtgggccttcagaatcttagccagttcgacggtctggtcaaggtcccaaccgcctgcggcccaatcggtggcggagacgcgcaccagcaccggcatggtgtcgggcacgacggaacgaatcgcatccacgacttcgaccagcatgcggacgctattgtcgaacgatccgccgtactcgtcgtcacgctcgttgatgagcgggtcgaggaactgcgacagcaggtagccatgcgcggcatggacttccaccgcgtcgaagccgatgttcatggcacgccaggcggcgtcgcggaactggtccacgatggtgtggatctcatcgacgctcagcgcgcgcggacgagccagggaaccgtatgcgttggcgcttgggcaaaccgtccgccatccgccttgctcctccggcacgctctgtccatcgaaaccgatcgcgtggcagccggtggaacccttgcgtccggcgtggttgagctgcaccgccatcgtggcacccactgccttcgcgtcggccacgatccaacgccatgcgtccatctgtccgtcatcccacaatcccagatcgcacggcgaaatgcggcctcccggcgcgacggcggtcgcttccatgatgatcatgccgaagccgcccatcgcgcgcgaaacgtaatgctggtagtggaatggcgtgggcttgccgtcctgcgccaatgcggaatacgtgtccattggcggcagccagatgcggttgcgcacggtgacgccacgcaacgtcatcggatcgaacggtttgaccgtcttgttctgcttgccgttcttcttgtcttcgctcattgtcatctctcttatgaatcgttggtatcgcctgaatcgtcgatatccgcaccgcgttcccacgcgacgggcatggtaccgattgcattgtaagcagaacgcccgccggttggggcgggcgttcatggactgttcactttgccatgcgatttacgctccagcggcgtaaacagtcagcgcaggcagccagtgcggccagtcggcacgtatagccgacaatcgcaactattgatgctgctggtcactttgctgctcagcaggctgttgctgcgattgctgctgctggccttggttggtctgctgctggctttgctgctgactgttctgctggcgctggtattggtactggttgtatgttctggtggcgcccttcgaaaccgtgtacttgtcggcaccctttccgtaatcgttgtcgatcggcgcgttgatggcggcaagatacgtgttcatgaactgcttccacgccggcgttgcgatgtacatgccgtaccaggacgggcggtacacgccgttgatggtcttgttgtcgaaggtgttgttgatcgggtcctgcgcgtcggcgaccgcgacgaacgccgcgacctggttcggcacgaaacctgcggtggtcatcaccgtgttctcgttggtaccggtcttggcgaaggtcttgcgattgttgtcaagctgcgtggtcgacgcttcgccgccaggctgcacgacaccttggttcagcgcgtaggacacggtctgcgcgatgtccgggtcgatggcctgatggcagttcgcggacggcactttcaccttgctgccgctgcggtcggtcaccttggtgatggcgatcggagtgcattccacgccgttggcgcccatggtggcgtacacgttggccatggtcaacggcgacgcctgcaccgtaccgatggtcattggcggctggaacgagttagcggagtagatgtcggacgcgttggagatggcgttgtggtagcccatctccttggccgcgtcggcgatcgcgcacaggccgatgttcgacgccatcgaggcctgcgtggtgttgtgcgacttgatcagaccctgcagcgggctttccggagaggtggtgccgccgccggaattctgcaccctccacgggccgacgaaaccgtagccgttgcagttgaacttcgacgtgtcgtagacggtggatgtgacgagcgactcgttgatggagtggcctttctgcatccacgccaccatgttgatgggcttccaggtggagccgacgttgaagcccataccgccgccgtcctcctggtcgaccatgtagttcatggaggtcttggtctcgtccgttcgggcgtcatccgtggcatcgtaggttcggttgatgccgaacgacaggatttcaccggtgcccggcttcacggccgctatcatcacttcgaatccggacgggtctgtggccggcacggtgctgttcgccgcctgcatggccgcgttgttggcgttgcggtcgagcgtggtgacgatcttcagaccgccttccttcagcagcttctcgcgagcctcgtcgtccttgccgaacgccttgttcttcaggatctggttgaccacgtacgagcagaagaagccggtgttttcaatggccgactggcatccggagctcacgtcctgcaggttcagcgtgtccttcaacggcgtgttgatggcgtctttgaattccttttcggaggtgatgtagccctggtcgtgcatcagctgcagcacgatgttgcgctgatgttcggcttccttctggttggcttccacggaaggatcgaagttctgcggattcttggtgattgccgcgatggtcgccgcctgggtcacgttcagttccgaagcggagacgttgaagtagcgtttggcggccatttccacgccgcacaggttgttgcggccgaactgcgcgatgttgaggtagccctgcaggatctcggctttggagtatttcttttcgatctgcaccgagatcagcatttcacgtagcttgcgtgccacggtgtcttccgtcgcatggtattcggcgatcggatcgtcgtcttcacgggcttgggtggacagcacgttcttgacgtactgctgcgtcagcgtggaaccgccctgctggtcgccgcctctgacgtaggtttggaagaacgctcggaacacgccctgcacgtccacgccggtatgttcgaagaagcgcttgtcttcacgggccacgacggcctgctgcatggctttggagattttcttcagcggcacgacctcgcggttctgcgtatagaattccgcgaaagcggtcttgccgtcgttgaaatacatcgtcgagcgttgcgggagcgaggtcacatcgaaatcgatgccttcgaccgcaagggacggaatgacggctttggccgcgttattggcggcgaacacagcgggcataaagaaaatactcgtcacaacgccgccgcccacgcataacgtgatgtatgcgattaccaatgcgagcacacgttgaacggtaagggtcttcttcttgggcatgacgcccattctaaagtggcgggtctactaaacacatgcccgtcaacgcatgtgccggaagccgtcacgggtttctcacaaaacagacaatttcttaggaaaagttggaaatcagccgaaaaccagccgaatgtcatcgtcttgatcggcgaatcagcatgcccggctggtagatgatgatggaccggccttccctggcgatccatccgcggttagcgaaatccatcaacgccttgttcaccgtttcgcgtgaggatccgacgagctgcgccatctcctcctgtgtcagatcgtgcggcaccttcaggccggcttcgaccggttcgccgaatcgtgatgccagattgagcagtgttttggcgagtcgtccgggaacgtccatgaacaccagatcgcagatgcgttcgttgttgctgcgcatgcggtgcgccaatacctgcagcatgtccacggccacgcgcggatgttcgtcgagccagtcgaacagcgcgtcatgttccagccagaccacacgcgtgccgttggtcatcgccaccgccgaagcggtacgcggtccgccatgcggatcgaacaccggaatctcgcccagcacttcgccgtacgcgtggatgctcagcagctgcacgcgcttgtcggaggattgtctggtcagtttgacgcggccttcctccagcagatacatgcgatggtcggtgtctccctcgcggaagatgaaatcgcccttgtcgtattcggcatgctgcagatacggcagcagttcccgggcttcttcggacgaaacctgcttgaacagcgcggtgtgcagcaacgtctcacgctcatcgtcgaaaccaccaaaaccattgattccgttggttccattcggggtgaccatcgacgtgcctccgttccgacgtgcttctgcgttttccgttgtcgacatccatgccaacgctcgttaagtcgggcaccatcgaccattcgggctacattgtaactcgaacggcggcgtcgaccagtcgcgccactacctcgtctcggcccatgccggtttgagagcgcatgggatcgacatgttttgccgctgatttcaccgctttgtcggacattttctctcgtgagatgttcaacacgcgggtcatcttttccgcgtcgatgtcgtaggcgagcgtgacgtggtgcagaatcgcgccgggtccgccgtgggtgggcgcgaaccggcgttgcgcggcgccgccgagtttgccgtattgtgtggcgatgtcgttgagtccggcgaatcgtacattgaggccgagggcgcgtaacgcttcgacgagccagtagtcgcagagtttgtaggattcctcgacgctcatgccgtgggcgaagtcgagtggcgcgtacagcgagtaggtgatggtgttgcctggttcgatgaacatcgctcccccgccggtgcagcggcggactatgcggaatccttcgtcttgcgcggtgtgcacgttgacttcgtcttcgagcgactggaatctgccgatgaccacggccggctcggcccattcccagaaacgcagggtgggttcgcgggttccggcagccacttcgcgtgcccattcgacgtcgaggtccatttgttcctgcggtttgcgggggtcgtcgtgcacgatgttcggtttgagtgcgtgccagcgtcgcgcgtattccgcccaattgccggtttcggcgatttcgccggttccaacggttccagcgttttcgtcgctttccgcggttccagcgttttcaatgttttttgcgatttccgcggtttctgcggtttccattgggctggtatgccgccgaatgcgcaggtcgtcgcgtggttccactttcgtaacatcattaccgccgataccggcaatgccatcggcgccatcgatgccgtcaatcgcacgttgaaaggcgatggcgatgccacgcgcgcccatgccgacgatgcgcacgtccggatggtgcagcatcgtccgttcgacggcggcggtcacgtcacgttcggaaaccatcgaaccgctgaggcaacgggccgcgcactgttccagcgcacattccatggaatgcaagagattccgcgttccggcatcgtccccgtcgaggaagaaatcgccgtcgatatggcattcgataacagtcgatgatgcagccggcccagcgtatggaaccgttttcacggcattcgtatgagccgaatcaatatagtccgaatcggcgtaatccgaatcggcgtaatccgaatcggcatgagaaagccggacagtcactccaacgagtttgccgcccggctgtttgtaaagtcctcgagtcatcaatcctgcagttcaacgccttgagcgtcacggtgccattgcgagccgtagtgggagcacagaatcaggatgccttccaccagtccccagatgcctgcgacggctgggccgatgatgagaatccagccgatgacggtcagcagcagctgtgccacggccttgccggtgttgcccaagtagaagttgtgcacgccgaagcagcccaggaagatgccaagcagaccggctgccagtttcgacttctgggcgtatccggccggtgcgacgggctggccgtatgccggctgctgcgcgtaggcgggctgggtgtaggcggattggttgtaagacggggccgcgtagccttgctgtccgtagttcgcttggttgtaatccggctgggcgtaagcgttgttggggtcatacgccggggctgccggctgaccgtacgacggctgcgcagattgggcaggctgggacggctggccatactgaccgtactggttgtacgatgcggcgttcggatcatataccggagcagcgggcgtggccggctgagccggctgggtatagacgggagccgtaccgtatgccggggccggagtcgccggctgaccgtatgacggctgagcggtttgggccgactgtgcggtctggccatactggctgtatgcggaagcgttcggatcgtacgccggaacggcaggctcggccggctgagcgggctgagtgtatgcggcggagttctgatcgtatgcgggggtttccggctgcgactccggatggttcatctgcgcatcgttctgttgtggaatgtacggttggttgtagtcggcctgggctgcgttatccgacgttggattgttgacttgaccggcaccattgaaatcggcgttgttatcactcatgcctcaacaatatcccaaagtttgcccatttccacccgattccaccttaggtggcccctgaaaaatccccgaatatgcgaagacgcccgccgattcgggaaaaacccttttcggtgggcgtctcaaaggatgggacggaagtcggaatcagccgatttctcggcttttcgaaccgtcacatgccgtcacatatctttatatgtcgtctcacatgcgcgccagaatgtcgcgaccgacctcgtcggtggaacgcgtggtggagccgagctcctcgatgtcggcttccacggcggtatggatcttcttggcggcatcgtcgaaaccgagatgctcgagtagcatggcggcggacaggatggccgcggtcgggttggccttgttctggccggcgatgtccggagcggaaccgtggatcggctcgaacatggacggatactcgttggacgcgttgatgcatcccgaagcggagtagccgacgccaccgaccacggcaccggcctcgtcggtgatgatgtcgccgaagaggttgtcggtcaggatcacgtcgaagcgggacgggttggacgccaggaagatggtggtcgcgtcgatgtgcaggtagtcgtgggagaccttcgggtattcctcggccaccttgtcgacgatgcgctgccacatgtcgccggcgttgaccagcacgttcttcttgtgcacaagggtcacatgcttcctgcgcttcatggccagttggaaggcgtaacgcaccacgcgctccacaccgtaggcggtgttgatggagacttcggtggccacctcgttcggggtgccacggcgcaccgcgccgccggcaccgcagtacaggccttcggtgccttcacgcacgaccacgaagtcgatgtcacccgggttggcaagcggcgaggtaacgcccttgtacagcttggacggacgcaggttcacgtactggtccaggtcgaagcggagcttgagcagcaggccgcgttccagaatgcccgccttgatgcgcggatcgccgacggcacccagcaggatggcgtcggtcttcttgatgcgctcctcttcctcttccggaagaatcgcgccgtcgcgcaggtaacgctcggcaccaagatcgaaattctcgtaatcgaattcggcgacgccctcggccgccttctccagagccttctgggcccacggagtcacttccttgccaatgccatcgcctggaatgacggcgatggtgtacttctttgcagaatcactcatagcacgcgactctagtcaacggaccagcacgtggacacgtaacgctcaactagtggacattccttgccgcgttcatgtgcgaatacggtttcacccggcttcaaacgccacgaacaacgaacgatccaatgatccggacgcaacaatccatacaccgtacatgaaaaagggggccgacctgaaggccgaccccacccttggattccaacactcagcgaacgctcttgggtttcacataatcctcggcgacggaaccgaaattcgtgcccgagaatttgcccgattgtctcactatggcatcgaacgctgccaacccgttcaatcccgtgtaggaatcggaatacgcgccggaatagctcgtcgaagatcccgtcgaaccggacgattccggcttcactaccctgttctcccgcgaccacaacgcatacagcgtgccgtcgcgatcgatgggcatcaacgatttcccggacgaatcaaaggagaccacgctgactgcgagcgcgtcgtctttcaccgtgctccacccttcgaaggtgtagccgtcaagctgaggctcgttggcgatgtccgccgtgggcgagaccagcgaatcaccgtcgtagactttccgctcggcgtacagggtcttcgcatccttgccggcgggcgcatgccctccgttcagatcgaaggttatggtccactggtgcgcggtgcgcacccactgcgcggtcagggtgatgtcgccggtcaccttcgagccgaaatcgtagcttttgccgtcatactgccagccggtgaaccggcagtcgtcgcgtgtcggcgacggatcaggcgcaacggccactcctccatcgtccacggtctggctgttcacggcactgccgccggccgtgtcgaaggtgaccgtccatgtcttgacccacttggcatacaaggtcatgtcggcggttacggcggtgccagcatcatagtccgtcttccgctgttcgtcgctggtcaatcctgcgaaacgatatccaccgcgggaaggagcggaatcggggatcgtaagcttctccccttccttgacgaacaacgtcatatcctgcggcaggtccgacgaataatcgtcgccgtcattcaaatgaatggtgacggtatggtacgtcgcgcccgcatcatcccacttggcatacagcgtgataccgccggtgacgggcatgccgaaaccgtacggcgtggtgccggccgcatccgtggtccagccgacgaacgtgtatccgtcacgggtcggtgtggcaggttgcgtcgcgtaaccaccgtacgcaacctgttgcgcatcgaccgcgctgccgccttgcgagtcgaaggtcacggcgtacatgttcggcgtccacttcgcatacaaggtcacatcatcgttcaccgcagccgtgaaatcgtattcgctacccgaagtgtcggcgctagtataccatcccgcgaacgcgtatcccacgcgctcaggattttccggtcgtacggccgatttccctgtttgcacctgttgtgcggcgatctcgctgccgccttggacgtcgaaggtcacggttttcgcttccgtccactgcgcatacaacgttatcggcgcgctcaccgtggtggcgaaatcatactcatgttcaccggccacgtccgtggtccacttcgagaacacgtagccgtcgcgagtaggcgtttcgggaacgctcgcagtgcctccgatggcgaccgcctgtgcgggaacgctgctgccgccttgggtgtcgaaggttattccggccacgttcaccggatgcgtgtacacggtcggatccccgctgacgatccagaattccgcgacgccgttttccacgtttcccgcggtcatgctgatcacggattccggaatctcgcgatcgttgtcgtcgcagtccttgccggtccatgatgagccaccgttgcgaatgatgaaccatgggttgcgcacgcctttggctatctggctcagcgtgtattccgcgacctcgccgaattcgtcatgggaggtaaattcctgggattcgccgctggtgctttccgcataccaagaccacagatcccagcctttccacgcgtcggattccatgctgtattcctgataattgccgtcgggacggtaataatgcagtttgatggtcaggtttttcggatttttgatgtcattcggctgcggtgtcgccgagggagacgctttttccgaggatcggtcggaagcggtatcgggttgcgcgccgtccacccacgcttcgatggcaccgctcacatgcgcgtcaccgaatttggcgagtttccacacgctcgcctcatattgttcgacggttcccgcggacgctccagtcgcatcggcaccatccacgattctgaaatgcactgttgccagatcgccgtccagttcgccgctggctttcctgccgtattgcgttggcgtgctttcgaatggaatatacgtggcgctttccatgtcgtcgccgttccacaccttcacgccggatgcgttctcaccgacgccggagacggaacggaagttgacggtcactttggttttcgccgcatggttgcgcgtgtagggcacgcccgtctgctgccggtgcccgctgacgttgatcatagtggcgccgacctgtgccgtatattccgttccccgcttgcccccgttccagtccgtggagtcagattccccggattgtgtggatgcgaaatggtatttcaccgcgcttaggttggccccttccggcagatcggccttataccagcctgccgcattcgtggaatcggctacatcgaccgcgctcatcgcaatgctaccgctgccgttgtcggacgtgtaacgcacatacacctgcccgtcccacgattcgtcgggcttgtagtagatggtgagggttttgtcacctatcagcgaactgttcggcgaatccttgtattgcggagcgtaggtgccgctaggttccgtggtttccgtccacgcgcccttgaccgcaccggcatagatggcaatggcgcttcgtttgccgatggtcgctttggcgtgaccgccgctgacggtcacggtttgcgagcaggtgcgggaagcgtacacgttgcagtattccccgtccggcaacgatgtcgtatagtcgacgtcatgctcctgcagggtgttgttcaatgcgagcagacccttgcttttcccgttggcgtcaaccctttcgaaggcgatgtcgttggatccggattcctgccagttgcttacgctggtgccgttcacggcattatggaatttgatcatgcctcggattgacgtccaccgctgttggcagttccaatcgccatatttcatctgcgttgggtccttttgcgtggcgcacacgccgtccatgctgattttcggcacggtggtgtcagtcgaatccttgacgccgtcatcatattgggtgctttcattgaatgcgtagtctgaaaggatcttcggatgcccgtagtcgtacccgagcatgaacgcgttggcgagctcgtatcgggcgccggaaacgggtttaagcgtttccgaaccgcgtgcggtatcccagttggacacgaatacggtggcattatcggcgtcgtcgagcagatcgctggtgatgttcttcaaattggtgatggatccgttgaaatccttcaacaatgagtacgcgtacgagaattcggtgacctgtccgttcttttcgtatcgttccggcgcgaatttttcggattctccattatggtagatgacttcctgcgaccatgggaagcttcgttcgtccgtaatgcccgctttggtcatgaacttgcgtttgatggatgcgatgtcgttgggatccatatgttttgcggagtcgatgcggaatccgcgtacgccgtcttcccataggtgcgccaagtattcggcttggatgttttgcacgcggtcgctgccggtgttgatgtcccacatggtcgacagtcggcagttccacacttcgtcggcgttggtgtagtcggagatgttgtctgacacgttcgacttgcaggtgtggaagtcgccgctgggaaggccgtattggtggttgttgccgctttcctcatactggtagatgccgatgcccgggtatcgtccgtatgatccgttgtattcggttccggccacgccatactggtcgtcaacccatgagacgtcatgaccggtggtgtggttgagcaccatgtcggccacgatttgcacgccggccgtgttgcactgcttgatcatgtttttgaattcgtcttccgtgccgaaacgcgagtcgagtttgtagctgaccggctggtagacggtccaccattgcgtgccttggatggattcctgcggcggggagacctgcacgtatttcacgccttccggaccataggttttcgtgcattcgtcgccaatcgtctcccatgattgctggaatgcgatcatggtcacgtcagtggctgccggattggtcggatcgttggcgagggctgtcgcctgcacgcttagtccggccatagaaagcgccaagccgatcaccgcggccacgatgcgccgtaccgttcgcacaccgccgcgacgtacagccgcgtgcctgatcatatggctcttcattcgactcccccgtttcatcgcatgacgcttcatcgtgcgcttccttccctattgcgcctgctgagtgcatagcagatgccgagcatgctgagcaacgtgaccgtcaggaacacgccgtaatgccagccttgcccgcccgtagacggcaatacgatggcgatggtgttggtgatggtggagattccggttttttggtcatcgttgatgaccggctggcagtagccgtccactccgctgatcgcttcgcccttttcgttggtttccttcaccgtgtacaccttgttttcatctaggtcggtgaacgtgtattgccagttgttgccgtcgctcaacgccaccgtcttgccggtggattggccattcgcatacaacgtcgcatataccgctttcggacgtttgccgctgtcgccgtagtccttccacactttatgcacgctgtggctgatacgccccggcgtgtaggtgttggtcagcgtgtacgcccaggattccgcattccggttgttcttgccggccgtgtccgtcttatcggatccttccgtttcatcggtcccggaagcggtatcgccgtcggccggaatgaccttgccgccggtgagtgtcggcgtgtagttcttcacggcctcttcggtcaccgaatactggatctccttgcccttgtagtatttgggcaggttcgtgaaggtgtaggtccacgtgtccgcgctcacctcttgcgaagtggttgcttcgcttgttccgtcagccccgttgacgttggccgtggtggcctgcgtcgctttggcgttcttcgaggtcagcaccatgcagctcacaccccatggattcgtgccatccgtcgcgccggtgtccttgcactcgctgttgtattgcggtgagggccatccgggcagcgtctggttcttcgcatcggtccacacgctggaaagcacccagatcgtggccttgtcgcccggccgtttcacattgctgggcgcatcggtgtcatcccacgtcttgtccacgctcaatgtcgtggtttcgggcgtatgcgtgttggtcacatcgaacgcgcaggatttgaccgtgctcgtcaccgcacagcgtgtttccgtaccgccggcgagcgtcacgtcgcttgccgtatagccatctacggattcctcggttaccgtatacgtgtacggattgttgtacaggttctgcttgggaagaccttcgaacgtccacgattgcgtgttgctgccgttggttcgcacggtttgcaccaccaattgttcggtcacgtcttccgtttcgtcggtactgccgctcttcggctgtttgctggttccccaaatatggaaggtcagcgtcttcggccgtttgccatcgttgtcatcctgatcgttccacgttttgttcaccgtgatgcttgccgtttccggctcccgaatgttcaataccgtgaattcggcgccgtcgatgtacggacgtttgatcacggaaacgcggtattccttacctgtgagctcttgggtcagttcctcgtcaaccgtgtagttgtacctgttgccgtccgcatcatatcggggcagatcggtccacgtgtacgtccagtcgctggtgttcttgttgtccaacgtccgcgtgtacttcgcatcttgcagctgcttggagttgcgcagcaggtggaatgtcaccgatgtcggacgctccgaatagttatggtcggaccagattttgcgcacgcgcaccatggtcgtatccacgcgatcctcgacgcggatggtgttgccatccaccagcttgccgtccacgtatgcttcgccgcgggaaatggtgaagttgaccgcgttcgccttttcatacccgaccggcgccttggtttcggtgagcttgtagacgccgtcctgcagctggaattgtttcggcagtccgccgccgctggtccaggtgatctcgtcgatcgtcttgccttcgaaagttttgccggttatggagaattccgctccagccagctcggcaccgccgccgaccttggttttggagaacaggatgccgcttttgcccggcttgtctttcatgacgacggtattggaatcctgcttcttaccgtcgatggtcacgctgccgtcgagcccgacgctgaatacgatgtcatccgcggtttcatagccgtccggcgccaccttttcacgcagggtgtaggtgccgggtagcagggtgagttcgccgggttcgccgcctttgctggtccaggtgatctcgtcgatcgccttgccatccaaggtggtgccggtgatgctcatctgcgcgccgtcaatattggtgatgccactggtgagactgtttttattgacggtcacctgatgcgtccggtactggtcggtcatcacgatggtattgtcctgcacgtcggcatatgtgtcatcggtttgcttgatctgcacgctgagcttgccggtgacggcgtcgctcacgactctgaattcgaccggacccgctaccagataaccatccggcgccttgtcttcgatcaaggcgtaggtgccgggcttgagcttgatgctcttcgacttatcccgctcacttggccagggctgcgtttcgaattcggtgccatcattcagcgtaccgatgaggcgcatggtggcacctgcgatctccgtacccttgaggtcctgcttggagaaccacacctcctcgttttcggggtggtgcgtgttagtgatgacgaaaccttgggtttgcgagccggtgatgtgcgtggtgtagccgctcaccgtatcttcgcgtatggtatacacgatcttcttgccatcctcgtagacgggcagattggtgaacgccttgtcgttctgccagtttccaaccgcatcgagtgtcacgctttgatcggtttcctctccgtttttcaacagatgcacggttacgctgccagggcgcttctggtcctggttgtcggcgtcgtcccatacttttttaacgccgatcgacgtggtttcgggcgtgtgcgtgttggtgcattgttcggtggcagccgaaccgtcggtgttgtattgcacgtcagcgcattgcgagtcgtacccgcccggcgtcgtggtttcgacggccatgtaggccgcggttttgccgtcgactttcaccggcagtcccgtccattgcactttatcgttcttgtcgggattgagtatgcggctttgcccgtcgactttcgtataatcggcatcgccgtcggtcttgcggtacaaatcgaagatgacggatgcgcgtttgccgtcctggttgttattgtcgtcccatgttttcgtaacagtcaacgacgtggttttcggtgcgtcctccgcctgcacgtgaccgatgccgtcgctaccggtcacatttttgccgtcgacggtgatggtgccgtcttcgccgaccagaatgatgatcggatccatgacttggtatccgtccggtgcgttggcttcggtcagcttgtaccgtccgggcaggagttcgagcgttttcgtctcgctgccggaggtggtccatgtccaatcggattccacctgcgacgatccgacacgagtcagctgcatggtggcaccgtcgacgggtacaccggcattcgccgcatccacctttgtgaattgcaccttgaacttcgttttgtggtcgttgctgcagttccaacggtagttgcccaatgtggtcgtcttgccgtcgctgtctttggctacggcgacgatcaatttgccgctttgcccgtctacggtaacggttttgttgtcgtatcgtccgtcgtatgcaccggcagcggtctgcgcgtcatgtccggggaatatcacatagagcggagcggatttctcgtattgcgaatcagtgctgccgggcactttgccgtccggacctgtcagctcggtgaccttatatacggtgtcgtagtccagctgcagtcggtcggacagtccgttggatgctcctgtggtcagctgcttggtgatttctttgccaaccgtaccattgcaggtgccgtcggcatcggccgtagacgacacgaagttgcatccggtgacgctttccactttgaaggtggcgctgcccgccggcttgccgagatcgccatccgcgtacttgtagatctgcagtgtgctctggtcgtatttcatgccgcctttgctctgctgcacggttccggtgattgtgttctgcgaggttccgccgttgttctcatacccggcgagcacgattttgttgccgcccagcgatccgaagctttcgcctggtttgagctgcaccgcggccgtgtaggtgatggtgcatgcacgggcgtcgggaatggagaacactagttcgcgggtctgcggattgtatgaccatgttgcaccgttgatggcggttccattgtcggagtccatgatcgacacgctgttggcgttgaggtcgagtgcctgacccatggtgtcggtcagagtgaggttgttgcctttgttaagcgtgtccgcattcgggttgactttgaccgtgtagttcacgttcggcgcggtcgtggcatcgtatttgccgtttttgtcaagaagtttcggcttgctcgcgcccactgtggcggaagcgtcgcctccggcgctgccatcaatgtcgatgtgcgccttgttctcataatttccccaatcaggtgcggtgatcgggtcgatgctcgtctcatacacgatgagcacaccagccgaggtcttcgcctggctgaacgccggggtacccttggctatggtgaaggtcaccgtgccgtcgccgttgtctttggcgctcactccggacagcatttttgtggtgctggaagcgtcgaagatcttcaacgatttcgcgtcgtaccgcgtgtggacgggcaacgtatcggtcaccacgatgttttcggcgtccgacatcacgtcatgcactttgatgcgccagcggatcacgcctttggagttggcggtgtagccgtacccgtattggtcccaatactggttggcgtcttccttgccgagcacgtcgccgcgatgctggtgtttcgccgtggaggttttgttcaatgccgaagctcggttccacacggtttcgtcggtcacaccgtcgttgacggtggactggtattgcacgtacaccgtagtgcctttgggcaatgatgcgaacacgatggtgaatcccctatcggtggcctctgtcgtgtatccgcccgcgtattgctgcgtcagggcggcgtcggtgtacactttaatgctgtctttcaccaaggtttgcttggatcccagatccttgccgctgtcgtccacatccagcttgtcggtcagttcggcgttggtgaggtcttccaaggctttcatgctggtcacccacgtcaggttcttcgcttcggatgccggcgacgtgcatgttttcttcagttcgaccgcgtccgtgccgagttgaggttcggccgtggctgttttgccggttccatcctgaggttttacggtgacttcgttcttgtatttctggtgttcgccgcttccttcgaccggcacgtttttcgcttcggtccaatactggatttggaaatggtcgtagccgccggagggcagggtcacggtgcctgctacgagatcgctccagctaagtttgatgtaatgctgcggattgtacgggtcgtcgtccgtatatgcgccgggcgagccggtcggacacacggatttccagtcgccgctgttgtagcagctgagcaccagatctccggtcggttccttgaggttgttcttgtcgagcagatctttgacggtggctccgtcgacggattggccttcgccagcgccgatggtgatgttccaagtgaagccttgcgtgccattttcgtcttttgctgcggttgcgcttttgttcacataccagtcgctgtagttgaaccagatggagttgctggtttccttcttgttgacgtcttcgttgctggagtaggtcaccttgtttttgttttcggtgacattgctgcaattgccggcctcgcggcatgccttgatgacgctgtctttgtcggcgttcaccgagtagcgcacgtatagtttctcaccgtcgcccatggagccgatggtgacgttgaaattatggtcgtcggttttggaggattgccatgcgcccgtgtattcgttcttgcagtcggcgtcggtgtagatgtgcacggatccgtccacgaaggtcagcaggccgcccatggtgtcgtccatggtcacgccggtgttcgtgcctgtagaggtcacttccaaaacgaaatcgtaggtggatgcgtcggaagtggagattgccgggcgtttgaccacgttgacgctgtgtttgccctccacgttcacggtgatggtgccatatccggggaaggtaaagctggtatcgccgccagccgaaccaccggttttgttcgaggtgatggttccgtcagtggtcacgaacgcttcgatgttggaccccgccgattcgccgcgggtgtaggtggccaccattttgtcgccgtcgatggtgtagtagccgaccacgtcgccaccgttgtagatcgggtatttctcgttcgatttgtattccagattgctgggaaggtcgtagacgaaggtgtcgccctcgttgattttgacgtcgttcggcactttccaatgcagttcggtgcggatctgatcaccgtagttgacttgcatgccggaaatgtacggcttccacgtcttgcctccgtcggaactgatttcgaaggaggtgtcgtccttgtcaacccaaccgagatcgctgatattgtattcctcagcatacgcatgaacgggcccgatcaatacgcatgccagcatggttgccaatgtcaccagcatggcggcaaacgttttcatataacgccctgccggtaactccttgcgcttatgcataatccccccgtttcaacaactaaggtggcggcagccactaccttgccccagctaccgccacctttacgcaatcacagtgccacgacatcaacatcaacgaatgaaacacaaaatttgtgatcattttgttgcaaaaacacgccgaaaagtgttgcatcaaacgtttgacaatgaggttacccccaccgaagcgaaaacaagaatcgccgcaaaagtcctgcaacagattatgcaaattttctgaaacagaagccacttttgcaattgtttgcaaaagtggctccgccacactttctcacccgaacacgggatcaactggtgacgcccatcaccgacaagcaccaagcgttctcataggagacttcctcccattgcttgtaccgcccggacgtacccccatggccggcttccacctcgattttcgccacggcgtccacaccggcatgctgcagccgggccagccatttcatcggctccacatacagcacgcgggtgtcgttcatggatgtggtaatgaaaattttcggaaaaacggcagttctttcgtcattttcactatctggcgcattctcgtatggcgtgtacgacttcatatacgcgtacacatccgcgtcgtgcagcggatcgccccactcgtcccattcggtgacggtcagcggcagcgaaggatcaaggatcgaggtcagcgcgtccacgaacggcacatccgcctccacgcccgcatagcattccggagccatgttggcgaccgcccccatcaataggccgcccgccgagccgccgttcgccaccgtacgcagcggcgaggccagtccggcacgttgcagcgcgcgcgtggcgtcgatgaaatcctcaaacgaatgcttcttgttgagcaggtgcccctgctcgtaccaggcgcgtcccatttcgccgccgccgcggatgtgcggcacagcgtacagcacgccgcggtcgagcatgctgatgcgtgacaccgcgaatcccggatcggaactgatctcgtacgcgccgtagccggtgatgaacatggcggaatcgcaggtcggcacgtcacgccgccataccagcgagacggggatgcgttcgccgtcgcgcgcggtgacccacacccggcgttccatgtagtcgcgcggatcgaaaccacccagcacggtggcgcgtttgagcagacggtcctcgccggtgtccggatcgtagtcatgcagctcgccggggcgcgtgtagctggcgaacgagtagcgcatgcgcggcgcgtcatacgaggggttgccaccaacgccgatcgaatacaggcggcgcgtctcccccggcatgcggtcggcggtggcgccgtccgacgacgtcatcgcccgacgcgagacgccatgcacggccgatcccttgccttgcgcggcggcggccgcgtccagtttgccccagatctcggcgcgttcctcgttgatctcgtccacggattcgtcgacgtcccaatcgtcctccagcgcgtgcggcaccagttcggtgaaccgccatggccggccggccaggaaatcctcggcggcggcctgcttcgtcatcaccgcgatgtgcggcaggctttccgcgcggtactgcaatgcgacgaaatgccgatggatcgagataccctcgatgcccaagccgtgcgcgccctgcagaatggcgggattgcagggatttgaatacggggtgccgattggcatggaggaggcgccggggtccacatcgtcgccgtgctcgcaaccgtagggcgatccgaccgccacgcgcacgccttcgcccagccggcatggaggctcgtgcgtccgcatatcgatcacgtcaatctcgaaattcggattcaacgcgttgtggtacaccacggcgagcggaatatcctcgccatgctcccccgcgccttcgaagcaggcgaagctcacatcgtattccacgtcggtttcgcgcggaatgaacgcccggaacgagccctctggggtgtccaccggcagcatcagcacctcggtggtggttttcgacccggtgccaatcacgatgttccgttcgtcgaaggacagtccgatgcccacccagaagcgttcatccgcctcgcggtagacctccacgtcatccgcgacgggggtgccgacacggtggcgcatcaccgcgtacggacgccatgcgccgtcgagcagcacgtagaacacccattgcgcgtccggcgtgaagcaggcgccgccgatgccctcgaaccgttcctccaactcgtcgccggtctcaagatcgcggatgcggaaatcgtagcgttcgtcgccgctcgtgtcggtgccgtacagcatccagcggccgtccttggagatgtccacgccgccgacacggaagaaatcatggccttgcgcctcggcgttcgtatcgaacaccacctgttcgccgtcgagtggcacaccggcctccaccgtcggcggatcccaatcgtcggcgctgcgaacgggcacgcggcattgcgtggcgtactgcttgccttgcgtggtgcgggtgaaataccagtagccgtccatgcgcgtcggcacggacatgtcggtttcctgcacatgcgatttgaattcctcgaacaacgttttgcgcaacgatgcgagcggtgccatgcgctgttcgcagtagcggttctccgccgccacatagtcgcgcacatcctgcgatcccttgtcgcgcagccattcgtagttatcgatgaacgtatcgccgtggaaggtgcgctcctttggcacccgcttcgcttccggcaccgccagtccattctggtgttcgtcgtgcgcgttcgtcgcttccttcacgttcatggtgttttccataccccgaaattcactcatgcacgcgattatactgacgacccacccaaacttgtgtcggccgtcagtcgccgttttgcgcggcgcgcaggtacggcagcatggttttcatgatgttcgatccggtcgttcccgtgaataccggcacgtcggtgaccggcatcggctgcgtggccacgcgcccggcgacggaaccgaaattgccggtcacttcgcgcggggacagctgccggatgccgatcgccagcacacgccccgggtagcggcgtgcgattgtggcgtatgtggtcggatccttctgcccgtcgtcgccgatcagaatgaacttcatatctggaaaatcggccatgagctgttcggcgtattcaagcttgtgctgcacgcccgacggaatgaaggttttcggcctcgggtcaaggtcgcgcagcagcagcggaccttccggaaaaccgtggttcgtaatgaaatggcggatcgagctttccacattccatggcgaagtggacaggtagaagaacggcgcgtccgggaacatgtccgcgatgcggttgaacagcaggttcatgctggccaccggcacttttttgcgcggattaagcagcagcagattgtaggcggccttcatcagacgcggcgcctgcgtgaccatgatggtgtcgtccacgtcggagatcacgcccactttggtgccgctgggaatggtgaaaagattggcgttgaccggcttgcggctgcgcactttgtacgagacgttgtggatgcccggttcgagcgaatgctcggcgacgaggtcgaggtagccggcatcgtcggatgccgcgaattcgctggaaatatcaggattgctgtcgatcgcgtcgtatacttccgacgcacccacctgcactgtttcgatgggcacgtcatcgatggcgatccgcactttggtatgcggggacggcaccatcagcatgccacggatgccgcgaatcaggcggccggcctgccgtttgaacgggccgtatacggtacggcagatcagtcgggagtaatgttcggtgccgtagccgacgtagggttcgacacatggataccagtcgagcgaccgtaccaatgcggtcgagaatttcagccagacactgaatgctttggtgatcgtgcggcggaacagcctggtcagcggcggtttgacttcaagacgctcatgtctggaggccgcgtcgaaggtggtgaccaccttgcgtgccggaatcggcacggtgggcatgtcatcgcaagaatcgtccatccgctcccccatacgctgctgttcgcgctgctggtcgtgctgcggcgcacgctgcggcgggaactgcggcaacggctgaatttcactcatatgcccactatagaggtcgcgttcgaacaaacagtaacgccaccgagaaaatcagggaactttcagggccccgcaaggcacttcccataaaaaggctgcggccggcgggtacgatgcgcgaccgtaagcccggccgaacggccttgagtgtgccgcgcatcgcacccgccggccgcagccgtaattaaaactagacgtccgtgctattcagtcagccacaatcttggcatactcgtcagcgctaagcaggtcaggctcgtcatcctcaagctcgatcttgaaaatccagccctcgccgtacggatcgtccgtcacaatgctcggatcgtccgcagcctcgttgttgacgtagcggatggtgccagccaccggcgagaccagcgcggtgaccgccttggaggattcgaattccgccacttcgtcgccagcttcgacctgcgtgccgacttcaggcaaatcgatgtacacgagttcgccgaactgttcggtggcgtattcggtgacgcccaccatggcgggttcaacggaggaatccacccacacgtgctcgtcggagtattcgaggtgctcgggcacgtcgaggttcactttgctatcgtttgcttcgctcatgccgcccattgtacggcgtatgcgaacgccgcgcacccgcgccacgcgtaacgggtcagcgcaccggtccggatggcatggcgccgactacctgcacgatggtgccttccgggcagttgtcgtagatccacttggaatcggcttcgtacatgttcacgcagccgtgggagccgtagtgcgccgggtcgccgtgggcgatgccgtaattgttccagcttgccgtgtggaagccttcgccgccgtagaagtagcttacccacttcacacccttggacaggtagcgcgagccgtcgtcgttcaggccggtcatgtcctggatctgatacttgaggtagatgtagaaggtgcccaggtcggtttcgtgcttgccggtggtgcccgtgcacaccgggaaggtcttgacggcctcgtcgttgtgatacacggtggcggtttgcgcggtgcggtccaccacgatgcggtattcgctcttcttctgcacggttttgaagttctgcacgtcgccgtccaccggaatggtggcgccttggccgtttttgagcgcttcgccgatcttcggtgcgagcgcttccatgttcttgaccttcacgccgttcacgcctttgacgatggtggccagcactttgccgctgttgtcgacggcgtcttcctggtcgaccgcgtcctggttgagctgggctgggacctgctgctgcacgtagttggtgatggcgttgtcatcgtaggacagcgaaagcgtgccgtgttcgaggtcggcgtcggttttcagccatgaggccacgacttcggctggaatctggaaggtcttgccttgtccgttgtccagcacgatcggcgcgttcagtcgcgcgtttgcctggtcggccacgttttgggcttcaggcagtgcgaccggcacgtcgatggtttcgtacgtgatcgtcacgctgccgctgtgccccgggttcgcgatggctttggcgaccgtgtcgatcacgttgtccaccttcggggacctgccgccgcggccttccactgcgacgaaggcgcgcgcgttggcatcgtacgatgcggtggacggtaccgcgcggtcggtgtcctgcacgaatttgtcggtgacgaacgtcctgagggccagcttgttggacttggcgttcagcggcacgttcttcttgacgaacgggttgacttcgttgatgtattcgagtgcgccgttggtctggtgcttggcggcgagcagttccgtgaccgtcttgtcgacgttgtagctcacgccgaggtcgctcaggctgccggaagcgttgttgccgttgccgtccttgatgttcacggtggtgttcttcacggcggccgtcaccgtgtttttcagctggtcggcggtctgtccggccacactggttccgccgaaggtcacgcccggcgcggccttgtcttggaagtaccagcgtgcggtgaagaagccggcgatcgcggcgaccaccagtacggcgagcacgattccggtgatgatcagcggcagtttgcgtttcttggccacgacggcttctccttcgaccggcatggtgagcacgggaatggcgggagcgggcgtggatgagggcatgtcaccggtaggaatggcaccagtgggaacagctccgttggggacagttccggcaggcgtggtttcggcggcaccggccgtcgggaatgactggaacggctgggtctggtccgatgcgaaattcaacggcggcatggtctcggtggcggcgttggacacgtcgtcctgttcggacacatcggccacgtcggcgagattgatcgtatcgccgttctcaccagactgcggcggcacggcattcaccccttcaaacgagatgccggcgaaactgttgtccgtatcgttctgcccacttctatcagacatgtatgtggtttcctcattcactctcttcacggtacataccatgcagcatgatacgcagacgagtgcccaaacgaatacctaaacaagctcccccggcaaccaccccgaagacaggctcagccgataccaccttttaatggcaggtcttgtcacggcaggtcgtggccgagccattcctcaatcatgtagcgtgcgatcgtggctttgcccggagcctccatacgtcccgaaaccagttcgctcatgtattcgtcgcgtgtgacccaacgcgcctgcaacgtttcctcgccgtccacgtgcacgtcggtggtgaccgccacgcctttgaacgccatcatgagagacgaggggaacggccacggctgggagccgaggtatttgagttcgcctatttcgatgccgacttcctctttggcttcgcgccggcatgcgtgctccaggttttcgccagcctccacgaatccggccgaaaccgagtacaggccgttgttgcgccatgcgctgttgtgctgcagcagcagacggtcatcatggtcaacgatcgcggtgatcaccgctggctcgattcgggggaacagcaagcgattgccatcctcatcgttcgtgcagtgctgagcccagccgccgagcgccggttcgacgggcgcgccgcacgtcgggcagtgacgctgccgggcgtgccacatgctgagcgagatggcggaggttgcctgtccggcttcgcgtgcgctggcgtggggcgcgaatccgcgcaggtccacccagtcgaatcgggttgccgcgctttccagcagcgatttcgcgttttcctgcgattcatgcgccggcacttcggcgaacgcgtcgtccgctcccccgctgcgagccgtcgcagccgtaatcgtcgtatcgttcggctggacgtgcgtcacgtccacggcgacgacgtgctcgcccaatcgtccgccgtacgagccgaggaatatcgcgagcgccgatgggtgcgattcgagttccgcggcaacgtacgcgcccggcagttgggcgaggcgcattttcacgttggcgtagtcggcgatggcgccttggccgtgcggcacggccactttgccgtctttgacgaggatgactttcgttgccggttccgccaggactttggcgaacaggtcgggttcgccgcgtcgtgccacttcgtagtcgatgtctccttgggcgagtggcaggaacggcagggtctgcgtcaatgccagtggtgagaacacgctcatggttgtgttgcctctttcatgcgtgttatatacggaatatattcgttatacatacgtagtacatatttcgtatatacgttttatatattttctctatatcttgtcgatacgccggatggtctgccacagataatcgtcgcagccggctcagccgactcgcttcaccagttccagcaacgcggcggccacctggtcggggtgttcgtacgcgctgaagtggccgcagtcgtcgatcaccgtcatcgtcacgtcggttttcgtcatcgcgtcggcgaccggcttcatcactgccggcgggctggacgggtccttgtcgccgcagattactgcgactggcacgttgatgttcggcagcacgtcgttcaggtcgggacggccagcggccatgcgttcgcgccaggcgatgccgtcggcgggctgttcgttgatccacgtttcgaactgcctgcagtaggcgtccgactgtttcacggtggagtcggcttccgacggcacggcgaatcccatgaccggctcgtgtgtgccggtcgtttcgcagtcggtggcgattgcgacgcgcttcaatcgcatgtcggcggagtcggcgtcggctttcgtgtcgcacagggcgagcgccgccaccgcttccggatgcaggcgttggatgtcgagaatcaggtagccgcccatcgacaggcccacccagatggctttgctgtagccggcggcgtgcagcaggtccacgtacgcgtccgccatgcggtccagtccgtatgggaacgcgccgtcggcgtccttgccgccgctgtcttcgtcggacggaatcggcccttcgccggcgccgggcatgtccggagcccagatcgcaaatggtttcacgccttgtttcacagcttggtcgcgtaaagccgccgcgcactcgtcccacatgcggtggtccaccgggaagccgtgcacgagcaccaccggcgtggtttcggtatcgttgccgccgtccgtatatatgttgttgttcagttcaatcgccatatttttttctaatcctcccctatctgcctgttcgcctagtttgcttggcttttgccccgcttgcgcggcttgtcctacttgccggtccatgcgagcgcctgccgcacgatggtgccgtaaccattggccatctgcccgacgaaggtgtcgagcatgtctccggacgggtcgacccattccacatcgagcgtctcgtcctgcggcttgcaatcgccggcgatcggcaccacgtagcacagcgcgatcgcatgttggcgtggatcgtaatagtcggacaggccgggtgtcgggaagaattcggccacggtgaacggctgcaggctgatcggcagctgcggcagggcgatatcgcccaaatcttttgcgacgttgcgcgccaccgcttcacgcaacgattcgtgatagagcacacgtccggcgatcaatgtgcgttcgataccgccgtcgtcggtgacgcgcagcagcgagccgatttgcgccaccctgccgagatcgtcggtgcgcaccggcacgaccacgacgtacggaatcggtatttcgcggcgcatgcggttgatttcgtccgatgggagccatcccggagggttgcccattccgcggatgaaatcctccggcgtaatgtcgtcgaattccccgcgatggcggttggcgtcgaaatcgccctcgtcgggcacttcatcattcatcactggcatggttccattatcacgcacggcatgtgaatgtcacgtgcttccgattcttcccatagcgcaatcgggtgcggcagtgtgtttgcgtggcgtgcggctatatacttttcgcaaacggtctttcgcaatattgcgcagcattgcacgatattgtttttgaaatcggcttatagcgtaagccggggaatggggaacgcatatggcaacgcatgcagtcacttcgcaggatttcaaccaggtcgtcgaatccaatgatctggtgttcgtggatttctgggccacgtggtgcggtccgtgccgtgcattcggcccaacgttcgagaaggcaagcgaggcgaatccggacgtctatttcgcgaaggtggatatcgatcagaatcccgatctggccgccgcggccaaggttcaggcagtgccgacgctgatggtcgtcaagaagcagcagatcatcttccaacaggccggcgcgttgcgcgcttccgatttggatgatctgatcagccaggccaaggcgttggatatggatgcggccgcttccgatggggacaccgcttccagcggagacgccaaagtgaaaacgccaagtagtcagtcggaacgatgattcggcccgtcgcctgcgcgttgcatacgttatcttcaagttccttggggtgcggtagactatatgcagttgcgcgcattccggcggaaccctagcggttgtgcgccgtgccctaggcacggaatccgccgaggaattgtacccgatgtaggagcagaatggctagccataagaaacatgcccaaccaactacgtttgccttgccgggcaaatctcagatggtgaagattgtcgcaacggttgcggcagtggggctgttggccactggcggcatcgtgtcgcataatctgtacgccaccgcggagaagtctcctgccaagcaggtcaccgcgtattccgtcaccgacagcatcgaagcctcccgtggcaacgcccgtgaggcgctttccggagatacttcgtacgtcaccgtgaagatcaacggcaagacccgcgtggttcccggcatgcatttcaccgacgtgaagtccgtgcttgacgcgggcgacatcacccttgatacggaagacaccgtttccccgtctttggatacgaaggtgaacgagaacaccgtcatcaagatcgaacgtgccggcgcttccgttgaggtgtctgatacggatatcgcattcaacacggtcaagaaggagacctccagcctgccgaagggccaggagaaggtcgagaccgaaggcgcgaacggtgttatggagaccacgaacctcgtcaccaagtccggcggcaaggtcatgtcttccaatatgatcagctctttcgtgaagaaggctccgaccgacaaggtgatcctcgtcggcaccggctcctcgtccacgccgtccgcggccgcagcgtcgatcggcaccaccgtgccggctggcgaaatgcagcagtgggctcacgattatctgctgtccagcggctattccgaggccgatttcaccgccaccgtgtacatcatttctcatgagtccggttggaatgtcgcagccacgaacccaagctccggcgcgtacggcctgccgcaggcgctgcccggttcgaagatggtgagcgccggtgccgattgggccaccaactaccagacccagcttaagtggttctggggctactgcgcacagcgctacggctccatccagggcgcctacacctactggctcgccaaccactgctactgagttttagtttttcagacaggagaggctccgcacacattgtgcggagcctctcctgtcttatatgcctcttttatatttcatatggaaagatgcaggccattcatggcgttacggttgtttatgcacgcaattcattcatcgcttttatcgcggcccttttggccatcttacgcgtgagcgaacggccagacgcaacgggctcgaaaaagccgtcatgctctttttccaccgtccatcgccaaccaagcacgttattttgagcgactcgaatactgaacgaagatcctacacgcccactacctgccacattcattccaagctccctttttcaggatttttgggctggatgcatacgtactcattattagcgtttatggacgtttcgcacagcctatcaagatactgcatatagtacagcactcacatcaagagaactgtactatatgcgatttttcaagctgagcggaatattgttcacttactcgccatctttggccgtatgatgcgaacctttgcggggaccacgcttgccggatacaccctttgcagcatcggccacagcaaaaatgacaaccttctcatccgggtaggactcgccatccatggcgaaataggcgatctggtcgtctgcgaccggcgggaaagtgaaatacttctgcaccgctaccagcacatcggtggtacgcacggtcacggaagaagcctttcccgcagcgtcagagtcgacgccatcggccttgcttcgcttggtcttgcagaacttgatgacgttctcgtctttggcgtcgcatgcctggactgcgatcttcttctgcttgtcattcaccagcaatttcacgtatgccgggcatccgagcgcttcggtcacgcctttggaaaagcgaacggatgattccatgaccgtcatggtcatcttattggtggtggtcttttctcccactgcttcaaatccgtcaagaacagacatgccaaccccttgaaaatataggatattaattacatgcaatataatacaacaattcgcataaatacacccttttttcactaataaaatagggggtatctccgctttccagcagaaataccccctgtatttccaagaatatagcaataattcatagacttcattgaacaagttttcattgagatgaattcaaggaaaacatgcaccaataatgtcgagaattaccgcgccatatttcaatagttgtatttcacatcattggtcattttgccacacggcgtctgatcgagcttcatatcagccgtggccttgtcagacacggtcacgtcgaactcgtacgtcacgctcttgccaggtgcgatgtacgccatactggagttcaatggcttgccgtccatggtggcattgctacggtcacgcacatcaccggtcacggcgattgatccaatcgaaccacctgcaggcgcgtaaatcagcacacgctgcgcggatgtgccactcggcgccacgggcacgccaccaacgcccttctgctcaccaccgagaatgtaactcgtgcaggtagccatttccgtggaagtcatacggttggtcagcgtgtacttcacgtggtaggtcttgtcccctgtcttggtcacttcgctggtacggtcgatataccaacccatcttcgaaggattctgctcgctgatgtaaatgcccgtttccggattggtctcgctctcaggcgcattcttggcgagtccagcaccttggaagtacttcgcttcgtcatcgtggaacgtgtaggcgtagaagtggcggttctcggccaaatcaccgatgctttgcgccaccttcatcatcttgtccacagtcatgttgccaaaagcgccatccatcaccgttttggcaatgtactcgaagtattcgtcctgctgtgccacaggaacgtctttgtagatggtgttgagcatgtattcggcggtgttctcgccggtaagcacagtgccgttggacaaagtgacaggtccgttgatctccaccattttctggatgaacaccggatccacggaaatcaaaccgtcgatgttgcaagcatattgcgaacgctgccatgaagcgttgagcatttccgcgttgcgggaaacatccggcaccgcgaaggtgtctcgcacgtcgaaggagaaacccaacggcctgttgaataccgcatgttcctcagcggtgccgttgttgccattgacgaactcaccattcgggtggaagtcccccaccgcgattttgccatgatccgcagtcatggtgccgagagagccaaccaagccgccgccggaacgtgtttcggatgtggtctgtgccgccagcaagtatgtgcgggcaccgttctggccgaggaaggaaggcagcatgtgagtggcgttgctgacctgtccaaccaaatcggcgatattgtcaagctggtccttgccctgctgataggctttcttcaccatgccgattttcggctcggcaagactgttatactgcttgttctgctgctgcacctgctggttgagcttgtcgaagttaccttgcgcatcggcgattggctgcagattaagttgcccttccgcaccggaaagattggccccggcaagctgttgcaccgcagtggtcaacgatggcagtgtctgctgtgcaaggttgtccacgacttccgtcatgccttgcacagtggcgatgtcactgccgacgaacggcattttcgcagccacgttccataatgaaccgtgcgcaatctgcttggcctgcgccgtctgctgctgagcctgcgcgatggacgcctgcaacgcggcggcatccttgagctttgcagggtcattgattgcggatagtgaggatatggcttgcgattcgtgtgccttgacgctttttgcctgcttatacagttgcataccgaacactgcggcaatggcgagtagcacgatcagcaccgcaagtacaataagcgtcacattccgtgccgtatgtttttcccgtattgcttgagcatgttgccccatgctttgctcctcaaatcattaagcactcaatttgactattccagcgcattattgtgccacatggcaccccttttttcggccgccaaatgaaatttccctctgttccatcacaagaacagagggaaaatcacagaaaacccacttattggctcagtacgatccacggccagtgaagattaccatcacggttttggcaagaatcgcaagatcgccagcgatggaccaattctcaatgtaggagacatccaaatattcgctttgctcctgtgaaagatccgaccggccggacacctgccacggaccggtgatgcccggcttgaccagcagtcgggcggaatatagggaaccatagcgggccacttcttccggcaatgccgggcgcggaccgaccagagacatatcgcccttgagcacgttgtagaactgcgggaactcatccaaagaagtcttacggatgaagtgacctaccttggtgatacgcggatcatctttcattttgaagatgaaccggtcttcctgcccagtttcctcagcgagtttcttcttcagctcctcagcattggtgaccatggaacggaatttatacattttgaacggcttgccgtgcagtccgatacgggtctgagagaagaacaccggaccgccatcatcaagcttgatggcgatggcgacgccgagaagaatcggagaggaaataatcagcgcgcacagtgagccgatgatgtccagcaaacgcttgattacgttcgcagctcccgtgtactgcggcagggaagccaacagaactggctgttccgtggtgtttcgcagatacaaacggtgaccgctcacatccgccagggagaccgccaaggcaagttccatacccagcgactccaccgcaagagaaagaccatgcaacatttcggaatcacgcgaaagcacgtcagccacatagacttcctgtacaccgaggctttcgcaaatacgtgggaatgccgagttgaaaggaatcaccttaagtttgctggagccttcgatattggcatccggtgtgtatgaggtaaccacataagcgtcttttgaagctggatccgcttcaattgggcatacagcaactggttcgtacccccaattcatgcagttgcgcatggtctgcaaggctttgttgatgccatcggaagatccgatgaccaccgttctgtacttgcaagagcctttgctgcggtgacgatgcaacgcttgacgcatctgccaacgtgcgatgatatccaagaagaaggcgatgactggcgcgataatcaacgcagtacggggcaatgcaagtttgaaaataaatgcaaggctgcagtatgagatgatggtcagcaacgacgcattgatgattttggcatacagctcatagccgtccgccataacatggcggtggtatgtgcccgcgaatgccaagcacagcaaccaaatcaggctgaacagaatgaggaaaagccaaaacggcatcacatcgccgatggcatcgaaagcagcaccgttgattacaaggctgacggtcaacgaaagcagcatcactgccaaatcgatggcgatcaggctggcgacgaaggcgaaacgccaccggggagtcgattcagccttgccgcgcctatgtccttccttttccgcaggaaacggggtattggaaaaagtcatcggctcgaactgcttttgcagacgctgattctgcatggacgcgtatgcctgtcgatgcgcattggacgagacgatatgaatctcttgagtcctcataccttgctcgccgtttggtgcgccggattcaccggtattcacgccttgcatgtatctccctccccttcagctgcatacggcaaacaatttaccacagccccccccccagaaattaagagggacctatgggggtaccattcgctatatccaaatccttctccggtatggcttattcgccagcagtacctgtatctgaatcgccgttatcgccgccgtttgaatcgccgttgccgttgccgttcgaatcgccattaccgtcattcgaatcgccgttaccgccgccgtttgaatcaccgttgccgttgccgttcgaaccaccgttgccgttgccgttcgaatcgccattaccaccggttgagccaccattgttattgccaccggtcgaaccaccgttaccgccggtcgaaccaccaccgttcacaccgtttccagagcccggaccaaattgccacgtatacgtgtagcgccggttcgtagtgccgttattggtattcgaattggtattcgactgggcattggccgcagtttgctccgccacagacttgttcacgccgtcggaagtcgaggaaatcaccttcgaagcgttctgcatggccgtaacatcagtgcttttgccatcgaggagtttttgggcagcgtcaatcgccttggcaagcgcgtcacgtgtcgactcgtccgcaacctggcctgcagaaccgtcaagcaacgtctttgcgtcagcaatggccttctgcaatgcggcagtcgtcttattcacttccaaagcttgcttgctggcgtccacagctgtggctgctgcggtaacggccatggtctgttctttgatattgctgatctgcttgctcatgctacgggcgtgcgcacgcagtgtggtttcggacagcaacaccgaacatccgccgaccgtcttgaggttctgcgccttggtcacggcctgagtaagttggtcgattgtggcggcatccgccacctggtttgccgcagtgccctgcaaactggttgcctgttcgatggcgttttgcagtttttcgttggctttggagtatttggatttcgccttctcacataccaccactgccgcacgctgttctttcgaattgatacgattgcgtaccacgatgacgccggcgatagcaaccgccactgccgcaatcgcagcgacaatggcaataatctttcgcttgtccgcagatggctctttcggcgcgaccggaatggttttcagcggatcatgttccggatcttccgcggccagctcctctaggtcggttatgccatctgatgcatcaaaggcctgagttgcttcggcgtcctgttcatctgtcgaagaaacgaggggtggcaaagtggcggtttcctcggcatcggctggtgcaaccgcatcatcgaaatcgatggtgtcgagcggcatactgggtatatccgcgattgttggcgcagccgaaaccggctgttccgtttgcgcaggtacggaggaagcgatggtacggggctcagcaagcgaagcctcatccgcaccatcggcttcttccgaatcggtaggctgcaatttggggaaggtcagcggaggaatatcccagctggtgtccaccacatcccgagatatgttggacaaaataccgttcatagactgggaatcatcgttctcagttgccatacacccctcattccatggagaagggaaccatcagtgccgcttcttccccttcgcgcgatggctgctgcgcggcgcaccatcctcatagtaatagtaataattggaatgcgtattggtcttcttcggatctgcacgattgaagatgaagccaagtaccggcacctgcgcggtggcgagcgtgtcggccgcctcctgcagggacttcttctcgcacacgttgcggctgaccaccagcagaaggcccttggcccaacggccgaataccgcgccatcgttggacaccgtcaacggggcggtatcaataatcacgtaatcgtattgggtgagcgcctgctccaccatgagcttcatggtttcggaacccagcagcacgccagcgttcgccggcctcttgccgccaggcagaatgtgcaggttcggcttccagtagctctgtaccacgtccttcgggcccatctgtccggacagcacgtgcgccagaccggcggcaccttcaatgcccaagtggtgagcaacggacgggtggcggagatcagcgtcgataagcagtactttcgcaccatcttcagcaagggccaccgcagtgttgatagccatggtggtcttgccttcggacggctgcgcagacgtgatgacaagcagctggcccacgccttcggtgcggtcggtctgcaggaagtcgatattcgtgtgaatacggcggaattcctcggcaatagcgccgttaggctggctcaccagcaccggacgcttatcatcaagcgaagcgtccatcggaacggagccaagggaggatgctcggacgatgccgcgcacgtcggaagtctcttcaaccttggtgttgaggaggtccttgatgagtgcggcgaacacgccgatgatgatgccgagcaccacaccgacagccaaatacagggcagtcttcggcgaagacttagacgtcggaacctgtgccttctgcacgatggaaagcttcaccggggacttatctccggagtacaggtcgctttcaatgacgttcttcagcgattcggcaacggaattggcgatgtccgcggcctgcttcggatctccatccaccacggcaatgttcacgaatgcggtgttggtcggattggtgacggtgacctggccggcaagatccgtcacggtttcgtccagaccgagatcatcgatgaccggcttgagcaccttcgaagtggtggcaagcgttgggtatgaggtgatttggttggaaatgtagctgccgccagtggactgctgggcgatgctttcgccaccatcggaagcgttataggtggccatggtctgggccgtagccgtatacttcgccggagcgaggaaggtataggcgctcacgcctgccactaccaccacgaatgcgatgatcgcggtgaccagatgcttacgaatgattttgaacagatccatcagagtgatgccgtcatccgcttcctcaactaccccttgcggtgcggtaggctgctgcacattagcgttctctacagaagtcactgaacttccccatctcacgttgacaatatcctttccaaggataatcttccccctcgaactattcctcatcccttcatacattgaacacattttttgggaactcaaacagatgggctgtgaaataaggaacattccctgtcgatatcgtgcgcgtacgagacttattggcaatatttggcatattcagtggctgattttgggcgggctgtttctgaccgcaagaaaaagtgccaccggccgaccgtgccaagtgaacaaggccgccaacacctgctgttagcctttcctacgcccaacttaaggcgatttgggagaacgacaaggcaagctggaagaatacgctgtcccgccagcaaggcgtgtacataataaccaataccgataatgggaaactgtatgtgggaatcgccaccggaaggaacggcatatatcagcggtggaaaaactacatagataatggccacgacggcaatacagaactaagcaaacttgtggagcagcaggagaagcgtacgtagagacgcattttccgttacacgcttttggaacattacgattccaccgtgcccaaaaacgtcgtcctcgcccgagaagcctattggaagcaggcactggacacccgcaaacacggatacaacgataattaggccttgccagatatagataccccaagaatttcctcaaatcattggtagtgaccggtacaggctttcatcatcattccgccacgccctgaaagtgacggaatgtatgtgcccagctccccatttcgcttatacgcggcagattccgagagatggaaactcccatttcgcctatatatggcaggtcataacgggcaaaagccactttggggggtacattttccacagtttaatgcgctttatcagagaggaaccaagagtcccagaaacgtcacccatctcgatgaagctggtgatgttttgttgggctatttcaacacaatcatctactacgcaacttctgagaaactgccctaggtccgactgttcaacctgaagaacctctaccagcaagccgttggcaattcttcaaatacttggaatcctgctggcgatctacgcggtccgcatcctgctcgacttcatccgtcaagagccatccgccacccctcgttgaccggcacgtagctaacgtcaatcacggggaacagcgttctagacgcctagatgactgtgagtgatcaaataaaggtgttcggcgttggcacttgtttctgcatactttcccgcacaatgggattagcggcataatattcttgaattgtctttttgctgataatcgtgctgcatggagcggaaggcggcaaatcaccgcgcgcgattttccaagggctctcagcgtgcgtccttatgcttagctcatttcccgtacgagacgacagcaccgcgcacactgcatctatggtttgcttttcttcttcagaaagcgtcttttcacagtcgttcacaggaagctcgccttcacggataaggaattttcccctgtgctgcgcatacagttcacgacatacaggaccgccacgccatgcttggaaatcttcgtcaaaaagaggatgtccacgacgagccaaagattccgcctgcgaatagaacgcgagcttttgtaatttcatagtggtcattgctccacagcgtttaagaatgtacgccgcgacatccaccacagttgccatgtcaatcctcccctcatatatatgaaatctgaaatcagtctagtatagtggatggccatggacgcgccccttactaccatcagcctcggcactatcagtcggaacagagcgaacaatgctgggaaaatattacgtgcaggagcacaatcagtttcgccggaagaataccagctcgctatcgatacagcacaagcttggcgtgatcagcatatcgaagccactcaagagtgtttttcagaggtcttaaagtgctcaaattattttgccgaatccgtctgcacttatcgtctcaaacgaattgcttccatcattcgtaaactgcaacgcgcccaaacccacctgaaattaggcgaattggatgatatcggaggatgccgtctgattttagagaccaataatcaggtccgtcaagcggctgaaattctgaaatctcaaatccctctcaagaaaggcagcggagagaaggactatatcctcaatccgcaaaagtccggataccgatcccgccaccttctgttcaaacctgagactcaaacaggctcttatcaagtggaggtacagattcgaacacagcttcaacattactgggcaacagctgttgaggccgctggagaaatctatggcaccgaatacaaaagccccgaagttcgtagacaggccgtagggcctgaagaccaggaaaggattcaattctttcaaattgtttccagcctattcgctctcgaagagggagccccgcaggttcccggctttgaacgcagccaaaaggaattggtaaaagagcttcagacgcttgaatgctcatcatgcttattggatgatttggcagcgtccacagacagcatcttccctttgaatcctccaacggataaagcggcaacgctgtttctcctcaaactttctcgcgaagatcaactccttgatatcgagtctttccgccaagatcagctttctgaagcattgcaaaaatacggcgatcttgaagaccgaattgaggcagcgaccaataagggaaccgaattcgaatacaacaatgttgtgttggtttacgcccaaaatcatgaacagttaagcattgcctatccaaactattcagctaatgtcagccactttgtggacaaggttggagaatatctgcaatagtgtacgttcagtcaagccgacgtttcgcgatgagaacggtgtctattctgaacgccaataatgttcagcataactggcgacggcatgcagatttattcgacaaaaagcatcaagtagagcagcgtgatgatgctcaatgatgatgtttcatgagggggcgccgataataccggcaatcacgattccgccaagagaaatccgcgcggccgatataaggttagacgcacggattccttaatcatgcagactgtaggatactgaaaggcagatgccgcgagaacctgccaagagataagaaaccacggaaggaaccgacgaattttgttgcacgattccgattttcgtggcaaatttcgaatcgtgcaacatttagggacacagaacgtgccgaagcggccggaagcatgcgtccatagcaagaaaacgcacccaaggcctagcaacgtatgctttgtcataaagcagaacatacgtaacatccggataccatgagatatagggggattaacaatcttcgctataaggtttcacgaaaggcatagtaatggccagagattctcggaactacgaagctcccggaaagttctccaatgtttacagctttcggcttgtctgtatccaagtctgcaatacatctacattttgcaagcccatctcgcagcatacataaccaatataatcagggatatccttttctagatttacgagtaaagattcaagctgctgtaggaattccagataccgtttcttgtccgtgaccagcctcaaatccttaacaagctggaatacagtgatgttcctatcatgaggatgtgcacaatacaatcgctcatcatgagcacatatatttcgaaaatcctttattctccggtatatcttgtcaagctgtatagaagtaatctcttccccatgacggtgagaatccttatataaagcagtaaagctacgcgcaatatttccacggacaacgctaccctgcgcttggaaaaaccaatagatctgaccaatagtgagatcattgcacaatacccaaagcggcacttccccctcatattcctcgagacaatgccgaagatattctttcctatcagggaatctaggatttctgtttaaagagatgattttctctaactttggaataagtaatacagctttgtcgtgtgctttgcctgtttccgcataatttgcgatattcagataaggatttttctcttctgcattctctttggtgaattcgtatgagcatattgtcttcagaatagcttctgacaacgtagtcatacggaacaacaagaatcgcaagttcctatcaaaaacgaaaagagcatacaagtcattgaacgacgtgccagtaagatatcggtcttcatgtgttctttttccggcttctttatcgagaaaaggatccttgtacccgttaacaatcgaataatagccttcacgttccaaaatccacggagtgcgcatgtcagtctgcagaccacgtctgttaagctgttgcacttggctttctatgccataaatggtctatacataacgcctccctaatgcacgaaaaccgttccctatctagggaacggttttcgcgaactagacaacgcctagctttatcgcatctgataaatttactcatgaatatcagcaatgtcaattcagcgtgtctcaacaggatttccgttctagagaaagcgcagcacatctcacactaacggatttctggtatgcgaactgttgcagagacattgaaagatggaaagccggaacacccggaaccagacctttgtcagttcttctggttggggacgagcatgatctcatcgtcgacgatgcccttcaaatgccggtaggggcccttgccataacgctcagcggactccatgagctggccgcgcgtgatccaaccgttctcgaaagagatctcccccacgattgcgatgggcaggccctgagcgcgctgcacggtacgcacgaccccctccccattactagcacaaactcttggaaagcaaagcactgtcagagccccgcgcaagccgcaccaccctcagctctgactttgcccgagttccgcacccttggcaggataccgcgcaacattctgagcaattaactcatcgcccatcaccttgccgaaatcagcccatggccacgctgcaaaaggcgagacgtcctcagacccatgatcctgagaaataatctccctgactatgctccggggatcatagcccttctcaagccgatcctgatcagcggcatcagtgaaataaagctcataacaacgtcttccctcatgaatccccctgcgccaccttgcaggcgtgatctcatagcccgtatggacgattgaatcatcaaccaaatcttgcggatccgaatagttcagcccaaggacatgcggatagaccctatccagcccacattccttaaacgcatgttcgaacacattgtcaaacgtcggataaagctgcggaatctccatgaatcgaattcccgaagcaagcagactgagagcagattgccccacaatctcatgtttcatttgcgtcttggtaagcatactcgatcttcctttcctaaaaaccgtcgttgcaaaacaccagatgttatgctcaaagaaaacgtctcagccaatcaggaagattgaagctatcaatagaccaagaatcctcttcatcttcctcccaaacattctctttaccatcaaagaatttctggagtatgaaaatctttccattcaacttccaagaaaatatccacaacctctcatccataggcaaagtatcatattcgtacctcatagaataagttcatgctcaacatttagattcagtatcaatatcacacttctcattttcaataaacacattcttgcggctaatccaagagtgcaaacgagccttatcgtctattttttcgcttatcgatacacataaatcaacaagcgacaactgcacatttttactatcacacagagtgcattctccatcctgaatttcccagattaaagcttcacatatatcatcattattcctaaactccaaccaatatttctccgcagttcgaagagcagaatcataatcatgttgcagaataagacaacaacaaagattgtagtaaccgagacatcgatttgtaaggccacgtttcaatgcatcctgaatgatatctccagcttcactaggggaatcgggaatgagacagaaccctcgtgaattttgagcacacgtatcgccagggtattgctttaaaaagaattgaaacaatgtggcagcagcaccgtactcctgacgagccaaatgccgtttagcagactcgtacacttgcatgtaaagacgagagttactcctatccgatcgcagaacggcacgcttcgcaatttctgaattgagtttcacctcatctagacccaatttttcaacggcacgttcaggaaaggcatctgtataaccgcaatggataaacttgtactctttacgtaaagatgaatcttcccacgctttcatattgtcgccaaacaaatatctgtctcttaaccaaacataggattccacgacagataaatcctccatgggagcaagattaagattatcccactcatcctttgaaggagggataaaacctattaaatcattcatagaagcagtagaagcccagatcttaaatctatggatatcatttaagaaccaggaacaatctttcccatcctcctctattccgaggatgttgcgccaacgagacaccatggaatcaggaagaccaattttattcaaaattacccctgaaataagaaaaacggcaatgtcatcggcaaatccatatctaagaacgctctctgtaaggccgtgcttttctaatgcggtaatcatttttttgataagggaaatacgttcatgcgctttttcgtcagtgtccggaatgggccgcatgactgcggaataaagcacatagaagaccttccgcagaccttccggaatccgaacttcacaaacagcgtccatacacgtattctctttccttcttcatcaacagcgatatttttatataatatcatgtatacttttttatgtataaaggtttcaaaaaacgcaggagtatgatgatggggacttttcaagtttccgatttagcaagaaaaagaacagcagtgatagaagcggctcgaaccgactgcgccgtcattcgagataaagaccaggatttggtcatgctgaaaaaaagcagactgtcgaatcttgaaaaatatcagcaatggtctatgcgtctagaaagactacgcagcattatcaattcagagaatcgtcccaacacagtagaatggggcgatttagcatggttgcgcgtcctcgacaacgatgatctgagcactttctgcgaagatttagccaatgaactcattatcgatgcctctgaagatgacttcaccggtctcgactgtttaatacgagagtggcgcgcaacagccggacagcttgaagacccgttacggaaacgcatcctgctatcttcagagctcgaaaaagcggacttcaccgaagcccaggcaccagcatcaggagcggacaatgggagcatatgatcccgaagtgccagcaaagaggccaggagggaaacctatcaatgcacctaaataccgcatattggttcatagaaagtacgaagcagcttggaatcagattgtcgaacgggttggcttgcagcaagcccaacaattctgggatcatgtcgcatattcgccaggcagcaaagaccctatagctaatagctgcttcctgagaggcaaggctggaaccccaaaagggaaaggcttctctaaaaccatccattatgaactttcaagcatggctcggatcaactaccagtattgcgacgaatatcaaacatcgccacagggagacaagcaccatgtcgttttcatcctcagcattgactattcgtctcactgatcaagacaacgattccaaaactaacacatagaaatacacgacaaccagtagagaggcatagccacatgccagggaccatgacttacgacatgtaaattatctctcaggagtcattaaaaatgtgacaacatttgttgaactcgctattaatccgcgcccgaactgctggacaccgcatctggcagttcggcgcccctctcgacaacgcctcgcacagcaaagcctttttgggagtcaacgccataaaagagcagttcaatcaagctgcatcttccaatttccaatcgctcttttgtcttagcaaatgaaaatcgttccgggaaaaatagctacgctctcttccggaaacccaaaccacaatatacgtaagaatccgaacgccctttaaatataaaaaagcatttagaaatcgaatcgtatgtacattaccgaatctgtgaatatccccgacgaattggaaagacaactcaagagggaccgtttggtccttttttgtaggcgctggagtatctgttccttccggacttccaggtttttcggactcgctgccgaactagctgggcagagcggccacttgtcccctgccaaaaaggacgctgaccgactggactatttcataggccggctttccgacgatcatttcaacacccatgaaataacaaaaaagatttttcaagagaaacagcccgccgccaacagcgaacatgcggctgtcatggcgttagccacagcctgcaaaacaccacgaatcatcactacgaactacgacaatcttcttgcagaagcgacggatgaacaaggccttgattatggcgaacaatacttcgcaccggctctccctctcggacgtgatttcaaaggattagttcatcttcatggttccatacttagacccagcaaaaatatggtgcttgatgataaagactttggaaaagcctacttcactgacggttgggcaacgcgtttcctcactgaagtgttcgccaactacaccgttttattcattggctacagtgtcaacgatcctgtcatcagatatctgtctctcggtctgcattccaatggacctaaacatttcattttcctcggtcatgacaacgaagagccgaaagaccattatgaaaccaccttggccaatttcgaacatctacagttccagaccattgagtatcccgttcagaacgggagtcaccaagcactaatcgatgctcttaacgcttgggccgaacacgaaaacgcagtcagttccggattacattcgaaaaacaaaagaacttgttgaagcgggtattccgcaaacacagcatgacacagatagtctccttagcgaactctccacaccgtcgggcttagacacttttattcaaaccgcaaaagaaccaatatggattaattggctctacgagcaaaaacgatattcaacgctgttcgatggcacagagcctcaaacaccccaacagcggcaactcctcaactggattacacgaatctgcaacataaacttcaatagcgagagtataaccctgcagtacatcaagctatgccagcagagactgtccgattatgctttccagtcattttcaacatccgcaattcaacctagcaacgatggaacgccgaagaaagcgctgcaagcattcctctcaacatccataaaagataaaacaatgccgtatatgccgcatgattctttattgtgcggcttcgaagaccaattccgcgcttccaatattgtttgggaagccgcattgcgcccatttttggagtttgatcgaagctcaaaattctatgagccagatccggttcctttttcttccggcgagaagcccgatgtcaacgttagttggaacattccgtcaagctttggacaaggaatcatcgatgacctcgcctcaagatgcgagcactcgccgtccttcgaaaggatcatcgaaaattcaataaatcaggcaatgaatttgctttcagaatattattcggattcgaatcacgaacattggaacgcgttcattcgcatttggatacctgaaattgaagcttgtggaaatacacgaggcgatctacatctcattatcgatacacttcgcgtatttggagagcagcacaatgagaaaaacgaactcgccaatcgctggatccacagtgatcaaatcgttttgcggcgtcttgccatccatgaacaggaaatcagcgaagcagctcctgatgaaaagcttgagtggttgctgaagcagaatcttctttttggcagattttgcgaacatgaggttcggcagctcttcaaggctgttatagaacatgtttcagcagcacagaaagcgtcacttctagaaaaactgcagcctccgtatagccctgaagatattccgaatagagccaaaaccacagacaaagacgaaagacaacggctcatacgcttgtatgagttatttaatcgggtctgctggctgtctgcagccgacccgaattggcatgaaatacagcagctgcaatcactctatgaaaaagattttggctttgttccagacccggactcagacgttccgctcaaaatttatcattcagtaaaaggacgaatctctctagaggaattcgcctcattagtcaaacaatctcccagtaaagcgatttccaaaattttgtctttgcctaaggacgccgatgcctttgactcattctcttttgaagctggatgcagactcatcggcgaatattgttcagagcatccgcaggatacccgcggcctttgggacgccatcctagccgctccaaacaccactgaatatgaaagagcgcagattgttctgtttattaccaacgagattcgaagcgcagacttcaagaaggatgtttgcaacatcacacaacgcgtatgcgctttcgattggaacgaggctaatctttattcaccgattttctttgtcacagagcaaatcagtcgaattgaatcagaaaacgcagaatcatttttccagacagcccagcatcttatagattctttgattccaaaatatggccaggcttttcatacagagaagccaaacattaaccaatttgactatgtagcctgtaacctatggccagctctcatcatcacgtatcagattaaaacagtgttataccgatacacaaatacctcgccaaccgattggaatggaattcccagcaacgaaaaaagatagaatacagaatctcttaaaccagcccaataacctcatctggccaatacagatagcgtgcgcccaaaaactagccgcgttctttatccttgataaaaaatttgccagagagtgcataatgcctctattccatgatgaaagcacccaacatcaaacatgggcggctttcctcgcttttccgcgtattaccagtagtttttccgaaaaagatgtgtccggtcttctcgaagatcaaatcgcagaggctagaaatctttgcgaatacaaggatcaaggactccgaaataactactgggatgttctcttcaatttcatgaacatgccacccaatacaagcaacgcatatgatgcagtactgaaaaaagtactttataacagtggattctctacactgtctgagattgcaaagtttctcccctattggtgccgtcagcagaatgatgaacaaatagatatcgcatggaaaaattggcttaagacgtacatcaccaatcgtttccaaggaattcctcgcgatcttgattctgaagaacaaaaagctctcatctgccttattccaagcctaagagggcatatctccgaagctctagaaatactctccacgacagataacaccgacatcgacttttcccaagaccattacccagtccccgaaggatatgacgaaaaggaacagcagcaattattactgttttatcagtggcaggttaagcaccaaaccggcgaatgcgattcaacgttgcttaggtggtggttacatcggattctcagaaacctgacaaatgaataccctgatttggatctgactgcgctccgcgaaacaatgcaagaccagttcggattcacaggaatagccggaatcgattgactcacctgaccgtttcacagcgaacgttgctgggacgaacctaccaatcagctcaggcaattgcgagcagcgggaccacggaaggaaccgacgaattttgtcgcacgattccgattttcggggcaaatttcgaatcgtgcaacatttttcctgccgaaatgcggttttcccacctatttcatacccccgaaccggctttcccgacactttcgcgcgactacgggggtgtgcgatgtagcacgattccaaaaaacggccggaaaatggaatcgtgcgacatttacgggacatagaacataccgaaacggtcgggaccatgcgattatggcaaaaaacacatccaaggcgccgcttttcatacattttgagtccaaggcctcccctatcggaaacagaaaccgagagtcccggaaacgtcaccatctcgtttatgccagcaaagaacaactgaatttctgcatatgttgctttcgactgcccaaacacgagactagactgctttttgactccatacgctgaaattatttgatatatctgcatgtagtcaatgcgcatattcccgaacaaggagaatgattcaaaatgacggaaaccatagcatcacttattggagccattgtcggagcaatcatcactacatcattctggtttgttcagcaccgcattgagcaaaaagacgttctcaataacgaacgaaggcaagacaaaagagaactcgttaaaaatatcatgcgcaacaggatggatcaacgagcgctctgcgttgaacttaaccaaattccgctcactttttacgatgatccacaagccaaagaactttatagaaaacttctggagacgcacgacgttgctacaagggatacgattttggcggatctggtgaatcatctggctgaaacaatgaatttcgatggtgaaattcatccttcggatttcagcagaggactatacgtcaaatgacatataacgaaaataattcctgagcattatgtgcaagactcgaataatgctcgtgtctcaccgcacgttcccgatacactggttagtagagcaatatatcacgttccttgggaccgaacatacgaaaaaactttcgcttagttcccacggaaaaaattcgcagtcctttatcgaggctaaagttctttaattaaatcccgataagctgatgctgtaattgatattacataccaaacccaaccagctaaatgagcaatgagaaatatcactaaagctgaaaaccacacggggaagataccctttttatcacacaacctaagtgatgaggctagtccaattactaatgttatgatcaaagacaaggcggatgcatagacaactgaataaaacatctggtcaatcatctctataactgccgttttctccattagaggactagatgcttctgacgctcgtctatgttttgcatcagaatatgccattcgcaattggaaaacaaatattgcatgagcaaaaagcaacccaccaagaactccaactcctgacacaataatgtcagcattgcccacttgcatcttacgtacgaaagaaagcaccgaacaacctattggaatcaataagacaataacaattgccagcaaatcagggtgacgttgtttccttccttttgggacaagcatattcaaacattgtctaaaaactcccatttcccctcacaatatttgcgaagtattccatctaaatttaagagaatcttctgaccattcactttgttcatatgcagtagaccattccaagccaagacacttataacgactcgctaccaattctgctgctctctgctgaaaggcatcatctccgagaggtaaatcgcctttctcagtaagaacttctcggaaaactggcgcaccaactttgccgagttctatagtcttcgttctcccttcatgttcaagcgtaatagtgcatttcttatccaacgaatcagactctttatcttcagactctttatcttcagacgttttgtctggcgaatcagacacttcaaaaagctcaacgacatcgataacgtccgaattcctgcgcactttcggttttgttcttcgttgagatgttgaagcgggcatggcccgcgtcctgtgtacgattttcagtcgccaaacaaagaatcgcaattggaaagcaggacgcgcagccatgcccgacagcaacatcatacagatcgaccagaacctgttcgagaccaaactcgaccggctggtcaccgagaagatgacccagatcctcaacgccatgctcgacgccgaggccgacgagatcaccggggccgccagatacgaacgcaaggaggggcgcaaggcgtacagggccggccactacgaacgcacgctcacggcaaaggcgggcaggctcgagctcagggtgccgaaactcaagggcgcggtcttcgaatccgcggtcatcgaacgctaccgcaggcgggagtccagcgtcgaggaggcgttgatggagatgtacctggcgggagtgagcacccgtcaggtcgacgacatcagcaaactgctgtggggtgacaggatgccatcccaggccctttccgacaagctcaagcgcgtgtatgacgacatcgaccgatggcgcacccggccattggaatccgaatacccgtacgtgttcgtggacggcgtgtggcacaagcgctcctggggcggaagcgtggagaacgtcagcgtcctcgtcgccatcggcgtcaacgcggagggccaccgcgaggtcatcggcgtgacggagggcatgagggaggacgctgccagctgggagcagttcatacgaagcatgatcgaacgcggtttgaagggcgtgcgcctcgtggtcggcgaccggtgcgcgggactcgtctccacggtgaactcgatgcttccccgggcgaagtaccagcggtggattggcaacggcgtgttggacaattctttagaggacgagtccctgttcggtgaattccttcgggctccggtatccgagggtggagtggagccgctggttgtcggaccaccacacatagtcgttgagatcgcccctcagctgctcgatcgtggtgtagtggttccggtatatgagctccttcttcagcaggcggttggtggattcgaccaccgcgttgtcgtacgggttgcccttgcgcgacagtgatcttctgatgccgaacacgtcgagcagcccgtcgattttcgcgttgtcgaactcgcttccccggtccgtgcggaacacctccacgtcggtcagggggaagtcgagcgtggcgaacgcggccatgaccaaatcggccccgcggctcataccggcggaatggccggcgatgctccggttcgccagatcgaccagcaggcacacgtacgcccagccgcccccgaccctcacgtacgtcaggtcgctggccaggtgcgtgcgcggggcgtagccgtcgaactcgcggtccagcaggttcgcgagcttcgcctcgtcggcccgcgtcctgtggggcttgaacgtcttgcgcgcgtacgagctcgtcatgccctgttcgcgcatgatgttgccgatgcgccttctggacgcggtgacgccttttctacccaaagcggccttgatcttcctcgccccgtagcgctggcggctgtcgcgccatatcgcgcgaacgtcgccggcgatcggatcggccctctccacctcgggatgttcgaccatccagtagtaggtggagcggggaacgccgaggattctgcactgcgctgatattggatacttggcggcgttggcccgtatcacgcctactttcgtgcgaatatcagcgccgcttgttttaaaacatccacctccatctccaattgcctgttgcgtttgcgcagctcgatcagctcgatcagctccggcgtacggttgtccgcggccctggtggagccgctgttgcggatgccctgcacccaacggtgcagcgtggaatgcgagatgtcgtactcggccttgatctcgcgcgccggcttgccgttctcgtacaactgcacgatctgccgcttgaacgactcctcgtagtggcgtggatgtttcgggtcggccatcgtcggcctccaatctcatgtcattcgtccctcatcggactgtctaat
